United States Patent 7,820,447 (COMPOSITIONS AND METHODS FOR CANCER) - sequence listing, part 3

SEQ ID NO: 1241 - DNA, 51705 bp, Mus musculus
  misc_feature (30574)..(30593): "n" at positions 30574 thru 30593 can be any base
  misc_feature (33640)..(33862): "n" at positions 33640 thru 33862 can be any base
  misc_feature (41890)..(43443): "n" at positions 41890 thru 43443 can be any base
  misc_feature (50508)..(51705): "n" at positions 50508 thru 51705 can be any base
aacttttaataaaatatagttgcatacaggtgaatatagtcttagcatacaaataactggttttctctaaactgtagcattcctggatgctttgtgaaagagattgggtcttttcatggaagtgtggggagagggaagaaattacttagagccactgaactcttgatcatggattccttatttaaggattcactgtttcttgatcttggggtgaataacccagtcaatgtgttgccttgcaagcatgaggacctggggtcaaccccatgcaggcctacagaacaacaccagtagcagcaggcatggtggttcatacttctcagtcctggagaggtttgaacacagggattcctggggcttcctggccagcctagcctgttcggaaagcgccatgccagtaagatagcctgtctcaggaagcaagacagatggagggggtctgaaaaacaaaagctaaggttgatctctgttggatgtgcatgcacacacacatacacacacacacacaaacatataatccacactcgcatgcacacacacacacacacacacacacacacacttcactaaaatgtatttgcaagtctagtcagttatagcactctgtcattttttgtggacatgcacggaatgatttcattctgtttctgtgagaaaacctgaccaaaaagcaacttctggcaagaaaaaggtttatttggaccctttcaggtcccagtctgtcattgagaggagtcagggtgggaacttaagcaggagcttgaaatgaaaccatgtaaggatcctgcttgctgctcacgttctgacctgtgcttctgtagttctcttatacagcctaagattgcttgcctagggattgtgccgcccatggtgggcaggaccttcccacataaaccatcaatcaagacaatctctcacagacatggatgcaggccagtctgacccagacaatcactcaatcgaggttttggatgactccttgcttgtcaacttaacagatgaggttagctaaccaggacagtggccctcttcttgtctcacaacataaacagtgcccattttcttgatctatttagggccacgttttaataacagatttttttccgtgctttttgttggtgccatccctactgaaaatagtcctaagcgtggggctaaagtgctgcctactgtccctaaacacaaaaaggctgctatgtgcttcattaagtaaattcccatgttgggtgagattcttacaagtattggagtcctgcccagaactcaatgtcagtgtattgacaatggatgggagttgtttctttaaacagatgcatatctgctacaaggttgttccttgtctggctggcagaagtataatcaggggatctccaggattaactttaaaagttccctgagaaagagtggttgaaattttgtaaattctagcacttctgtgggaagtatctacggctcatcataggaagtaactatatttagtgtcatgcattggaaagtaggaccaaggtcaggggaatggatgaaatggagagaggatgtgtgagccctgatgcttgtggtggtaaaataacctgaacactggggttcatccctgaccctaaccacagtagatggtaagtcctaggttcagatggtgctgctctgaggggatctaggcagagtactctggcccctggactttctgtaaacatggagaagtgaggggagataggggtaggctggcagcatcctggaacacaccctcagccatgtgcaacttctttcctcacctcagttctccttctctcttggaatctgggtaccagaaagtcttctccaggctaccagagcccagaccactggtttgttgacagtatgtcgagatagttgttagtcgctggttgtgcctctggtttgcctttgggtatctgctttgggtaccaggatctaaggagctgcctgtgtctgccctgagaaattcaattctttaattagctcaatagccgggcagacacggctgttgctcagtgtctctggaggtcattgactgacaagatagtactacattggtgcctgtgataagacaaaggtcacacagtcctccttagtcctgggactggggaacaggcatgtgattgtctaatgggaaaggaaggtcagaagtcagttggtgagtaatgtgcttgctctgcagcatggagacatgggctgacaatcacccatgacaagggcagggctggaaaacgtaatccctggtctagggaagtaaagctaggcagagccctggagctccgtagccagtctacccaagccagggagctctaggtttaatgatagattctgttacagaaaacaatgttaaaaaacgagaggaagataccagatgttatgtgtgcatagattatgtgttctcactctctctctctctgtcttctggctgcctctctctcctctctctgtgtctctctgtctctgtctgtgtctctctcacacacatacatgcacacacacatgcacacatgctcacatacatacacatgcacactcgcacgcatacacacgcaatcacatgcacacattagtgcgaaatgattccccgtaactggttatgactgctgaccaatgctcagggctagcagagggagaggaaaaccacccagcatgtaggcagcttcctgaaagcgttcggcttcctccattagctaaactacagctttggaggaacggcacctttaggtaggaagagtgccttagccctttgatgtctgcagtctctaagcgcaagcccctctcatgctccactctgcacacccatggagtttgcttgacaaattcaggcagccattgacctctccctatagcagagggaggtgagaatcaactctgagggcttcagtctgagctagaggcacactgacagctgccatgcctctggattcagcatttctttcctggagtcctagggctcccaggaagccagtcatagactcgtgggcatctctgaggtgggtgtctgttagtgtctgtaagactgcaggaagtgtgctctggttagcccctggcataaacctagcaaggatctagcctgtgaagaagcatggccacgctctggacttgaccggtacagtgttctgagggtgggatgacaccatttggtacccaactgtgttctgagggtgggatgatatcatttctgagcatcctgatgtgtctgtccctgtttggtgagcacctcccttcctgaaaatcatgtgtttctattcctcctctttatatctgtgaaacccactcttcctatctgcgcagagcttgccatcccaaggtgccagttgccatggttcccatcttccatgcataatcaaagcactacagtcgctctgacactgccctccatagtcataggagagctggggaggtgcacaggtgtcaaggtactgcagagccagacaggacacctgcagagcttgcgtttagcttctgctctgcatccctgctgccttctaggcttagagagcatcatagccaagagtccctctaggcctcctgacctctgctgttgtacagcaccatgcttagagaaacagagctggcatcctcctcagattggctgctcctgcttgcaggagtccatcaggagccagtcagtggactgcaacctcagagaaggaaggtgtggttggggtcactggaccctcaagcaatactatagacacccagcctagtcatctgtaattgtgcccctacctatgtgtacatatggcttggcatctcagggaaggggtggagtgtgtaggatgggaaagactagctagagaatgggagttctagctatgtagccatggggaagccatcatccatgctgggtactgatcttctagtgtagttgttttagggtcccctacccataaaccccttggccatgttctataactaagcctaaaaaacccgttggtcgcttagagtgaatttttgtggactcaaaattctttggacccttatgaggaagggggagatgtttatgtcatctctggggaggagtttccacaacgtctgctcattgttgaaaatggtcttcaaataaatgagggtacattgagttattttaatagattagtgaaaccaaaggttctaagacaggctgcatcaaatttgtgctcacgtcactgcaactaatctagtggtagtagaagagaagtccccccccaccctaaacacacataccaaggactggtccagtctctctgtcaagactacccaggctgagcagctccgagatgctactgtgaacagttctagagaacctaatgggtgggatggggtggcaatgcagatgtcctcgtatgtaaatagagggtgaggagggtgtcaagaccacatgtggaagagaaacttctcatcattctccgggagcttagggcagatgctggacagctgggaccatccccagctgtgtttgttgatccctggcctacaccaaggagatcagagcagcagcttcagggttggtgatatatatatatatatttatttatttaaagaagcttatacaacatgaaattatgtggggaaattaagaaaaatatgcacatgctggagatactgacgaataggaagaatgtattgactgcctgtaggcaggcctttgaggtacttaagaacaatatatgccaatgatgtcctagggcttcagagaaaaggcagggaatccaatgagacagcctttcattactgaagcatggagcaggtgacagaggtcccttccttgaaaaaaccatgagtttgtgtaagacatgactgagctccatcaacacagacactgggctagacatctggacagctggtgcgctgctctccaggatcctctggacttatacaaattgggcttttagcattttcattaggaaaatagcctatagccacagtaaactctctaaagaagagcatgtgtccgttaggcacatagtttgtggacatctggtaggccctgaaacatgagccaccgagttaaagtgtccagacctttgaaacttacattttcatataaggcaaagatggaagcaatctataagggaaatggatacttaagtgaatttaaatgaggatgtgttggggatcaatttgagggctaaaggcacacactgaaaaatcagatcatgaggctatcaagggggatgggaggatcttagaccacaggcctgggaaggaggaaagtcattagcgaaaatgctgtaaccaagagaggataagcctgacatccgaggcctggaaggacaatgtgggacacagctggagtggctggagtcaggccaaggagggccttgtaggccggggctgtacttgctaaagagaaaatggacaaagaatgaggcccagaagagaggaccaggtaaaactgggaggtgggcattacacaggccgtgttgggaatgggtgaagagcaccagtggcttggggagccatttacagactctgtgttgctaggaaactccctcaagacccttcagccattggccacattggtgaagattgggactagtctactccatgtgtgtccatgcttagagagagaacaatcttttatgactctagggatgatctatggaagacaggagagagggaaggctcaaaacactcttcagtatcatcttcactggctattgcagttgctatcacctcttttagggaagaaagcaatgtagtggtccccccagatgagggttcagggtaaggagtggagttgggaaggtcgagctacctcttgggcatccaagagtaatttagatgaaccaacacatagggttgacctcactagaaagactggatgtccatttaatcagcaaattacggtcagaaaaaaaaatgaatgaccctccaccaaacatcaagagctgctccaggcatggaggaattatggttccattcatatcttccacagccagctctactgatatgttaaagggaggtcaccttgttacactggaccatggagaagactgaagcagggaggggagacaaacaccaaggggatttcaaaatatgaaagaaaaaaaatcccctcagtctgggtggtagcttagtgggtagggtgcttgctttgcggggacaagggcttgagttcactaaccagaacccatgcaaaagagctaagcttggtggctcacaagtgtttgtaatcctgcagggagtcttcagcactagttctcactgggaaggcagcaaggaggccagagtttatttatctttggtaattcctctgcgcataactctttgcttttccaaggccaaaagccattggcttccagctacaaactcttgctagcagcagcagagaactgagaagaaaaatggcttaatagcaagtgcttctctctcaccagctcaggagctcctggctggtcaggggagaggctgggagcttatcaactctttgtgaaccagaaagaaaagaaaaggaagaaagggagacatcagtcacacacacatgcagactttggatgaaaaaagaaaagaggcttgattcacttcacacacacacacacacacacacacacacacacacacacacacacaccttctgattgggcccgactaactgtctcaactccacaactgttcatgcatacttacatacagacatctatacttatatattcatgcacacacacacatacacacatttagtagagcaaaagctcccatgagcaagttccattgagaaagtgccaacacagaaaaaaaatcacgcattctggatgaaaaataaactccaatctttattgctcagaaaaagaagaggcttctgcctttttattgctgaaagtaaggaaaggctcataagtaagaaaatctcatcctctttattgctgagaaaaatgcctcacccacccccctctcttgctgaatgaaagaaggcttgtgtcctactgacatcgttcttagttcttacactttctcaggagaatagatggcatggttttccaagcacctttacattctgaaaagggttcatagcgagttcaagacactaattcacgtcaataaatcgaacaagaagttacagcaaacgtgtttccatgtgtttccattaagactagtatctaaataaacattcactatctagcttctagatccataagctcattaaaagtttaaagcaataattcttatggtgtaagttagcatggttttgtcaagaggcaaattatttgccttgtgtctcattagttttgaagtttgtataggtaaatccagtcaatattttatcctctgtccttttacctgcagtaaatttcccttcccagtttatgaccttcagttatcagataatggtttctcagcttgcctagagggaatatttttttcctcatcataaatttgttgtaaccctgcttccttatcttagtgcaattagcctgtgacacatgaacagttacagaactctaattgcagcttccatacaatagaggattcaaaattacttgtataaatttaggaattctatataaccattataatcattattaggaattacaaaatcatcggtttgtctacatagcattactacaagagagtacatcctgacggatctgcagaaaatctgcccaacagactccagggtgcccaggagtcattagaatacgcaataatgacaggaaatctcttgtagtcttgcctttctgagctcacccatcacaggccatgcaaaaaatggtggcccactccaggaaagagacaggaggatcttgggatttgccaacccgccagactagagtatctggcaagctccaggtccaataagaggactgtttcataaaaaaggagagtgattgaaaacagcctctgaagttgacctctggcctctaaatgtaaacatgcagaagcatccacatgaactagcatgtgtgcacacatacatttccatactcctaaggtcttgcatgcataatttacatcctacaaggcctcaaaagagtgagagatttactgtgttctgatggctccccatatacctcacggcagcagagctacctgtaaggtgtgtgcagaggtaagtactggccaactctgggcacaggtacagtgaggtggagtagggggttgctttgtcaggactggggtcttactactttcctcaagttaatgcttttacaaagtggcttcacacacttgtcaatgtcaaactgcgcaaagatagtgttgcactgagaaggaagagcaagtgtctcaggactgttgagggtgataacagcattgtgagctatgaactctctctgccgtcagaagaggggagctcagatgtgacatgcaagccacagtggttggtacaatgagttcagtggtgcctggaggagcacacgtgtcaggacaccatgttacctgtgcccacatgacatctttgagttgtgcagccacatgggggaggatgactttcagagagaaggctgttcatctaactccatgtggcatgagttacacagcatatacacatacctcacatacacacaccaccgtgtgcctatgtgttcacacggtggtgtgtgtatgtgaggtatgtgtgtatgctgtgttaagtgtgttcagtgtgaggtgtgcttgtgtgttctgggtacatgcactggctgtatatactgtatgtggtatatgtgggctatatgttatgatgtctgtgtgctgtgtgtacctgtgatgcgtgatgtgttgatggtgtgtgtaccatgtggtatgtgtgcatgtgatatacgatatgtgtgatatgtggaatatattacgatgtggtgtgtgtgtgtggtacatgcatgtggtatgtgtgggatatgtgtttacagtatgctgtgtgcatgagaggtagtttgaaaacaccgagaggtaaatgctctctccccaggtgaaaggatttccttgtccagcatattccagacgaccagcattttttacttaaacatgctttgaacactttctgggtggcgctgtgtgtcttttccattcacaattgtgtccatgcattcatttctcttctgcagagtgcgttcctcagaggtagcatctccccatggcaagctcctcacacacctccacctactgactgatcatctgctatgcaggggaggtgggccgaactgtccagggctctggatgtttctcctagtggcacccaaggctggagagggcactctgggtagatggcactggttataactcagggagccacttgctgctctttccaccccaggcaggagatgagaaagcctgtggtaacgaggccacacctatggctctctgagatgtgactgcaatgcttgtttatgtgaagtaggctccacagccttgggatgaagctcatctgtaggatacatttctagcattcgtgaagttcttggttataccccagtaccatataaaccacatgtggtagttcgtgcctctgatctcaaactggggagagggaggcgggggaattagaagttgaaggtcatccttgactacatactgactgagttcaaggtcatcttgggtaacttaaaacccaagagactgaggagggatgcatagcttttcttagcccgttctgtgcctactggggcccaccgggggctttgagttctcactggttctgttccgtggaccactgtctaccctcagggtactacgcccttgaggactgtgtccaaagactactgtgcacttctctttttctcagtttcttcttagaattccttgtattaactagaaaaaaaaaaaagaatgatagtgaattgggtcaccttcgtcaaaagccgtgggtttggttagctaaccacaggatgtgtgttgggagaccgtgggaattaggtaataatagaaagtaccacacaccaaacacacacaccagtgtaagcactctaagcttgtatccctgtggaaacggttctggtagtcatagccagtgtctcttgtggtttgggttctgcattgtgactctcccgtctttgtgggccccaggtacttctccatacacttcccagaactctgaaggggtgcagacatggcgggaagtgctgtggacagcgccaaccacctgacctacttttttggcaacatcacccgggaagaggctgaagactacctggtccagggaggcatgaccgatgggctctacctgctacgccagagccgcaattacctgggtggttttgctttgtcggtggctcacaacaggaaggcacaccactacaccatcgagagggaacttaatggcacctacgccatctccgggggcagggcccatgccagcccagcagacctctgccattaccactcccaggaacctgatggccttatctgcctccttaagaagcccttcaaccggcccccgggagtacagcccaagaccggaccctttgaggacctgaaggagaacctcatcagggaatatgtgaaacagacctggaaccttcaggtgagtctgctgggcttgagcccacagagttctctaaacatattcagagcctgtgcctcctttacccaaagactaggatagcagatgcctgtgtgctgctgcccctcgctgcctctcttcccaccccatctgctcatgggaccaaagcggagtcctcacatcctctctgccctcctcctttcaccacgaaggagaaggttgtgttttaactttattcctttgagtttttcttctttgaaagtccaactctggctattcattaccaagatctgttgttctctcactaggaaggaaaagggaaccagccttctccacacttaatccatctccatgttgttatttccaccttgtttcttcctggtccaggctgctggccagggcctcctctgatggacttcctgcaggagtgttggggtaggaaagatgggaccgacgacatggctgaaccctgatagacatgaagccccaggtgccctccttacacatgtcatccttttaaactttctttagttgcatgtactgatttcgtgtgttggaggcgggtgcctacaggtctacagcatgcatgcggaggtcagacgacttgcaggggtcagtctctcttccacctcatggagttccgggagtcaagctgagacggccaggctcagcagccagcatctttactgcggagctgtctcaggacccccaacctcacacacatcttatagctccttggctgttatgaaattaccaggtttcacactgaaactagtttgagtatagagctttggagtatctattctcttagcccattggtttatgatctatatattcaaatatttgtatggcttttcaagggcccatctcttcattccgaagcatattcctttatttatacacttgatgacatgcaagtaatatacaaaagtcttattggttttcttatgaatgagagaaagatgatctagagggaagcagagtttggtgttgataggacctgggacagatgggtctaatgtctttctacctggccagctcagtctctctccattcactgcagggccaggctctggagcaagccatcatcagccagaagccccagctggagaagctgatcgccaccacggcccatgagaagatgccctggttccatggcaacatctccagagatgaatcagagcagacggtcctcatagggtcaaagaccaatggaaaattcctgtgagtgacaagccatctccctacctcctcacccagagctaacagcttccccagttagaacccaggtggcctgggaaggtgtcacacaccatcatctaccaacacgggagttgctgtcacttgtgacccagcatgtgttttatctagcctgcccgtaaagattgataccgtgcctaaagaaaatggtgttcagtcccacgagggttgggtatgttatccgtggtgagagcagaagttctttggattggaggtattttctgatggaggaatatttgcacacatgtaacgagaaatcttagtatcttatctaagcctgccctagaaattcatttatgttttagaagcacttgatgcttataatctctaggcaatcaatttcctgtgtgtgtaggttttcctgctaatgcatgtaaatgtatgtgcacctgtgaatggaggtcagaggtgtacgttaggtatctctacagttgctttctaccttatatatcttagtatctccttcttatttcttattgtgcgtgtgcatgctggtgggtggggagtacttgtgccacagttgaggtcagaggacaacgttcatggagtcagttctccccttccacctttacatgggttccaaggattgaatccaggtcaccaggcttgtgcggcaaccacctttgttcgctggccctcccttccaccatgtattttgagaaacagtctctcaaagaagctggggtttgctgatttgtctatactgactggtcagcagccctcccccccccccccaggaatcttctgtctgaacagaaatagttctgtggtcttcagtctggacagctcaataatgtgaaggcttggatcttggattcttgacctgggtatctgcagtgggtcagtgtgagcctaaattcagaaggttctggagcaaattgggcagtgtaactgagcagagtagtagtctggggtgcagagaggctgggagctgtccttgtgtggttaagccttctcatgtaacgatgcacctgccgagggagtgctgtaggaatgcctgcatttgtcaccccatgtccctacacagaggccttctgggaaccaccaccccattccttccagtgaaacgttcttagattcaggggtgtggccttacagtcaggcaacatgatcagtatcaggttgtcttcctagaaatataggtgtttcctctgcatttgcatctagctaaagaattttctcttacttctgatattaaaaaaaaaaatttaaggtgctgaaaagatggcccagtagctaagagcactggctgtttttccaaaagagccgagttcaattctcagcacccacgtggcggctcacaactgtctctaactccaatcccaggggatccagtgccctcttctggactctgcatgagctaggaattcatatggtgcacagacacatgtgcaggcaaagcacacagagacgtaaaaaaagaaaagagtaaaatgaagattatttttagattatcttaatcatttctctttttaaaaaccttttgttggttctttgtgacttttaaatcatgctccccaatctctcttatctcccccttcccttgtaccctcccccaccctttcaaactccctgccaacagaggaaaaaaagatctcatggaagctgtagtatgtcacagtgtgtcccagagcatacccttttgttcacacttctgtgcttgcaaatattcattgcaatgacttgttggtcttgtacaaagcctctggcttctgctactctcttaacactggaacctcactgggattcctctcagatatcctggtgttgccctatgtcatggagatcctgtagctttggatctataggaccagcccggcagttcatagatggggtacatgttgggatgggccattcaaagtcccgaatctgggcaggtatcttgtgtgtggctgttctgtgagtataatacaagatgcacaggtcactctgtgtgccatcttccatgccacgcatgctaagacagacccgtgtcctctcagtcctgtcatgaggtactcggcaaggtctctgtgtcacttctgtacacacccctgctgggtgtgaactcgtgcacagagcacacctcatccatctccactatccgtcttgttcttagtgctcactacagcaaggagaaagctgagatggccacacaggagatcttggtagaaacagaagactggatctgtttatggtccagtgtacagcaagtcctccattttgggatgggatgcactcttgaatcccgtgttagtagtaatgccctgctgccttctctcaggtgtgagcccagaaggttctggaagccttcccctcttctctttccttcctcaccctctgttcatttcccaccgtaatttcccagctgcctgtggaggaatgacagggaagaccaagtcaacgggagtaggcaccaaagctccctcctcactgaaaagcaagcacagcctacctgcactcacacggtttgaagtgccactttgacaggccagactctttaccacatccttcatcctccgaggccccttcacactgaggaattcaagagtgaataaaactttaggccttcagcctgagcctacaggggctgctgacagaaatgcacaaagtataggagtctctagggcagctgtggaggcagcaggctaccattgtattcctcagagctgtaaatttcctatttgtgctgtcatcaagccaggaagtcactcaactgctgtgtgagccacagttcctattttctgacttgtgacatacattgtgcaaagaagaagaacaaaaaggaacacagaagcagttattcattcaacaagagagccgtgtgtctgagtagataagcatacatcatcatgctttctacgtcagggaagatgccagccatccaggttcacatgctacagagcctgtgacacgataacatgccacttcctgccatggtgtctcataaaatatgtgtttatgtatatacatattcatgagcatctatgttcatgtatgcacgcatgtgtgtgtgtgtgtgtgtgtgttagggaggggtcagaagtcaacactcaatgtctctctataactttccatccattctgggtgtcttgggagcaaggactggcctcttgtcttcaacagctgtaatcttaacttgtatagtgttgcaacgggaggacctctctgaggacgtccaaggggctctgagagagaaagaggaggttagctgaggaagggcatgccctagccgaagaagtatctgtgagagccttagtgacccagtattgccagaacatgttgcatgtgaccagctatgggaagggaggtccctatgatgtcgtggcaactgtgttaaaacccttactttacttagtaatggctccagacgaagactaatgatgcccaagagaagctgcgcttatgtggtacttagttcagtaccctctagtttcaagaatctgctgggagtcaagttaagtgctccctgtagatcaatgtctgctttcctgttccaccatccacaatgttccattgtgaagattaactgggtcaagttcggagacaagctggggactgtggtagacctgtgctccctacatccaccgatgtttccaatcaactctaaagaacgcctaccttccccttgtccttcagaggaagtgtgggctccttactgcagcctctccagcctgcttaatgtctgttgcctctcctcccccatgtcacgtgggcctgtcaccatgtttcttctcatattaacttttgtttgatctctgtctaatctgtcctttttttgctcattaacttttaaaaaatagttacatctttcaatgtccagaaattaaatttggagtagggtttgtttacttttcacaattgttcctcggcatttttaggagcatctcgttggttggttgctgattcctgttttgtttctttaagcgttccatgcatcatcgctagtttgtatcccatctcatagttttaatactgagcatatccaggtatacatataattttcctccatgtctctctcttatccgatgcctcttttatcataactcatgtttacttacatctggggtgacctttttgagttcatatttggttgatactcatctgtggggatgcagaatgccctgtgctcaagtgctttccttcaggattcaagtggcggctgctaccctaaaggctggctcctgcccactgtagtgctggtaactgtgtttgtcctcaactccactaacactggtgtgtgtgtgtgtgtgtgtgtgtgtgtgtgtgtgtacatgcacatgcaaatgtatgcaggtgtacatgatagtgcatacatacagagggtagaggtcaaccttatatgttacttctcaagagccaaccacattgctccttcaaaaagtgtctctcactaggacctggggctcatcaattgggctaggtttcctggccagtgagtctcagggatctgtctctctccacctccctagtgctgggatttaaaggatatgccccctgccccaccctcgcttccatctcctcccacttgctcagcaagcattttactgactggactatctcctcctcagccccaagctcgtgctgttgctttcatttgccaaacaagtttgcctcctcaagttccagcttacggggtgatctatgcctacttttcaaaattatattgtgggcatcaaagaaacccttctctttgttcgttaaggaatgagacagtaactgttgtgagcctcctgggccacggcgaaagccgagttcagtcagtcagtcagtctgtcttcccacactggtatgggtgatcaaagcaggtcattcatttgatctgtgtgggtttgccaccagggcgatcaaaagaagcatcctagcccgtctgaagggaaagttcaaagacagccgtggactgatgtcagtgtcagtttactgatgctgctcagaggccctgggaagctggaagagaagccacaaaaaagaatctctacctagggactggagcagaaagacaaagagaaagcagcgaggggctgggtgtatgcctgcctatcttgtacagaccagctgtcagcctcaggagatagtccccctgggagctgtccacccatgagatagtccccgggagctgtccaccgagttcaccctggaacctggggcttgttgattatgctaggacatctactacctgcaagtcccagagatccacctgcctctgcctctgcctctgccttcccagcacagggactgtaagcaaaatcatgacacttggctgtgtttgtttgctgtttgttgtttggggagcttgctaactggcttgcttgtttgtttttgtttttctttggtggtggtggtgggggagggtttcaagacagggtttctctgtgaagccctggctgtcctggaactcactctgtagaccaggctggccttgaactcagagatccgcctgcctctgcctcccgagtgctgggatcaaaggcgtgcgccaccactgcttggcttgtttgtttgctttaatagggattctaaaggttgaactcagatcatcctggttgcaagacaagcacttttcctactgcaccctctccacagtgcagggagagatgattgtggaagatgtttcagaagacgcatgggtagagaacacaagtttggcatgcctcagatctggtttgctttagggaccgatcttgctttcaggatctgcacagacaacacccagtgttgctacttcaaggtgttggcaggcacagcgtttctgtaccaaatgtcacttattccaggatccctgtctcctgttttcctagccttcttggaaaggctactgtgcattcttagctctgagcaatgatcattttcccacctattattcccctctctcttcacctctctttccttcccctcctcttcccccgcccatcttccatcctctctcctcctgcccattcagacattttccctcccctttcaactctgaccccatcacagatgcccctggacgatagccacagagactgagtggtactcaggctggagtgaacctgctgtcctgctctctctgtatcagatgcagaccgcatccctagagttttacacaccgaagccttcagtatctcattatctcccaggccctccactcactgcctggtctcaccaccacccacacattcttttaccctggagggcacacaaaggtagagaagagggttaagcccttccagcaaaagtcacaccctcctctctcacatctatgaggggcaagttcaaggtctgtctgccgagcatgcacgtacatacacatacacatttcctcctactacttaccgaacttccctctccttaccgctcctcttaccctcccccttaccctccctctcctcctcctctctctctccccttaccttcccacttccccttcttccccctcctttctttctctctctctctctctctctctctctctctctctctctctctctctctctctctctgtattctatgcctacttatgtgtgttgatgtgcatgcccatgcatgcaaatgcagatgcccaaggaagatttccagaatcttcctctatcacttcccacttattcttctgaaacagggtctctctctgagcagaggctcactgcctcagctgggctggtcagcctgggagctcatagcatttgtctctctccaacctccgtcgctgggcttacaggcacatgtgaagatgtccagcctgatttaccgcaagtgttctcacccactgaaccatatcccagccccttacacgtgtgtgtgtgtgtgtgtgtgtgtgtgttttcacacattgtcctttctgcaagccagcacacattgtgaatggtttccctagaaaacaggctcaaccctttattcatatatggtgttttattgtgtgactgggcgttacccaatgaccaaccaggcttttatcagccacatagtcatcccaaaggagttggcacctcagggtgctcgtgactgactgtaggagggaggaggtgtttccacagtggtgaaatttcaaaacacaaatctacgatggcggagaagggtctttcacccttcaccagcttctctgagcttcaagcaggggcctggagggagccctggccactctgccaggcaagcgccatttcaaaagaaatcattcgtaaagttgcaacctcctcctactttgaggagatgggtatggcaggagaaagggaagtgaggtcacttccggtcccaaggcccagctcagcctggactgtggctgtggccttgatgttgtgtgcttggagaaagctgtacaaaccaccccagtttacagacacccttctccaggctgctgggacttgattgagctcttcccaagtccagtgcatttatgctggatgctctgaaaattcatcttccttcctttagcaaatgcagaggccacagaggcctcagggactcccagaccgcagatgtcccacggactcgcccttccccagatctcatgattagaacgcatgagttgctggaaaggcggcgaatagcatggcctcagaggaatgaggctctgaactgggagagtcacacctcctattgccatgccagccagatctcaccttctccggggccttcctaagtactgattcctcctatgatgtcaggactgccttgtgcctgtgtctcgaggttcaagggtgcacctgtatgttgtcactcgccatgggggcctgaagtcctacatgtagctcctggtaccagtggaacaatgaagtctcattcacctacagacgcctcaggccttgggctgtctctgttggctcatgccacgtggctatcattcccgtctcaggtgggggatgctacctgctaatgtcaaacaatgtcttaaacccggccttggcactgaagagaaagggaagaagaccataggagtagaagagttcataacctcctttgtgtgctccagaaagttctgttaacaagctcattagactcctcacctgtccttcacctgagtctaggggcttcacagacaccccaaagcctgtgcctgtggccctgagccacacccccccaagctctttcactgatctccaaagcgccatggccctgctggatctttgccatagtccatctccaacccttggcgtttccctctggctaactcgctggctctggtacagagccctcctgtcatctcgaggtctgggtgctgcgtgcccaccacctgcccatttgctggtgctggagagcacctgctgcccaccagggccaccaactgtagtgacggtactgcttcctaggtcaaaaggtcgcagtaggggtaatatggtgtgtgctctctctcgcaggatcagggccagagacaacagcggctcctatgctctgtgcctgctgcacgaagggaaagtattgcactaccgcattgacagggacaagaccgggaagctctccattcctgaggggaagaagtttgacaccctctggcaggtatgtctctgtctctctgtctctctctctctggactcacttctgtgtgtctctgtatctctctctctttgtctgtctgcctctctctctgtctctctagactctttctttctctggactctcttctctgtctctccctgtctgtctctgtctctctctgtctctccctccctcctggagggcacaatgcagacccactgggatgctagttccaaaactcttaggaacaagaggaggaacgaggctatctgtcccataccctccatcaacccactttctgatttctagaagacttgtgtgagaaatgttcacacagaccgtcatcaagtcaatgaagccacaaacaggctccgtcacctggttagagccataagttcctggtgcctcaagatcatgtattttagggcagcattaagaatttgacagaaggccatgccatcagggactggaataacatgtgcatgcatgcacacacacacacacacacacacacacacacacacacacacacacacacatactgtaactgatcaaacaaaaaccctagggactgtgacctagctggtcctggagctctgaaatgccagggtagacactgaatttcaggtgacatcccagtggataaccaatatgggaagcaccctcctaggcaagcatcctcatagccgagccaccacaggaagttaaaacagcttagaaagcaagtctactcttcctgggctgcagacagctgcctgtccaaagagcaccccatacctgctctgcaatgtgttctcaacctagctgtcagtaagcctcaaggcaactcaagcaccccaacattattcacccagctccccacatttgctactgagcacattccgcttccttaatttgatatcataactacattaactgtggatgcagaaggatcaaaagtagtaaattcaaggctagcctgggctacatagaaaaaatcctatctcagcaaataaacaaaaaattaagtcaataaaggactaagtgatggagatgctatggagaccccgaacccctaatgtatccctatctggctacgtgatggttattttttttaaactattttaaaattttattattattattattattattattattattattattattattatacataagtacactctagctaacttcagacacaccggaagaaggcgtcagatctcattatgggtggttgtgagccaccatgtggttgctgggatttgaactcagtaccttcagaagagcagtcagtgctcttacccactgagccatctcacctgcccgtgatggttagttttagttgttaatttgataccatctaaatcacctgagaagagagcctcagtgaaggattgtgtagattagagagtgagcatatccatggggattcttttgattacattaattgatgtgggaagacccaggtcattgttgggtggcaccattccctaagcttgagttctggtctgtgtaagagcagagagtgctcactaagcagtaagcatgcatgcattcattcactctccactcttgactatgcatgtgaccagctgcttcaaggctaaaaagtttgttgactctatccaaggacatctttggcccatcccccgagtaccctgtggaaaagagactatctggggtttagatggttttaaaacctgtgagggctgtgacttatccgctgtctccccctctctctctcttaaccattttcttccctgtttcttttccagctagtggaacattactcttacaagccagatgggctactaagagtcctcacggtaccatgccaaaagattggtgcacagatgggtgagtgatcggcacagaagaggctctgttttgggggagctagccattgtcaacctggtgtcagatttgccaaactcacacagggtgaggcttcggctttaccgtgtgattaaactagatgtcactcaaattcttggaatcattagctgaaagataaccataacaaaaacaaacaaacaaacaaacaaaaactagaagattttgattgcatgtgtggccaggatgttggcacatatcttcagtcccagcattaaaaaagcagggtagggaatctgtgagttcaaggccactgtcagaccctgtctcaaagagaaaagcttacttggtggaatgtgtgaaaaatccagtaaaagagaaaagtacagatgcagaaagttgagtctccccagtatgttcccatcatactgatagatctgagaagtagatggtttgaacaaacacagaagtacacagaactgtaaccatgacatattctccttccaggccacccaggaagcccaaatgcccatcccgtggtaagtattctctgaggcgtctctgctggggaagcagctgtgtctggacacatgggaaggtcaggctttagtcagcacgggatggatactctgagcacatcccggaagatctgggaatccagtgagtctgagaaagcctcagcctgtgaccaccgcccagctagacgtgttttcatggtttctcggccgttttattttctcttcattctttggaagtatacagagtgagacagaaaccccctaggagatcagaaaatccaccggtcagatgtagaaaaggggaatatatcgtccacgttcagtcttgtactgtctgtgtgaactcgtgtgtgccatgcacaggtctgccaacatgcatatcagtataacatggccagcggataggtatctccttgaggttggctacccaacttctttggcccaaccaattgacaccttattactagggacttgacttaaattgatttgactaatgattaggggaggcagggaggggccacttggcaagatttcaagagaaaggtccagagaaggaaggagtcttggccagaatgcacattccactccatgccactcactagataagaacggagcccagatggccctgtgttgggttaaccctttcattgccatgccttcaaagagagaagaacctcaagtcccctctccatctgggatgtcggagctggtacttaggttacttcacaagagcatctcttctcatatctagggtcttcagcgagcacatcccagctcattagcaccaccagggaataattcttgacttctatcttgctagatgctaaaaaacccaatatctaccaggcacatgttctgtctccaacaggggcggttggccacttgctactgaacctgttcattccagggttagtacttcttaccagactgagagcccttgagttggctaacacaccctggagctttagggtcctctgaaccacagtgccccctggtggcctcacctggtgtttatcattctgtgcccttgagacagatctgtctaacttgtgacccgagggttgcgtatgtcccaggattgtgtaaatgaaaatgttatattgcaaccactgacaccactgaacagccagtgactagagtctcttgtggagtctgagacacaagatttccacagacaacgtggctgcttcttgtctcagctttaattttgtagccttcagtgggaaattatttattgaaaattcttgacctctctgccagaatgataggctcttctggaagcttctcaaatgatccggacttgcatgcaggaaatctccctggggcaggtgaagggagcgggcagggcatttgcagaatcggggccaggtagcatgtcatgacgaagaatatccttgcatgtgtttttctgaaactaaacgctctattcctctctgccgttgtggtttctagacttggtcaccgggtggaataatctcaaggatcaaatcctactccttcccaaagcctggccacaaaaaggtgctaaagcgtcccgtgcttgctgtccctgactgagtggtaggatagaccctcctgcagcccgtgcttggctggctatcctgtacccaatgcggctttgcctctgtgcctcccgcctgcccagctccgagcatacccgctgagcctcgcagccccatgctttgtctccttacctctctttacaccctgcctcctgtgctcctactgagccttgcagtccctgcacagtgcacacatgccctccctgcctgtggcttctccgtcaccgccgctgcgcagcctgtccacgttgccttgccctttacaacacgtacctccagtcacttcagtgagccccacctgctggctctcattccagagagtctttgcacgctcaactcaccttcagtgtccagagtcacaaggggcagcatcagggcttctgccacatagagttcttcccagtggaggcaaccaaggtccccaggggagctctaccccctgagacagcaggttgatttctgcattttgttacatggctgaattttgagggacagtaaaaaaaggccttcatgggaagatggcccagaggccaaaggcagttgtcaccaagcctgacagcctgagtgtgatttcctgcaactcacacagggtggaaggggaaagccagaactgactcctgcgagttgcctctgatccccatgtatgggccttgactcctacacagatttattttcagggtttaggaatcaaactcaagcgcttcaccactgagctgtgcccaagctcctggtttctgtttgtttatttgtttgtttggttggttagtctgtgagacgggattttactctgtagccaaggttgtctttgaacttaactccacctcccaagctccagacttataagaagtcctaccctgacctttgtgttgacttgtttatagtgaattacatacacaagcatgcacacacagacacacacacagacacacacacacacacacacacacactcacacgcacgcatgcacccccatatgtgtatatgtatgtatatgcacagatatatgtgcatatatatacacatatgtaatgtgtattatatacatctgtgtatataatatgtataggttgttctatcatatttatttttatcttctttaggtaaagattaactttattaatagttgtttcaattttatatcaatgttttttccaagcgtgtgggcatatgattaagccagtgtacacagagttgtatattaaggtatttattagcaacagacagcataaatgcccacgagttctactcagcaactatttgctctgttggccacttcctagagggtcctaaccctgatggccagagcacagcggagaaaggagcatgatgcttgaacaggaaggcagccatgttgtgctaagctcagtcagtgaggagaatgttagaggatagtctgcggctgcctggacctttctcagagcccgacacacccccatgtgattggggtagctcatggccagcaagcccagtgagagccaggcaacacggtacctcacaggctaagggacttaaacgtgcctgatgaaggaagctcttcagaggtgtccactcaggccagcagccactcacagactctgtaatcctgaatgtgacaccacacttaacaagcctcacagacactgcaagccttgtgtctccccctcctcaaccgactcttcaagagcttctgatgacaccctgtcattccacttgccgtagcccaaggcttgttgctaactcacagcccccagctctgcacagtcctggcaaggagtgctttcatcccagcatctcaagtttatcttttgggttcccccggagacatatcaaccagagatgctgtatgtacatgagcacacatacacatgtatgacacactcatatatacactcatacatggaaatatctgtgcccgtgtgtacatagtcgtataccatatttgaaatgcatatgccctgaatatgcaccatatacacacatatgcatctgcatagtatgtgtatttgtgtatgcatctattgctgcttacacatggcaaatggattgcctgcggatagctacacaaagatgtatttcaaggacttacagagttaaacagaccagttaagtgattgcaatgtccatgggagagattgtcaagcagaggggatccagagccaggtggaacctcagtggtgttgctaaagaaagctgctgcatggtaggggtcagcttcccttccccgcccccttttccctttccttagaaagtctaaacttacatctaagaatgctcacctgagtcaggcccatgtgagatcatcctcatgatggaagtcacctactaaggactgtaagcccatcagtgagccccttctcagcagcaggactgcctcaggctgggtcttctgcgtgactcagtactgaccactcaggagagccagttgtcatagcgaaagccaacgctgcagctggaagagatagcgcagtaggcaaagtgctcgtcacccaagcacgagcccctcagttcagatgcccagcacccaagtaagaagccaggcacagtggcacacggtgccatcacagtgctgaggagctgaggcaggagggcccctcagccagccagtctcgtcaaagaggcaagctccaggttcagtgagagaccttgcctcaaacaataaggtggtgaaggcattgaaaaagatatcggatgtcagcctctggcccccgaatgtccacataagcaatcgcacgtacatgcacatacatgtgcaggcacatagaaatccacctacgccatgtgcacatttttagagaagccgacaccaacaaagcccagtcaacaagcacttgaaataactctagtgtctagagagttaatgaaaactgtgctttgatcttaggattatcaatttaaaatgaaaccagggcggggacttagcttagtgacagagtatttgtctaacaaccatgaggctctagatttggtccttagcaccaggaggagaaaaatacttggaaagtcaaatacagatttttgaaataatgtatttctttttatcttatgtgcattggtgttttgcatgcatgtgtgcctgtatgagggtatccgatcttggagttacagacagttgtaagctgctatgtggtgagatggctcaacagttaagagccccgattgctcttccagaggtcctgagttcaattcccagcaaccacatggtggctcacagccatctgtaatgggatctgatgccttcttctggtgtgtctgaagagagaatgacagtgtaaataaataaattaacttttttaaaaaaataaaaagaggaggaagagaaagaggaggaagaggccaggttttaggtctttgttgtgagatcaaagaataattatacagggcatgtgctcatctttaggtgaacctaaccgcatcccaccttctgacagagtctgcccacatcacactgcctgtgctccttctgagactggagactgtagccagctgattgcagccagtgtcctggagccctatggcttctggcctctggggagggttaccacccacactgccaccaccgttgcctagtttgaaaatactggcaggaagctgggagtgaaagtcaaggtccaggaagcaaaaggcaagattgtggaagcaggacacagggcagaggctacctgctccacaggacagagggtgtgctgcagagctctggtgatcacgggcctagagagagagacaggcaagtccctggtgcctactgaccagccattcagccagtggagaccccgtgtcaaacgctagggtggatagttcctgaaagttgacctctgtccttcacaggcacatgcacacacacaactgctcacacacacacgcacacacaatatcatgcacgcacgcacacaagcctgtctaatgcatccccacttttaacacactgtgacagagtagttcgaacttgaaaattatctacccaaggctggattcctggcgccatctaggggccactagaagttgtgcataagtggaaagggtaagggtgaagctgtcagcgcttcctttacagctctgttctcagtgcagaacagagatgccagggagggccagaccaccaagtacaaagtggagagatggataacgcatgctagcgctgtctaccagcaatgcttctcacgacagctcacatttccctcccttcatctttcaactgaagctttgcttccagagctttcagtggtgacagtggagctggtagtggaggggaggagggttgtatcttcatctgcaccacaaagcagccaatgactgctctggccctgcccattccttctgcaggacactcaagccaggtgccatgattgtcccagttccctaggctgccacctaggtgcaggaggcaggaggtggtgggtcctaagggtgaggcatccagatgagaagggttatgaatctcttgggtctcaggggctctgtctggatcttgaatgcttggactcatagggtgctttctgttgggcagcatggaaatgaagcactgagctacatccacttaaagaagaatcccagtttccaagggaggtgcctgttttgtccttttgtctgtcatcgagacataggggtagctcctgtctatctgggtgtgaactccttccaggagctgggatgctcaggggtccctccccccactgatccctacgtccttttgatatactgccattttttaaaactgatttcctaagaccctcagctctgctttaaaaatattccaagagattttgttaggaaattgtgagtgctggtttattataacaagtcttttgaagcccccttgctccggagataattccagagagactgcatgaagcccccagttgagacactgagcggcagagggtagacgctcttctatccacgggaaggattacgcctgtcctccctaccctggggtgtcctttaacttcatgatggtcagattgtcttggggatctcagacatttcttgtgtacagaggaaaaaaatcaaaagacttaacatggtagtcacgctaaccggaaaagacatctggagactgcagctggatgatggtagctattatcaagtataaactagggtagttcttcctaggcagggcttctaagcaacagccaactctgctgaagtgatgtgtaaatgtttaagagggtcgctcgcaagagattgcctatgcttagttcccttcctgagagcaaagactgaagagagaattcatctcaaaccatgtgagtttacattccacatctccatcttctgaaaggtctctctgttcaaccatccaccatctatccacccacgcatccttctgtccatctaccaactcactgattcaaccgtccatccatttacctatctatccactcagccatccatttatccatccatccacatatctgtccacatacccatacatccatctatggatctgtccgtacatacacacacccattcacccacctatgtgtccatcatccatcctttcacacgtctgtgttgtgtgtttctccttagcatccgttaccagcgtggcccagctactgagctttgatttaatgcctaagtctgcataacttctgctctgttgccatggttagttctatcacacagtccttcgggagtgttgagagaggccaggagaatatggatcctgtgacatctgagactggatgtcctttggctttgctgaaagaggtctttcccacaggtgctggcagactctaactcatggttaacaccacgaagccagcaagtcgtagtgaccgagtgtgacccagctgctaaacattgatgggtggggttgtcacgtcagtgaggcgggtgggatttttgatatgtgcttcaagatggtggctgtgtaatgttagctgaatgtctctgtttctctacacttcccctcaaatctggcattatctcactacttcatggcaatgtgtggatgctgataaggtaagtagatattcaagacaagacagaaatgggaggagagagccgtcagagctggacggcggtttgcctgtgagatgggtttaatagccaccactttgctttaatttgtgagtaaagatgggccagagaaaagtttttaaaaatgtatcaaatagaactataaggagattcaccccctctgcctacttcatgaaacaaattgatattgatggatcgaatgagaaatctccgtgtataagggccagtgtgccttagtgaacagccacaggaaaaccagaagagttctcttccttcaggaagacagagagactgtctctttgacagggcatgtgcccgatgacattatcatggtccttatcacgataatgaccgaagtgcatggggtgggggtgaggcaggatacagccttcctctctgagacttgcagctggttggcctgggctaccctgtggtagcaatgccttggtgtctcaatctgtatggaaggcaaaacaggtggacacggtttgactttttaaataacttctgcctgacgttagatgaaagcagaaatgaacccatggggagggagcctgcgaggtcctgctattttctgggaggtgtgaaaggaagttctcttgggatagtcagaacagatgctcttccctccnnnnnnnnnnnnnnnnnnnnccctccctccctccttaaggccacttcaggggtgggagctataagccatgagcctgtctagccttctcaggtccaaacagttgcctgaagaatgagatgagcctttctgacctcttcctaatcctctgcctcccctgcttatgttatctgtgaacacttggaaatggtggcatcggggcagaaaaataacatcttctcatctgtgtgcttcagcctgccccaccccaagggagccgtccagagagcactgtgtccttcaacccctatgagccaacgggagggccctggggcccagacagaggtgagagatgaaagatgcacttttactcaattaaacattcgagcagggtacacacaggcttgccagcatgtagaggcagcttacaaattcctggcaccattccaactttgccttacagtgatggtccacactaaacagtggtgatatccaccagccacaggtagaaaatatcacctatccataaaacaagcagtcctgtctagtgaaaatggtcttttataattaaaagaagcaagcaagcaaacaaacaaaaaccctgagttgttagcatcggcagcatcatgctgtgtgtctggcacattccggggaccctggttgccattcttggaagaaaatgttgccaaagcataactgtaacctctgggtggctttgacggtaggcacaactcacagattcttctagatttgttcagggagctgtgatgactgggaggccacaggggacacagtgcaggagggcgcaggagacttgttcccagaaatgggttttttcggtacctttcgtaggttcatgagtgtctgcatctgattttctactaacaagattggggtttgtttgttgctatagttcgcctccgaatagaggcttaaagcaacaagagtcagttatctctcatttcatttatgccttgtggctggaggtgtgactcatatagggtgcttgtctagcatgcacggagccccgggtttcatccccagacccgcagaagccatgcatcgtgttgtatacaccgtcggcatcattgctggctttgtgttgagttcacggcctgtctcacatgagcctcagagcagtagaactccttagcatcttagaaatgaagcatgttggctttttcaagccttgagaagcacacatatcatttctcttgagctctgttggttcagttatgaaaagccaacaaggactgtgtcgttggtgctacttctcaataggagactgtcacagctggcttaaagtctaaggaaggttttatctgccattagtactggtgtagaagaaccatcttgtctcttcccttgcttcgcttctccgctgcatgcaactgtcccttagacggaaggagtttagggcagggtggcaagggttgtaatgtcacaggagtccagactggagtcatctgttccctgactacgttgcaggccttcagagagaagccctgcccatggacacagaggtgtacgagagcccttatgctgaccctgaagagatccggcccaaagaggtctacctggacaggagcctgctgaccctggaggacaatgaactgggctccggtaacttcgggactgtgaaaaagggatactaccaaatgaaaaagtaagcaccgttgactcattgcactgctgtcatcttcagtgtgagagtgcattctgaaaacttctcagaacgtacctacactgctcaattaatcccagacattggcgtccaagtacgtgtgtttattgcacgcacacacatacacattgcagcgcttatgtggtcagaggactcatcaattggttttctcctcctcacacaggttctggggattaagctaatgtcatcaggtttggcaacaagtttttttttttttttttttgtttttttaccaactgagccatcttgtagtcttcatttctgactcatttagagtaaaagcatcctttgtgtatgctaactgtggtgacagtagtgacatgtttgtattagaatgtagtatagtatagaaaacagctaaatagaaataagcaaattcataagaaaataaaaatatattctatctccagaacacaaatatctgtgactaaccttggtgtaggcatttattggatctttatatgttttgtatgtaaatggtaagtgcttttggtactcttaatagtttgctggtaatgtgtgtatcgtgtagcattttccatgtctagaccttatatatgaactaatattgattttacacagagatgtgacaaccggcaacacaactgagttcacttgtgacctgtagcagtttatctagctatcctttaatacagaaatgtgtcacttaggaatgccagatctctgtctttctctctctctgtctttgactctgtctctgtctctctctctctgtatgcatacatgtggtgggtatgactatatatgttcagatatgttcacaagtatgtgtgggttgtgagtacacatttgtgcaggtacaaatgcccttagaagtaataataataaaataataataatagtaataatagtaataataataatagttcctcaggccccgtccaccttgctttttgaggcagggtctatcactggaatctggagcttaccaattaggctatggaaactggccagagaagcgcaggaattcacctgtctctgcctccccagtgctgcgattatagctgtgtaccacaaacatctttttatatgctggggtcttgggggtcgaagcccagtcctcatgatttcacggcgagccctttacagactgagctgcctccccagcccaatagtgatactttttaaaagaaaaccatgtctactcctgatccgttgggtgtttgtcctcaccttggtgcattaactaagaattgtagagtagtgttttagaactggcaggagtcttgtgcctggttacagagagatcccagcattcctttgggtgtggcttatgtctgtatgatgactgctgtctgacagactgaagacatgctattttgttccgataattctgcaagttctttagtcctgcatctatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgcttctctttctttcctgtgatgagttacagccatagatttcagaccttaaacatgtccctccatcttggggtaaactccctcacctttgttcattacatctccttccataagcaactgaatataacccatgagtatttctcctagaatttttcctatctgtgctcatgaagtgtcctaattactgttctattgctgtgatgagacaccgtgaccaaggtaacttataaaaggaagcaattaattgggggcttgtttagttttagagggtgagtctctgaacatcgtcacagcaggaagatatggcactggagcagtagctgagtgtatatcttatttgcaagttggaggcagagagcaagaaacctcaaagctcacccccagttacagatctcttccaacaaggacacacctgctaaacattctcaaaacagttctaccaaactaggggcccagccttcggatatatgagcctaccgaggtttttctcattaaaccaccacgtgaagttatcagtcaattgctttcttacaattctcataatggagtcttactctcttacctgtaaaagagctcagtgcttggaagaccaggagtttcatagtctcttcctgggccaccgtaaacagtcaggaattggaacaatagtagcctcttagaattagtgggatattatctttcccctctgcttttctagaagacgtggtattttcttttttaaatgtctagaggaatcaagaaaccttttctaacttcttaatttagatccctgcctcacaccacagatgtaatgatagacccaactatgaaagccaaaataggtggctagagatgacagaatggagcctcccatgttcccgggagggcccagagaggcttctagggtgatgataatatctaaatcctcctgtcaggccacaggctgtgttctagatcaccacactagctgtgtgtactttcctgtgtgtgtgtgtcccactaattctgttatttgacctagtgtatttgttaggtgtgtgtgtgtgtgtgtgtgtgtgtgtgtgtgtgtacgtacatgcatgtggtttggggatcaagctccagccaccaagcttggcagagagtatctttaccacctgagcccccacacggcccatttcctgaatagttctgttttgattcatcggtttgaaggttcaacaaaagaaacaacttctcatgcttgtggaaattttaccacaggtaatttttcaaagcatacctagttaatgtttgttctttcttttaagccacattttgctagaatactttcaagagttcagcatgatccatgtgatgtttttgtgagggaataaaaaaaaatccatattttcgaaacacattgaggcttgcttaaaagtaaccaagcccagtgggagagaagtgtttctttctctttaactctgagcttgaacagaatgtgtgcttctgattgggcatgttgtgtacacacctgtggccccccagagccccagaggtagagacagggggatcagaagtttaaggtcatctcctactatacagctagtttcaagccacagtggattatgtaagacccggactcaaagaaaaaaaaaaagcaaagcaatgtatttttattttttaaattctgggcccagaggctcatttgcaatatcataaagaaactttgtattcctttatgcatgtaggcagaacctagctgggaaaccacatgacactgcagcaggctgtatgtgtgtcacaacaggggaactttgttgaagctggttgaatatttcacaattcggggctttcctcagcctggaccattctccattgctgtccactacaccggggttcacaggcagtggggcatggttcctctgtctgtaaaagaacagctgtagaaagaatctcttgtgtactgtatggaatcattaccatcatacagagcaccaaccacaaaccagagaacaatccccgaagtccaatttggggaaccagtgactgggcacgcatgtgggggttactcacaggagctgcgtgtgccgctgagaagtctgggcctcagtgtggatggtggcctctacaggatgtagggtcccctagatgccccctctcgggctcctgttagctttcacagtcgtatgctctagcacctcccaagaccgtgcgtctatgttcagttaggacaggatctcacacagatgactgggaagcgccggggggagttccaggaatcagggtaacagtccagtgagcatctccaccccttccttatatggaggagcaccagcatttgaagctggtctttcttctctcttgcaaaaggcatagctgatcagatggaaagagcaggtgttatattcagaggacgttaaagatgatcttaaaccaacgatcctcctgtatccacctctggggctctggggctcacaggtgagcacccccatggccggtctgaagcacacgagttgttcaagctcagagttaaagggaaagaaacacttctctcccactgggctttgttacttttaagcaagcctcaacatgtttcgaaaatacagatctttttcaatttctcacaaaaatatcacatagatcgtgttgaactcttgaaagtattctaacaaactgtggtttaaatgaaagaataaacatcagctatgtgtgatttgaaaatttacacctgccgggcagttgtggcacacgcctttaatctcagcacttgggaggcagaggcaggcggatttctgagttggaagccagcctggtctgcagagtgagttccaggacagccagggctacacagagaaaccctgtctcgaaaaaacaaaaacaaacaaacaaacaaacaaacaaataaaccccaaaagaaagaaagaaagaaagaaagaaagaaagaaagaaagaaggaaaatttgcacctgtgataaaattttcacaagaaggagaaaaatggtactagctatttatcttgatgtgtgtgtgtgtgtgtgtgtgtgtgtgtgtgtgtgtgtgtgcaggtactcctgacacagcacatatatagaggccaagggacaacccttggatgtcacctcttacctttcaccttgtttcaaaccgcctctggggattcactgctggccccacgaatctccatagattctcccctagaagccctggggttgcagacatctgctatccaactttctgtgggttctggggatctgaactcttaacctcactcttgcatgcgctttttacactgggttatctccccagcccatggccgtttcttgtttgttttttttttttcgtttgtttgtttgtttgtttttgggttgctttgttttgtttttctgaatggctttaagagattctcattgggcagcgggtgtcagcaccattcccctccacccccctccccccaacacacacacaatgtgactacagagaagaggacctctaggcagtttggaaagtttctcacaagttacaatctgtgtcacagagttgtgaaaaccgtggctgtgaaaatcctgaagaacgaggccaacgacccggctttgaaggacgagctgctggcagaggcgaacgtcatgcagcagctggacaacccctacattgtgcgcatgatcggaatctgcgaggcggagtcctggatgctggtgatggagatggcggagctggggccgctcaacaagtacctgcagcagaacaggtgacctggggcatgcgagttgtgtgcggtgccaccccgcacatgccctgtcccccgagtttgggctgtgccggggccccgcccccacacacgccctgtcccccgagtttgggctgtgccgggcctgatttctaggggaagctctctctccctctcctctctgtgtctctgagtctctgtctctctgtctctcttcgtgtctctctctctctctctctctctctctctgtgtgtgtgtgtgtgtgtgtgtgtgtacatctttgagggtgtgcacctgtgtggatgtgtttatgtggaagccagaggtcaatattggagatcaccctctctcctctctcagtctccaacttaattttttttttttatttatgtgaatgttggtgtgagtgtgtgccacacaacgcagatacttatggaggctagaggagctggtcagatccctcggagctgggcttacagcacttgtgagcctcccaacataagtgctgggaaccaaactccggtcctctgcaagaacagtacgtgtagccaggcagtggtgacacaggcctttaatcctagcacttaggaggcagaggcaggtggatttctgagtttgaggccagcctggtctacaaagtgagttccaggacagccaggactacacagagaaaccctgtctcgaaaaaaaaccaaaaaggagaaaaaaaaaagaaagaaaaaagaagaaaagaaaagaaaaaagaacagaaggcgttcttaaccactgaactatctcgttagctctccgccttatttcatgagacaaggaactatctcattagctctccgccttatttcgtgagacaaggaactatcttgttagctctctgccttatttcgtgagacaaggtctctcactaacaccggagctcaccaattcagccaaacagagccccagggattacaggttctcactggcatacctggcttttatatgagcactgtgggtcccaactcaggcttcatccctataagtcaaacagtttaccaactaaggcaccttcctagccctgtccagtgataaaatcctcaatgtgtgtggacagggcattgcccaccagcaggcagaacattcttctttggtaaacacctggaacaaacatgttcctggggcaccatctgtgtctcgtctggccgacctcttgagtgcctgcatctgaagaggcagcagcagttcgttgattctggtccagacataggtgctctaatgctgcggtcaacatagagtaactccccgattcctctgagccggggttccttctgtacagcttttcgtcatcatttccaacatggatgtgtgagtttgagcatgtgcagcaggtggaggccaaaggtcaagccaaacccatgcccatcccttagaataccatctgcttcctctgagacagaggtccctcatgggccagagctcatcagtttagctagactttctgggcagggaacaccaagaatccacccgtttcacttacccggctttgggattacaagtgcaggccgcccgccatgtttggcttttatttcacgagggcgccaggcatcaaactcaagtcctcttgcttgcaggatgagcgctttcctaaaaagctttctccatagcgctatgaatttttgtccatctcaaagcatgcctgaaaatgaagcacactcatcatatagtgtgtgtatgtgtatatgtgtatgcacatgtgtgtatgtgtatatgtgtatgcacatgtacatgggtatgcatgcccatgcatacgtgcagaggccaggagaggccactgtgtgtgtccttctcaatcactctctgctttattccctcgaaacacagccaggtgtggtagcacagacccttaatctcaacaccaaagaggccgaggttggtggctctctgtgagtttgaggccagtctgatcgacacagtttattccaggctagttggggctacagagggagaccttgtcaaaaacaaacaaacaaacaaacaaaaaaggttctcccacaaacagaaagtcctgcctgtttggtttggcgtggtttgatttggtgtggttttggttattctgatagccagcaagcctccgcctcttcctgtccccatcccctcccagtgctgagattacagcacaggtgaccacactcaactttctcccatcacttctggggatcgaaacttaggtcctcaggttgtgcacgcagcaactgtcctcgccctgagtcatcttcccagcctgtcctgttgtcgacaaagaaggaacgagtggaccgacccttcttccatgtactcgggggacacggctgtgtgtttggaatggccgccgtccactcttggtaatgatgtcgtgtgattctaggcacattaaggataagaacatcatagagctggttcaccaggtttccatggggatgaagtatttggaagagagcaactttgtgcacagagatctggctgcgcggaacgtgcttctggtcacacagcactatgccaagatcagcgatttcggtctttccaaagccctgcgtgctgatgaaaactactacaaggtaggagcgctcggtgcaagctcacagaacagggagaggaaacagctctgtgcaggctcacggagcaggctgagagctcagtacaggctcacagagcagctgaggggacagcttccatgcatagttaaggttgcaggttataaagatatagaaagataaatgtgtgctctctgtattttactatggtagaaatctcactagtaaccttggagaaaagtattcttaagatcgattctgtccatcaagaaacacaaaccaaaaatactgtaatgtttctcaactggaatctttttcagactaggatcttatgttgagttttttggtggtggtggtggttttttttttttttttttttcgttttacatttacttatcttgctctgtgtatggagtcatgtgtgccgtagtgttctaatagagagcagaggacaacttacagaagttgattctctccatctaccatgcatatcggaggaatcgaactctgatcttcggattcggcagcaggcaccttacccattgagccatcttgctggcctctaaatgcttgcgtcaacttgctttgaaacatacaaatcaaacaaattgatttttcttttcttaggcagggtttcatggagcccaggttggcatctgtctcctgagtgctggggttataagtattcaccaccacgattgggttactcagtctacctaatactatgaccctttaacacagttcctcgtgttgtggtgacccccaacctaaaatctttcatcgctacttcataactgtaatttcgcgactgatatgcagggtgtctgatatgtgacccccaaaagggtcactacataggctgagaactactgggggctttatgcgtgttaaaggaaaccactgctaactgagccacttccttggccccaaaactggtggatccttgagagatttttccgagtccttttcactgaattgacactgtgactttcagcagaggctttttcctaccccactccttaaacccagctcctttgtgcatcggggtgtgcacacctgacttaacgcatcacagagtgtccactctgcttccaggcccagacccacgggaagtggcccgtgaagtggtacgcccccgaatgcatcaactactacaagttctccagtaagagtgacgtctggagcttcggagtcctgatgtgggaagcgttctcctatgggcagaagccctacagagtgagccatgcttagctgtgtgttttgtgtctcagcctcttggacttaagaaaccatccctcagtatggggttattgccacaagaacctgaacccctggaatctgaggacaccctggggtctcccatcaccttctaacagtgggcggctagtgcaacctaacttacgcttgtactcacttgagaatgacatgtgatactgagtgaatgcattctcactgtgctacacacatacgtgcaccaggcacaggccatccttcctgagagttaagtggaaatggtgatacggatggatgacatcaagtattttagttgtaagcgtgtgtgttctcatgtgtgtgcacacctgtgtatgtgcaaacacattgtgtgtgtgtgtgtgtgtgtgtgtgtgtgtgtgtgtgtgtgtagcccagagaccatcctcaggtgtcattcctcagggactctccactttgctttttgagacagtgttttcattagcctaagctcacccaataggccaggctggctagcctgtgagccccagggatctgcctgtctctctacccagcactgggcacacaaacattcaataccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatcatggtgtttcatggcaggcatactactatatgcattttgtaactgtggggatgtcataaagcatacgtaagcaaactagggcagctgcaaagtcgccagctgttacaatcttatgagactgtgatgtggattgggagaagtcacagaatcccagatgtcaactcaagcatctagaacactcttgccttccacaaactcagacatgtctgggagcatcactgcttccaagaatcctaacatcgaggctagatgctcctgctgaccacagacagctcagtaccagaagtctcccgatagtggtgcagagttgccacttgccacgttcaccactgctcagcccatagggtcggaagccccatccctattcttgggtacagtgtattttgccttcccctccatcccctgagcaggacagacaccgtgcacgtggtgagagcgtgaatccactgtgagccactgggcatgctctgccctacctatgggaaggatcccagccaccgtgataaagctgttcggtgctagtgaggcactcgatgttagaaagctgacattgaatgtagccatacattttttttgcaacgtatttttaataaaggttcaacctcccctctagcccgccactcagcagaggtagcagaagataaaagttattcggctatgggggaagtggacctgttcagcaatagttctttggggggcgagcttgatcctcttgggcagcagctcagccctgtagcaaacaccaaatgtgattcagcagctgcagaccagtccgctaggcaggcagacaccaggcatgaaccagcagctacagttaagtcttttcatcgcttgctttcatcgcttgcttgcctcagcatctaacctgtaggcgacagcacagacttgctgggcaaagacttaggatgcacagggttgggctctgaaccagaccacagccacagaaatctgtgagttctagcaagagcacaaaccaataccccctctccttgaaagtccagcttgaacgtgggtatggtatattacagctgtgtccatattctcctcttaagatttttagccaagggactaaggagatggctctgttggtaaagagttactgttgtgtaactctagggacctgacttcagtccctagtacccatataaaatacaccaggcctggtggcaagtgcttgtggtcccagcaccagcaaggaagatggagacaggaaaatctcagatgctttctggtcagccagccttgccaacttgacaagttctaggcaattgaaagaccctgtctccaaaaaaaaaaaaaaaaaaaaaaaccaaggtagatggtgtctgaggaaggacaccaaggttgtcctctggccttcagacacagaagatattctgtaccatagtgcaaaactcttctggctcacaaggacatggatccccaggatgctataaaatgcaggcttgagttctgtaagtttagagcaggaagagacatttctgaccatgctggaggcaggcgcagtgagcagcattcaccactgccaggaggcacggcgacttaatcatgtttccatgagcctatggataaacactaatacagctctctcttccttcttcagtgtggagaacaggccaggattcacagctgtggaactgaggcttcgcaattactactacgacgtggttaactaacagctccggcgcctgtccgtgcacaccacggattcccaagcgatcacaggaaattcattcagatgaactggctctcagagtttcatctccctctgcccggagtgagagctaagctaacataggactcaccctcacaacaggtctggtgcccagagacagacaagcagcaagaccttggggcctgtggagtcgtctctctggtctttgtttccatctgtgtggtcttcgctatcggtcacgtttgggagccatttccaaattctcttgacatcattccgttcctctgggtccaggatttcagtgtcccctgaagatcagaaaagaaaagtgctttgccactccagcaaaggacataaagagaaacctcgctggtgcagtcagcaagctggaaggtggttaaggacaatgacaagcctggacactggttttactctcagcgctgagacagagatactgtgtggatgacatgctgagatgtgctggcttggctgacacgcccctggagtccacctccctgcagtcgtgtgtgtttgctggaggaggtgtgaataacgttctgtgtggaggctgccgggggaggtgagctcccatgatcctctgcgactgagcagaagtgtgtcaggcaagggtcagactcccctctctgcagagggaatgcatccaggactccttgttgctgccactaaaaaattgccaaccagcaacttaagggaggaatggctcatttgagctcacagttggaggggataggccatcatggtggaaaagacaacaggcaggaaaggcttggtggcatgaaaaggaagctggaaggtcacatggcatccacattcaggaaacaaagaatgaacaggaagtggggccaggctataaggccctaaaggccacctccggtgacccagttccttcagatccatctatcaaagattccacaggcctctcagacactgaatgccaacagctggggaccaaatgttcaagcacacaaggtgcagtgccaggcaggggccttcctgaatgattacacagtgtggtatcctgacagagcgggtgagccatctcaggtctgtccccttatgagccccgtttaccatcccagattcccccttgggacccccctcatctggatcattcccctccccccaggccctatctccaaacacctaggtactaagtgaacctaggtactaagtcttcaacacatgaattctgaggggacacattcatactggagccgatggcagcctggtgaccaagaccatctcaggatgagtttctgaatggaatcttcattcgccataaaaccagagatgtgaccttccccacaaggaagccttgctaagtgcgacattgagctgaggacacacaagctgagaattccccctctgtcctcctagccttggctaactactgaccatacaccgaatgtcacccattcacggcacttttgctgaggacctaaaagctacaaaggctgcatagccttccatctaggtctagggacatgtacagatgggagcatctcaccttcacctctgagacactgggacattcacagccagggatggtacaggagtccctgctggtggtgggctcaatgaacagagacgatggtgaaatgggtgcctctctttagaccagtggttctcaaccttcctaatgctgagatctttcaatacaggtccttgcgttgtggcgactcccaaccatgaagttattttgttgctacattgtcactgtaattttgctactatgatgaatcgtagtgtagatatctgatatgcaggatatcggatatgtaaatatctggtatgcaggatatgtgaaatgagggcacatcccacaggttgggaaccactgcctttgatagggaggcactatgcttagagcatggttaggaagtatttagaagctattggtgtgtcttggaattgtgttagtaggtcaaccgtcctgtggagggaaggaagggggtggaggaaatccctgtatgttgaattcattgagcagacctgcagaacacagccttggtgaggaagtcccatgggtcagaccacctgtagatttagtcaggagaggaagggccactgtatagttatggagacaggactgtctgctctgagcaagaagttctctgctgagctcctagcctaccttcccttgtccccagggctatagaaaggccacctcgaagaccagggagcatgtgtgagaagtctgtggaggcctctgccttcttcctggcctctctagcagtgcctctccttcccagggatttgggactgaccgttatctggctatgactgagcagagtggagggatgggctttgccccccttcagaaagccgaaaccggttcccatgtgcagagtcacatgtggccatcgaccagggctctcatctggtgaaaactgtgtcttactgtcaagattaattctctcccctgggccactgaggagggcagatggcaagaggatcctccctagaggatttagactatgaatgcccactaaatttgcaaggtcagaaactagccaaggtccttctcaggcatctatccttaacttggtctctccacaagctgcctctgatgctccgagccccttctgcctggcagctgggctccctgtgtgcttttacctatgacccttggtcagcagagtacaaggagcacctaagctgcctcgccacctcccactgactgcaaacaccacatacctcatgcggaaccgaatgtctctccagtaaacaccccagccagccattcataaaaacctgtctctgtgtgcgctgggacatgtcctccctgtaccccgggcctgctttgtgtgccagacagtgactccacagggatgccaggtctgtgattgcattgctccttgcagagggaagccctcggttgtccttctctgggaatgctgccacccagagcagcacacagtgattccctgttatttcagaaattattttaaataaagatctactattagtcttgtgatgacctttacggatgcagacaggagatgatgggatatacacccttgactagagctggccagcatcttcgtaagtgcaacctgcttgtgaaatactgagccctcagtcataccactcgctacatttgggtgggaacgcagactccagagctcacctattctgccgcttcagaagcctgcaaggagagcccggtcctgtgaggggaaacaactgtgtctgagattcgtaggctgagaactgacagccgaactcaaacccagtagaaagtggtacaaggagaccccaaggtggccagagagggcggggtgagctttgccactgtcaatgaagacaacacgaaagcatcagagcagagaaggtgaggatgtaaaggtcccgagccctgggctcctctcattctatagggagttatgagcaggcacacatacatacactacatataattgcatgtgtgcatagacaagcatcttatgtatgtatacacaggaacacatacacatgcatgcacaaacgtgcattaaaaacatgcctgcaaatgcacactgcacacacagacatgaacctgtgtacacaaatccacaatcacatgtacatgttgacacatccccactcgcaatgccactttgcccacaggctaatctgatcttggaaatccctccatggagagtcccttcccaagtgactctaggctgtgtcaagttcatagtttaatctaagcatggtacagagagtgtatggtaaagagaacctgagtttagcccccagtgcctatgtagagaggcagtgcattggcacatgcccgcagcgccagctctggggagggagaagcagatcgctacagctcactggccatccagcctcacccagcacggttgtcacattccaggtcttatgatcctgtcttagaaaaataaaggagaaagcagctgaagagaacactcagtgtcaaccttctgcatgcacacatacaaacatgcacccctgaacacatgcacccctgaacacatgcatgcacacacatgcatacatacacatgcactggcacacatacaaacatgcacccctgaacacatgcacacatgaacacatgcatgcacacacatgcatgcacacacatgcatacatacacatgcactggcacacatacaaacatgtacccctgaacacatgcacacatgaacacatgcatgcacacacatgcatacatacacatgcattggcacacatacaaacatgtagccccgaacacatgcacacacacaaacatgcacacatacaaacatgcacacatgaacacatgcatgcacacatgtgcacacaaacatgcacatgtgaacacatgcacatgcatgcacacactcatgcacacacacacatacacatgagcacacacatgcacgcacgcatggcaaagaacgcaatgcctctgaacaacctcaatttaagagcattgcctgcacacgcatcaacacttgtctatccatacatgtggacttgtgtaagagccacagacttttaaagctggcaggctcccacactgtaccaattggtttcccggtgctgtgacaaatacctgagtaaagcaacttaaaaggaggaaaggcctgtcttggcagcagtctctgaggccttgttcctggagtgagggttcaagcccaggctcttgggcagcctaccaagccacatccagccaatgcaggatacagaggtgcaaagcagagactggaggtttagccaatgtaaccacatcagagatagggacaaagatggttgctgaccctcctaagcccatcttctggggtcctggcacgaagcttaggtttaaagagaggaccagcaacatgtccccatggaggcatgctcccatctggcaacacgtttcagctccagtctcccatgagcagcaccctgacacaacctctccccaggagaccagctcccctcctggctggcaccgggcttcagccttatccttctccaccagctccttggtttgcagctttgctgctctgatggtcaaagggagatgcgtggggctctcgctacagcaacgttattcctgccaggatggtaaagctgtgggtacctgacgctgctgatttgtgtctgtggtggcatagcttctcaccagaggagcacaccgtggaggaagctcctctcttactgtggtcaggaagcagagagagagggagagcggttcccaacatctacaacagcattcctgacgaacggcttccctttcacaaggccccagatctttgagtttattattttatttgtttgtgtgtatgtgcatgttcacacacatgtgcacccgcgcatgtgtgtgtgtgcttgtgtatgtgtgtgctatgtgtgcaagggttccttctgaggacagaagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1242 - DNA, 5350 bp, Mus musculus
ggcacgagggaggagaaggcggcggcggagaaacaggaggagggaggaggagagggggttggaggacgcggccacctgcccaggtaggagccactccgcctcgccgcaccctagcaaagggcctcggcacccccaggcgacagaccttggctaaactaggctggaccgcagttttgctccagtgactgcggctgagcgcggacccgccgggctccggcgcgggaccagaactcccgcctgcaaacgcgcgcgcccgggcgcggagtggggcccagccggagctccgcctctcggcagctggaggatcggagaaccgggagacttccacggtgcgcgcccccgaagcaaaacaacgtccccaagcatttgagatccgggactgtcgtcgtgcgcgcctgtgagttgctgcagagtcccagcgcctctgaaatgcggtacttctccatacacttcccagaactctgaaggggtgcagacatggcgggaagtgctgtggacagcgccaaccacctgacctacttttttggcaacatcacccgggaagaggctgaagactacctggtccagggaggcatgaccgatgggctctacctgctacgccagagccgcaattacctgggtggttttgctttgtcggtggctcacaacaggaaggcacaccactacaccatcgagagggaacttaatggcacctacgccatctccgggggcagggcccatgccagcccagcagacctctgccattaccactcccaggaacctgatggccttatctgcctccttaagaagcccttcaaccggcccccgggagtacagcccaagaccggaccctttgaggacctgaaggagaacctcatcagggaatatgtgaaacagacctggaaccttcagggccaggctctggagcaagccatcatcagccagaagccccagctggagaagctgatcgccaccacggcccatgagaagatgccctggttccatggcaacatctccagagatgaatcagagcagacggtcctcatagggtcaaagaccaatggaaaattcctgatcagggccagagacaacagcggctcctatgctctgtgcctgctgcacgaagggaaagtattgcactaccgcattgacagggacaagaccgggaagctctccattcctgaggggaagaagtttgacaccctctggcagctagtggaacattactcttacaagccagatgggctactaagagtcctcacggtaccatgccaaaagattggtgcacagatgggccacccaggaagcccaaatgcccatcccgtgacttggtcaccgggtggaataatctcaaggatcaaatcctactccttcccaaagcctggccacaaaaagcctgccccaccccaagggagccgtccagagagcactgtgtccttcaacccctatgagccaacgggagggccctggggagacagaggccttcagagagaagccctgcccatggacacagaggtgtacgagagcccttatgctgaccctgaagagatccggcccaaagaggtctacctggacaggagcctgctgaccctggaggacaatgaactgggctccggtaacttcgggactgtgaaaaagggatactaccaaatgaaaaaagttgtgaaaaccgtggctgtgaaaatcctgaagaacgaggccaacgacccggctttgaaggacgagctgctggcagaggcgaacgtcatgcagcagctggacaacccctacattgtgcgcatgatcggaatctgcgaggcggagtcctggatgctggtgatggagatggcggacgtggggccgctcaacaagtacctgcagcagaacaggcacattaaggataagaacatcatagagctggttcaccaggtttccatggggatgaagtatttggaagagagcaactttgtgcacagagatctggctgcgcggaacgtgcttctggtcacacagcactatgccaagatcagcgatttcggtctttccaaagccctgcgtgctgatgaaaactactacaaggcccagacccacgggaagtggcccgtgaagtggtacgcccccgaatgcatcaactactacaagttctccagtaagagtgacgtctggagcttcggagtcctgatgtgggaagcgttctcctatgggcagaagccctacagagggatgaaagggagcgaagtgaccgccatgctggagaaaggagagcggatggggtgccctgcaggatgcccgagagagatgtacgacctgatgaacctgtgctggacttacgatgtggagaacaggccaggattcacagctgtggaactgaggcttcgcaattactactacgacgtggttaactaacagctccggcgcctgtccgtgcacaccacggattcccaagcgatcacaggaaattcattcagatgaactggctctcagagtttcatctccctctgcccggagtgagagctaagctaacataggactcaccctcacaacaggtctggtgcccagagacagacaagcagcaagaccttggggcctgtggagtcgtctctctggtctttgtttccatctgtgtggtcttcgctatcggtcacgtttgggagccatttccaaattctcttgacatcattccgttcctctgggtccaggatttcagtgtcccctgaagatcagaaaagaaaagtgctttgccactccagaaagacataaagagaaacctcgctggtgcagtcagcaagctggaaggtggttaaggacaatgacaagcctggacactggttttactctcagcgctgagacagagatactgtgtggatgacatgctgagatgtgctggcttggctgacacgcccctggagtccacctccctgcagtcgtgtgtgtttgctggaggaggtgtgaataacgttctgtgtggaggctgccgggggaggtgagctcccatgatcctctgcgactgagcagaagtgtgtcaggcaagggtcagactcccctctctgcagagggaatgcatccaggactccttgttgctgccactaaaaaattgccaaccagcaacttaagggaggaatggctcatttgagctcacagttggaggggataggccatcatggtggaaaagacaacaggcaggaaaggcttggtggcatgaaaaggaagctggaaggtcacatggcatccacattcaggaaacaaagaatgaacaggaagtggggccaggctataaggccctaaaggccacctccggtgacccagttccttcagatccatctatcaaagattccacaggcctctcagacactgaatgccaacagctggggaccaaatgttcaagcacacaaggtgcagtgccaggcaggggccttcctgaatgattacacagtgtggtatcctgacagagcgggtgagccatctcaggtctgtccccttatgagccccgtttaccatcccagattcccccttgggacccccctcatctggatcattcccctccccccaggccctatctccaaacacctaggtactaagtgaacctaggtactaagtcttcaacacatgaattctgaggggacacattcatactggagccgatggcagcctggtgaccaagaccatctcaggatgagtttctgaatggaatcttcattcgccataaaaccagagatgtgaccttccccacaaggaagccttgctaagtgcgacattgagctgaggacacacaagctgagaattccccctctgtcctcctagccttggctaactactgaccatacaccgaatgtcacccattcacggcacttttgctgaggacctaaaagctacaaaggctgcatagccttccatctaggtctagggacatgtacagatgggagcatctcaccttcacctctgagacactgggacattcacagccagggatggtacaggagtccctgctggtggtgggctcaatgaacagagacgatggtgaaatgggtgcctctctttagaccagtggttctcaaccttcctaatgctgagatctttcaatacaggtccttgcgttgtggcgactcccaaccatgaagttattttgttgcagattgtcactgaattttgctactatgatgaatcgtagtgtagatatatgatatgcaggatatcggatatgtaaatatctggtatgcaggatatgtgaaatgagggcacatcccacaggttgggaaccactgcctttgatagggaggcactatgcttagagcatggttaggaagtatttagaagctattggtgtgtcttggaattgtgttagtaggtcaaccgtcctgtggagggaaggaagggggtggaggaaatccctgtatgttgaattcattgagcagacctgcagaacacagccttggtgaggaagtcccatgggtcagaccacctgtagatttagtcaggagaggaagggccactgtatagttatggagacaggactgtctgctctgagcaagaagttctctgctgagctcctagcctaccttcccttgtccccagggctatagaaaggccacctcgaagaccagggagcatgtgtgagaagtctgtggaggcctctgccttcttcctggcctctctagcagtgcctctccttcccagggatttgggactgaccgttatctggctatgactgagcagagtggagggatgggctttgccccttcagaaagccgaaaccggttcccatgtgcagagtcacatgtggccatcgaccagggctctcatctggtgaaaactgtgtcttactgtcaagattaattctctcccctgggccactgaggagggcacatggcaagaggatcctccctagaggatttagactatgaatgcccactaaatttgcaaggtcagaaactagccaaggtccttctcaggcatctatccttaacttggtctctccacaagctgcctctgatgctccgagccccttctgcctggcgactgggctccctgtgtgcttttacctatgacccttggtcagcagagtacaaggagcacctaagctgcctcgccacctcccactgactgcaaacaccacatacctcatgcggaaccgaatgtctctccagtaaacaccccagccagccattcataaaaacctgtctctgtgtgcgctgggacatgtcctccctgtaccccgggcctgctttgtgtgccagacagtgactccacagggatgccaggtctgtgattgcattgctccttgcagagggaagccctcggttgtccttctctgggaatgctgccacccagagcagcacacagtgattgccctgttatttcagaaattattttaaataaagatctacctcgtgcc

SEQ ID NO: 1243 - DNA, 1887 bp, Mus musculus
atggcgggaagtgctgtggacagcgccaaccacctgacctacttttttggcaacatcacccgggaagaggctgaagactacctggtccagggaggcatgaccgatgggctctacctgctacgccagagccgcaattacctgggtggttttgctttgtcggtggctcacaacaggaaggcacaccactacaccatcgagagggaacttaatggcacctacgccatctccgggggcagggcccatgccagcccagcagacctctgccattaccactcccaggaacctgatggccttatctgcctccttaagaagcccttcaaccggcccccgggagtacagcccaagaccggaccctttgaggacctgaaggagaacctcatcagggaatatgtgaaacagacctggaaccttcagggccaggctctggagcaagccatcatcagccagaagccccagctggagaagctgatcgccaccacggcccatgagaagatgccctggttccatggcaacatctccagagatgaatcagagcagacggtcctcatagggtcaaagaccaatggaaaattcctgatcagggccagagacaacagcggctcctatgctctgtgcctgctgcacgaagggaaagtattgcactaccgcattgacagggacaagaccgggaagctctccattcctgaggggaagaagtttgacaccctctggcagctagtggaacattactcttacaagccagatgggctactaagagtcctcacggtaccatgccaaaagattggtgcacagatgggccacccaggaagcccaaatgcccatcccgtgacttggtcaccgggtggaataatctcaaggatcaaatcctactccttcccaaagcctggccacaaaaagcctgccccaccccaagggagccgtccagagagcactgtgtccttcaacccctatgagccaacgggagggccctggggagacagaggccttcagagagaagccctgcccatggacacagaggtgtacgagagcccttatgctgaccctgaagagatccggcccaaagaggtctacctggacaggagcctgctgaccctggaggacaatgaactgggctccggtaacttcgggactgtgaaaaagggatactaccaaatgaaaaaagttgtgaaaaccgtggctgtgaaaatcctgaagaacgaggccaacgacccggctttgaaggacgagctgctggcagaggcgaacgtcatgcagcagctggacaacccctacattgtgcgcatgatcggaatctgcgaggcggagtcctggatgctggtgatggagatggcggacgtggggccgctcaacaagtacctgcagcagaacaggcacattaaggataagaacatcatagagctggttcaccaggtttccatggggatgaagtatttggaagagagcaactttgtgcacagagatctggctgcgcggaacgtgcttctggtcacacagcactatgccaagatcagcgatttcggtctttccaaagccctgcgtgctgatgaaaactactacaaggcccagacccacgggaagtggcccgtgaagtggtacgcccccgaatgcatcaactactacaagttctccagtaagagtgacgtctggagcttcggagtcctgatgtgggaagcgttctcctatgggcagaagccctacagagggatgaaagggagcgaagtgaccgccatgctggagaaaggagagcggatggggtgccctgcaggatgcccgagagagatgtacgacctgatgaacctgtgctggacttacgatgtggagaacaggccaggattcacagctgtggaactgaggcttcgcaattactactacgacgtggttaactaa

SEQ ID NO: 1244 - DNA, 96595 bp, Homo sapiens
  misc_feature (49183)..(49621): "n" at positons 49183 thru 49621 can be any base
ctctttagtacttgtaaatgcctgatgggttcttcctgcttactgcacaggcaaaaccaatttattgagaccacaccatcacaataaaagagtttaattgacacaaggccggccacaccacatgagagatgaagttactactcaaatcaatctcggaaaatttggaggctaggatttttcaaagatagtatggcaggctaaggagtctgtttctgggtgggagcacatgactggtccgtagggttggtggggtcagggaggtcagtggggtcagcagggccagcagggtcagcagggttggtggatccaggtgaagccattggttgtcagaaattcaaaaacctaaaaggtatctcaaaaagcgaatcttagtttctgcaatggtgatgttatctgcaggagtaattgggaaacttgcaaaacttgtgacctctaaataatagctggtaatcatttatgtctacaccttagcagaattcaggctcctcacaccctcctaacctggtggcctttcacaagctttacaaaggtggtttaatttggggaaaggactattgtcatttaaactataaactaaatgtctccccaggataacttagctcagacccaagaatggttaagggcagtttggaggctaatggcaagatgaaatttggttagatcagatactttccactgtcataattttcccactgttataatttttgaaaaggtggttttaagttagaatggcaatcattaaaaagtcaggaaacaacaggtgtggagaggatgtggagaaataggaacacttttacactgttggtggaactgtaaactagttcaaccattgtggaagtcagtgtggcgattcctcagggatctagaactagaaataccatttgacccagccatcccattactgggtatatacccaaaggactataaatcatgctgctataaagacacatgtacacgtatgtttattgcggcactattcacaatagcaaatacttggaaccaacccaaatgtccaacaatgatagactggattaagaaaatgtggcacatatacaccatggaatactatgcaaccataaaaaatgatgagttcatgtcctttgtagggacatggatgaaattggaaatcatcattctcagtaaactatcgcaagaacaaaaaaccaaacaccgcatattctcactcataggtgggaattgagcaatgagaacacatggacacaggaaggggaacatcacactctggggactgttgtggggtgcggggagcggggagggatagctttaggagatatacctaatgctaaatgacgagttaatgggtgcagcacaccagcatggcacatgtatacatatgtaactaacctgcacattgtgcacatgtaccctaaaacttaaagtataataaaataaaataaaataaaataaaataaaataaaataaaataaaataaaataaagaaaaggtagttttataaagataaatatacagatcaatgaaatagaattggaagtctggaaataaacctttacattgattttcaaaaagtgtgtcaactcaattaggacagaataattgttttaacaactactgttgaactggtacaactggaaatctgcatgcaaaaaaaatgaaattggatctttgcctcatattgtacatgaaaattaactcaaaatggatgttgggcataaatgtaagagttaaaactataaaattcctagaggaaatcataggagtaaatcttcatgaccttagatagtagtttcttagctacatcaccaaaagcataaacaacaaaagaaaaaagtcgataaattgaacttcatcaaaattaaaaacttttattctgcaaatgataccatcacaaaagtgaaaagacaactctcagaacaggagaaaatattgggaaattctatatctaataagagacttgtattcaaaatatgtaaagaactcttacaacttaatgatacaaagataagtgactcaattgaaaactgggcaaatgatctgaatagacacttctccaaaaatatgcaaatgacaaagaagcacatgaaaagattctcagcattgttagtcataaatgaaatgaaaatgaagtcatcagataccacttcacgcccactaggatggctataatcaaaacgacagacaataacaagagttgacaaagatgtggaaaaattggaaccctcctgttttgctggtggaaacctgaaaatggtgaagccacttttgaaaacagttatcagttcctcaaaatgacaaacatagatttactatatcactcagcaattccactcctagttatatattcaagaaaaaaggaaaatatacacccacacaaaaacttgtataggaatggttgatgcaaaattatttatagtagccaaagagcagaaaccgatgagtggataaataaaatgtggcctatccatacaatggaatattatttggtactaaaaatgtaaaacactgatgtatgctataacatgaatgaaaacattatgctaagtaaataagccagtcacaaagagcacatattacatcatgcaatttatatgaaatgtccagaataggcatgtctacagagacaaaaagtagatgggaggttttcctagggccttggatggggaggagggaaaggattgtgtgggatgggaagcatgagaagtgatatgggtatggggttttgttttgtggtttaaaaaagttcttccaggtgcagtggctcacatctgtaatcctagcacttaaggatgcagtggcaggagtatagtgtgagcccaggagtttgagacctgcctgggcaatataaagagaccccattcttcacaaaaaagaaaaaaagtgcttaaaaaagttctaatattgatagtgatgatggttgtacaactttgtgaatacacttaaaacaatttaattgtatactttcaacaagtaaactggatgttatgtgaattatatcttttgaaaacttaaaaatggaaccgcactttgaaaaatataaaaaagaaaaagaatgaaaagatcttggtatgagaaaaaccatctaattttcactacagtgaaaaataacagctgaactaccttctaattatataattatattttaaaagagtactctgttaagcaaatgattagctacccattgaaatagatgaaagggaggagttatttttgagcataagttttttccatccttttgaatctccagtggcttgggtcatgtctggcaagtaaaggaccctaattcaattattgaattgtttgctccctggaatttcacaaaaaaataaggaatcaggtacacagaggaaacttgacttgctcagagctgcacacctacaaaaagtagcagagctgagactactatggcccgtgcttcctgacccgtggccagtgcacctaccgctgggtttaaacacatgtgatcacacttcagacactatctttggtctttaagtaacttttctgttttgtttgttcaaaagattactaacaaaagaaaaatgaggaagtttaccatttgtaggtgaaaagtcacttttatatctggttgaattggttagggaataccagcagaaggaagttgttcctctggctacatcctgtgtcatttcagcaactggatgaatgtgatcagaaggtgaaaatcactgagagaagccactcacctccatcatgctggtctatcaaaattaacttcccttcataggacacaatagggttgttactttttttttaaaggtatacctacatatgaaaataattaattttatctaaatttaatgtaatatgcataaaaatacacctgatgctgtcctaactatgcaatattctcctttgtgtgtcaataaaagtgtattatttcaatacatggagttggttattattttacttgcaacctaaagcaccttaacagatatatcatgtgtaacttgtgtatttttttaatttagaagagacaaaaatgaggaccttacattctaaatattaaaatgtgcaatcacatgagtccaggagtttgagaccagcctggcaacgtagtaaaaccccatctctactaaaaatacaaaaagtcccagctactcaggaggctgaggtgggggaatcacttgagctggggaagccaaggctgcagtgagctgtgattgcgccactgcactccagtctgagtgacagagtaagaccctgtcacaaaaaaaaaaaagtacagcgtatattctatagtaaaaaacatgtgggccattacattctgaaagaacatagtgaaacatttacagaatatcaaggcctcaccatctagaagaaaagaatccttactttcctcatctttctacctcaagaaaaaagggaagcgggaagaaacaaaagtgctaaagttacaagtggtaaccaaacaagaaaaggagaaccgcttaacaaaatgcactttgaaaagcgctggctcatataaaaaccagaagtttgagagtatcacaatgaggccacactccaacctcccagaaaccatatattgtgcgtctacaaaatcctgaacaattctcactcagatcttgagagaagaaggggccattgtttatccttagtttttctcatttttgactgtggagtagtgaaaatggctgcagtggagattagtgcaaaaggaaatagcagcaatgtggcatgattttgtcagagtgtgaggactccaacgacccacattaattgggggaatgagctgaaactcacagatgcccccaacctcgctggacagagtaagctcagccttctccctccctcaatgaagtgcgaagcctgcatgttcctcacagtctcacattggaaggaggggcccagtttgtgcaacacaactccagctaagcccacccccaccattcccacgctcaaaggttatagaaaatcaagctcaaaaggaatattaagccgtcatatgtaatccagaaaaggggtaagaaaaggctctgacatgaggatttaggagctgccacacacaaaggggcagagcaaagtgaaagtctgaagaaagctgccaagtatggacaagatgaaatcaatgaactagcagctatgcaaaccttaaaagaaaataacatgcacaaattaaaaataaaatccagtctgaaagaatttttaagtgcacaggctacaaaatttgataagagcctgcattcaattttttaaaaaactcaagaaccgattgaataaccaagagaaaataactaaaaagagtgagatagagagaaccagagacaaagaaataatttgaggaccaataaacctacctacaggtaaattagaaataacaagaaataaagcagacccagctaaacatttagttcccgaaaaaaaagaaagggagagagagaaaatcactgtgaaccaggaagaaaaaacaaagtagattactacaatcagagaaaagataatagacttagatgataaaaagttaattaatatccttgaagaaaagcacttaacaaataaaaaggtatttaaaatcacacaagaaaaaattctttgaatgaagatctaaatctgcgcattacaatggtggatacacagcattatatatttgttaaacaccatacaatatacaacaccaagagggaacctcaatgcaaactttgggctttgggtgattatgatgtgcattaaagagtgcattgtgtttaagaaataaaagatggccgggtgtggtgactcctgccatcactttgggaggccaaggcaggatgatcacctgaggtcaggagttcgagaccagcctggccaacatggtgaaactctgtctctactaaaaatacaaaaaattagctgggcttggtggcgggcgcctgtaatcccagctgctcaggaggctgaggcaggagaattgcttgaacctgggaggcagaggttgcagtgagccaagatcacgccattgcacaccagcctgggcaacaagagtgaaactccatctcaaaaaaagaaaaagaaataaaagatgctggttgatctgtatcagtatatatccttgtcaagtttcttaatatctcagttaaagaaagtttcctccagcagcctggaaagaagagcaagtcacctaaaagaggacaaaggactggctgttctcacatttctccaaaacaacattcaatgccaaaggggcaagggaggaaaatcaaccgagtctaggccaaagggaagtaggatggagacacaatgtgcccaccttgatgtcactgcaatacaacagcaacagaataacatcctgaaagtggagagcattgatagatgcagtatgtgggatcacatcttcacagagtccatccagctcatcaacaaagaaagtaggaatgagatatggtggtagaaaggtctggaggtgcataaggtatccttttaaatggagaactaagaagagaccactgagggtttatggttacagaaatcaaaaattttaaacttaactatgtaaaactcatataactagggaaacgtgagaggtgagctgaagtgaagtggagtgagagaggtaattggttcatgtatcatagcagagttactgatactgtctgaaattaaagctcatggtttagaagaaatgacgaaaactgcttattattgtcacttttcttttcctttaatcaaagtggggtcatttcagaaatgatacatttgtggcaaagaatcatttctataaaatcagcaattctttagatcccatttcagaattttttattctgttaaatttaagtagaattaaatatcatatttaacatggataaaatgtataataaatgtattatatttaaaatgatgcccatttttatatctattgccatgtgtacatatagaaagagataattttgtaagggtcacctaacggtaatgatgattatgtctgaaatttgggatgtttctatttcctttgtgcttttattcttttaagggattgcctattaggaatacttgccactgttaccaaaaaaactatttttttaaattaaacactattttttagagcagttttaggttcacagtaaaaatgagaggcaggtaccgaggtttcccatatacccactgacctcacacatgcacagcctttcccattatcaacagccccatcagactggtacatttgttacaattgatgaacctactttgacacatcataatcacccaaagcctgaagtttacactgatgttccctcttggtgttgtatattgtatggtgtttaacaaatgtatagtgctgtgtatccaccattgtaatatcatacagcatactttcacagccctaaaaaatctctgttctccttctattcatcctgccctccccaccagcccatggcagccactgatctttttactatccagatagtttggctctttccagaatatcacctgttgaaattatacagtatgtagccttttcagagggcttctttcacttggtaatatgcatttagatttcatccatttcttttcataacttgctagtgcatttcattttagtgtggaacaatattccattacactgatgtacaagagtttatatatccattcacttactgaatgacatcttgtttgtgtccaagttttggcaataaacttagtaaataaagccagcgtaaacatttgtgtgcagatttttgtgtgaacataaggtttgaactcctttgggtaaataccaagaagcacaattactgggtactactttaggtaaataccaactactttgggtaaataccaagaaggacaatcctcttataattactcatgttgtaagaggatgtttagtttcataagaaactgccaaactgtcttccacagtggctgtaccatcttgcattcacaacagcaatgaatgagtatttctattgcttcacatcctcactagtgttcactgcggtcagtgttccgaatttgggccatactgatatcttactgtcttcatttgcatttccctgatgatacataatgtgaaccatcttttaggctaggcatggtggctcacgcctgtaatcccagcattttgggaggccaaggcaggcagatcacgaggtcaggagatcgagaccatcctggcgaacacggtgaaaccccgtctctactaaaaatacaaaaaattagccgggcatggtggcgggcgcctatagtcccagctactcgggaggctgaggcaggagaatggcgtgagcccaggaggcagagcttgcggtgagctgagatgatcgggccactgtactccagcctgggcaacagagtgaggctccgtctcaaaaaaaaaaaaaattactacatgatactaagtaatgcggaaggtgactcaaagggggaaaggaacacagcagtgtaaaggaaggaggttgtagatggatctagaatttccccctcatttccatcaggtgaaagcctgagaaaactgcaatctttgtgcaggctgggtttgctttgtacacactggtcccctagtgttcatctccaataatgctgacaactctgaaaaccatctgtagacattctgcaggctccatctcaggaacaatggctattttttcgggtagttgaagcaaaattaagtccaatgataagcaaatataaccattatcaaaatcttccatttatgtttgttaaagcaacctaagtatgatctgagaaggactctgtattctatatttgagtccttgtggatgaactgtaacctagcttaataggcagacaagattgaaaacctaatttaggagtatgtgcctttaacaatagctgagtcttggccaatcccagtggccatacttcaaccattcatacactgctgagtgttcaaactgtgttcaaagaaggcaaaagccaacctgtaaccaatccagttgtttctctgccttacctccaatttctgtatgtcacttccctttttttgtctataaatatgttctgaccatgaggcatccctggagtctctgaatccgctgtgattctggaagctgccccattcgcaaatcattcattactcaattaaactgctttaaatttaattctgctgaagttttcttttaacaggtttagaaaaaataatggcaaaaatgaatgaaaatccaataaccctggaagcagaaaaggctgggggctccaataagtgtaaatagtcccatccctatattttctccatggcaattacaatccagcacattatatatatatttttttgcttctcgcattttggcttagggtaaagctttttaaaacaggcactgccaaccagtgttatcaagaaggtctggatgccgttttgtgggaacattttaaagaggaatgtccaaaaggaaaagggggatgggttgggagaagggtatcaggcgggtatctcaaaaccattcttagggctataggtttaatttatttggttgtggacgtcagagccgtcatggtaagaaggaagcaaagccttttgtaataattaaagccttcagaagcagcgtgccccattgcccactagtgcgccgtgaagtctggtgttcacctacagggtccctctcagcactgcccaggcctcccgagtgctccagcacagtagcttggagcttgttggtttggtgaccaagatacactccagggaatatgccatgcagtggagtctcttccccggcactgcatagcaaaaggaaagggccgctgggtgtctgtgggtcctgggcagtcacagaagccaccgcgctggcggggaggagggggaccgatgcggtccatgtcccgggcagccccaccttctctgcctgcgaagggcccttgtccggcgggaggagagaggcgcgccccacccgggctcctctacacctgccgccgcctgggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtgggttccgccagcttcgctcctgaacctacccgcgctcgggatccagaagctgcgccgggagagaggggctcaggcctgggcggaggggacggaggtcagaccgtgcggaaagtgacccgggcaccccagggcgcccaggcccccagggagcgcggaaagtgcggtcgcggcccggccctcgggagacgcgggattgggatcaggcacagcgcgaggaagtcgatcttggagctagaacattttcctttggccatttacacgaatccactggaaaatgccgcagtgtttatcaaagttactcaaagtagaaatgtccagacgtcttatgagcttagacaaatcttttactacaaaaagaaacagcagttgcattcaaacaacaacccttctgaaccactactaaaatttagcataattactcttgtggatacattttcattgtcaagtaatttacttagccaatgaacttggagagcaagaaagttttatgtagtaaaatgtaaatttgagttaagagttaagggtgtttctttttgtctgtttgtctgtttttggcaatgtggctccaaaaccttaagcccacctaaaaactatataaatgcaatccattcttttgttggaatgttcaaggactagaaagacaattggagaagtgagagtttgaatctttttttacgttggaaacagtgttgcaaaatattttttgagttttgcctgacttagcaaagattcagtcgaactcaagtagagttcaaagcattgcagcgtgtagtaaaaaaaaaaaaaaaaaaaaaaaaaagagttgaagatgttgtgccatatctgattcttggtattaaaaataaaaaaaggaaccatttaatccctaagagttcctggaagaaatggaattgattctaccatctgacttctttgtcttagtagggacaaattcattgccttcacacaggcagcattttaattaaatgcaactaaatacattgatgtcctccttctccccagtgaaagtccgagcagtgcatagatagaattatattttctcaaaaaggcttaaatacatgtaaattattaagtgttttaagtgagaaatctttgtcagttgaaattattttatcaaatcatttttgttctgaacggcacttttgttttaacgtatttagaaaactcttgcattaaaacagaaattgatttgtattatcccctgtatttgaagtgcactttaaagtgtatttgaatgagagattataatcaaattacttgatttgtgtcttatcctcttactcttctaccttggatttgaaaaggttggatttgaacactaggaaaaaagagatttttctactgagggattgtgggaagatttttttttaagcctctgtatttgaagtgaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagacgtattttggaattcaagctttttcagaatttggaattaaaatttagaatctaaatttcagaactgagaaagacattgctcagaatttagaaaggtaaacatacatgttgaccctgctggttacatgccattccaatatagtctggagagaatcctgtaattccatgcattaatatttctgtacttttacatttaagaacatgaatattctcactaagtggaataaataaagactataaagagctgtgtgtctgtttagagcaggtgttatcactacgagagcttctctaagacttaccaaaaaaaaaaaaagtgttgtttttcagagctttttagagctgcagctgagggactgagtctgtattagactccactgaactacggtttgcttttaaaaggaaagtgcatttatgttgttcaatacttcacactttccagtaattagaagggcagttcctctctctttagggagtcttaaatagcaagattttactgaattttcaatcataccgatcaaaatagaggtacttcaagtaagagtggatgtctcatctttgtaatataatttcaaacagcatagtttctgacagtctaccattttagagaaacagagcagaagttacttacaggaggggttactgtcaccctttacagctgcagtctgtccatggaagaaatattatttcctgttaactttgcaaccagctgggtttgtgtcagttatctaagcctaagtgatggctaatttttactttctcaactttccctgtatagatttttttccagctaccccctgacttttctactcttgctttgctggttttaacattttccactacttctggattggtttagctataactgggtggagaaaacaacaacaacaacaggaatttaggcctttggggaagaatttgttttgttttagaagtctacacattgagcattactttttcttctaaagcaactaaaatcagaaggcagagtcctaatgagagattatgatcaaattgcctcatttgtgtcttatcaccttcctcttctacttagatttgaacaggttggatttgaatactaggaaaaaagggttttctactgagggattgtgggaagatgttttaagaactagtctgattggattttaggaaagttcattcattttgatatgatgttatcagggacattttctatttgcttataattttatctgaccaatattagcttgtatcaatttgaggtttttttttcctttatgaatcaattgtgcaaggtttgccctacatctcttaaaaggtggttaaactggaatcttaaagacagttgaatttagccaagaccaaagatatgcaaagaaagaatattttgtttatgttacagtacatttaataaatccaaatggctcccttgattcttttctttctgggacaccacgtattgatttctggcagctggccaaaggcagatggtggtggagcaagcgaggacagttaagaatgttgatgattactggattactgaggagtactgtgagctttctggtcctctgctcagaggtgtctagctctgaaactgggatcctggctctgagctggagaggcgcttccagttactgctgtcctggagcgctggaagggagcataagtgtgaggagacagtgggcttttagcctgggatgcagatgagagatgtcttgacctgagtgaaaaccttgcaggcaagctgcaggtctaccgagcagggtgagggaggctctcgacctggatactgtgaactagggagagaaagtaaattcaacagaaggagggcccagggcagagatttaggaatatccacagtttaaatattgctttacttaagtatactctgcctgactataagtagcatttgaatgttcaacatatgacctttcatttctcccctccattggtttgtcttaactgataaatctttattttcccatggtcaacctggtagtttattaatattacatctatcagttcctgttgagttgacatgaaaatgttttggtgtgacctaagttaatttctctttttgtttaattttaatttgtaatgagttcctcttttcattctgcccatcctttggtactgctttgagttatgtcctctagaattctcactatttccttatgattggcatattttcaaagttttttggtgtactaattttaaacagtgtttgttgacactgagaattcaggactttggagttttagaccaccatcaccttctactccttctcacaccatcccaggataattattctctcatttgagattaagaagttatttggtttattttattatggttatataaatatagtttactgctaaagcaaggtatatcattccattttctatctcgtacccctttttgctcttcctggggtaaacccttgctttgtttttgtgttttcttagtttgcactgtgcctattatcatttccttcccaactttctgacataaagatgaaagccctattgacacaattttctacagtgtcagatataccaagtaatctcacggttccatttttctttctttttttctagaaccctccatcttcttcttgtctaacagttgctcttcagtcttgctatacatacagtaatacctgaagaatgtttggaggatatttggtgtgggatttttcttttttttttttctttttcttttttgtagagatgggctctcgctatattgcccaggctagtctcaaactcctgggcccaagcaatcctcttgcctcagcctcccaaagtgctgggattataggcatgatccactgtgcccagccctatggggaatatttgttgactaaatatgttttatgtaaattgcttatcatactctttgttgtaacatctgtggcattaatatgcctcttgttaacactcacctacattttacctgttgtaaatccactgtcataattattgaaaatatttctccagagctttttaattctatggttatttatttattgtagtatagaacttttatgatttcttccatcagggtgcattctgaatcatgcttagtgagagatggtttttaactccactttaacagttagcatctatgttttacatcagtgtcaatgtcacttttgtattatatacgacaccaacattttattatctgagtgatgagaatgtttatttttgtggaaatggagatctcatgagactttaagcagattgctggccttctcctcgatttccttgattgattcctgaagtggaactgcagtgctaagtggaattccctgggaagcttgctcaagtaagtaagcatgagaaatgctgaatgaaataaagtgcagcaagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccacagcctctttgggaaaccatgcatgacctcttgctgctccttaccaagctccttaggctttgcttggtagaggcagaatgttgtggttgttttcatcttaaatgctaacaatatatgaattatgtggtggatacactgcctcaaagtgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgcccccagtcccactgttggggagcagttggagctctaacctctcttctttcgtcctgtgcattcatgtgtgcatgtgtgcacgtcttcagaagatataatggtgggctgtgtatgtcttcttaatacctttatcactctggaactttctttttattaatatgttggggtgcggggaggtctccatattcagtgattattgtaatttttatgacagtccagaataggcatgtcgattttttttaatttttgatattataaacagtgctgcaatgaatgcactttttcttttcattctttccctctcctttgccatttgcactgtgttttcatgaaaccatcaggttaatctttatctcaaggaagcccttcatccctgtccatcctgttcttcagtccatccacttagttttcctatgattattttagcaagcaggtggttaatttccaaggaatgtagttacttctttgggatttttttaagtgatgtattagttttctgtgtattttattacttgtttgagtgcaccattacccccgtctcccggggtatcagttcatctgcttgcatgcttggtgcctctctctcctgctgtcagctttcctgatgtgctgggtatttccacgtgtgtgttggtttttttttttttttaggtaccctaggcattagtcttttaaggctgcattcttgcagcctgtcccacatgagataggaggagggcaagacctggatgtgcacagggcaggatgggcccataactggtctgtgtggtgtgtgggtggcaggaactccctgttctttgtgggtatggccatgccttccctattcaaacgaagccacacacctgtcttttcctgcgaggcgtcttctgctgctttcttggagctggggagcatctactcttcccttgtcctcccgctcctccctgttcctccctcaggtctctgtcgcttctaaggcactccacccttggtcttctcccaccttgcaccccccacactgctgcctgcctgcacagggggactgtgattgcccccttcagtgtgagcctgacctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttggttaacaacaccaatcagctgatggtcatggctacgtgaaggaactcacagtgagggctcaggaagagcctggctagagcaggctgcatcgcaggccttggcgttaggttccccaaatcactgctggtgatcttgtagctctgtcatgaagtctgtcctgcttattaggataccgagggtccaaattcatagattcttagaagcctgtttaaatatgcagagtatctaattcaacccgattagaaacgggctcagaaaggtgaagggatttgtccaaccactgagtgatgctgctgggattagaactctcaaaactaggtgtttctaatccagaaccagaatccctatccactactctaataaggcgtaaaagaggatctgctgtcctgcctaattggtgggcaggtttggagtcctgtcagcagctcaggaaagcctggagaggcagagggaggacacaggctcagtgtcagacatgccaattttactcatcaccaatggttacacaaaacttgttttgatctttgtggcttttgcattgagaagttaagcatatacaataggaattagacacaatcccaaaccaatgagagactcaagtgagaagagctgaagcttttatgcatgccttccttccatagagataaatttactatccagagtgaactagagcctcgtggaaagtgagtgccgagcccctagctgtgagtgtctctgtccttcccacatcagacctccatgtctgtggctgtccccctacggggcagaactgctgctctctgcttgtgttgctgtcgtgagggttgggagtggacaggtgtggacagatctcagacccgtttccctcctgttatggaaatgtttgtgaggcaggtgggacttcaatgatttggtcaaggaaaggcagcttggcagctggggagaagggctcaggctagaaaggcaagcgtttgtgagggatgatttccccaaagaagccagcagtgtgtaaggtattccccggagcttgtttcttctcagaagactctggaagctgtgtcagtgtctgttatggaggaatggagtatcagtccgatcaggctttcataacaaagcaccacatactgaacggcttgaacagcccaatgtgtcgcctcccaactctgagccaaagagactgaggtcaggatgtcccagggtggctccttccaagggttgggtgggacaatgtgcccccagcatctccttggcttgtgggtgaccatctccagctccacatggcatgctccctgtgtgcctgtctctgggtccagatctccttttcatgtaaggacaccagtcatgttggagtagggctcaccctaaggacttcaatggggcgtaatcactgctgtaaagaccctgtctttaaataaggtcacactcagaggggttagggagttaggacatcaacatttgaacttgggggacacaattcaacctgtaacaaatgtgtgagtgaagactggcacctccccacgatggcctttctgtgatgccatcaagagcaccagggagctctccagatatggagatggacagatgtctaaggcccctgaaatgagcctgctgtacagatgattccagaactctgtcagtgtgaagaccaaacacaattaagcacattaaaatacttacggtaaagtgtttctttcactttagatgtgcaaaaacttaaagagagagagacttatgagaagactcagggaagaaatgtaagataaaggtgttaagggagacaaactccacaaaattgtaaagtgaagctgctgtggggagtagagcccagacccagataatatgcaggcatgggtccaagggaggctttgcacaccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaaacatcaatagctttaatatgcagcgagttttttcaaatcaataagaaaaaagacacagatgggtgctgacagggccgtttggtaatatcttttaaaatttaaaacacaagtgctttcactcaacaacttcacttttaggaacctatcacacatataaattgacaaaagtggagaaatattcattgcaacattttattttataatagcaaaaaaaaatcactaagggaagtacagttgattcatatgttggaatcctatgcagtcttctaaaaaatgtggaatttatttcatacaccaaatataacaatgtccaagttctactagtgaaaaagcaagatgtaacatatcattgtatttgtttaaaaaactcatgctgggttgggtgcaatgactcatgcctgtaattccagcactttgggaagccaaggtgggtggattgcttgagctcaggagtttgaagccagcctgggcaatatggcaaaaccccacctctatgacaaataccaaaaaaaaaaaaaactagcctggactggtggtgtgcacctgtagtcccagctacatgggggcgctgaggtggggggatcacttgagtccaagaggtcaaggctgcagtgagctgagatcatgccactgcacaccagcctgggtgacagagcaagaccctgtctcaaaaataagtgaaaaaaaaaaaaaagcctaaaaatctcccacatgcacataataatttaagtgatattggattgtcgtttactacttatatgtgcatttctgcctatacatattctatccagtgtgtacacatgtgtatgtaaatatgtagcatgatctggaagtgtaagcaccaaattaagaacagcagtttttagggggaggggaatagaattggtttagagaaaaaggtgaaattaacatttttattctgcctacttcagtgtgcctgcagtatttacaatgatcaggagtgtgtacttttttcaatttagaaaaatgataataataaggtttgcttggggggaaagggtaagtaggatgagaccaggaagagaagtaacttagaaacacatcatgcatcatgactgctggcaccattctgtcctccaatgaagagcgaggctttgagaggttcagcagctcacccaaaggtgtacagccatggtctcaaacatgcttgcaccctgctgtcactcaggtcctgaagcccaggccacctccaaggacactggggtgctctggggtgcagcctgccttcagatgtttcttaaagccactcctactccaccccacccagtgcaggagccaagattgaggaccaccatttgacagctagttcataggatttcatagcacacaaacacatctttaaaggctgatgaggtttccaccaaattgggatttattggtatgctgggtataatggcagctgtgtgtgcctttgactgcaaagacactgggcaggccagagtggctcctccccatttgatatgtgtgtgtgtgtgtgtgtgtgtgtgtgtgtgtgtgtgtgagattgagagagagagggctcgtgtttttctgttgcgaacagtcctttccacgggaacttatattctcctaaggtttgccactctgcagaacttttggaggaaggctttagagtgagaatgtcagtgcattctcagcgtgcaactgtaagacttgcaggaggtgaatgcacatgaaataattctcagaggaagaatatgtgcactggtcagataggaaaactgacctgtaacattttctacacaagaggatttgaatggttttcgtctttaagatttttttttaacattatgcttagtccaccatgctttattctgtcagaccatttgtcatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgctacctccccaccccagccacctccatcagcactgtgccatactcgcccagaagagcccctggactcatcgcctgcccccatgtttacacttgttaataaaatctctagaattgtggcttagacctgtaaacatccagttccaagaagtggctctaaagccctctctgggggcagagtggttgtcagaagcagaccaggcctcggggtctagattccatccttcactggaactgctgggggctggtagtaccccatctgcaaaatgaggttaaaaatacctaacccttgggttgctatcaagctcagagatgctgtatgcaaagcaccaatcagactggctcacaaagaataggccctctgtcaaatgttcatggttgagtgcgggatgtcaaggataaatagctactggttaccagggaattgaagacagggttcttttacaagcaaaaagattttataagagggtcacagaaacagagtgactcttgcccaacagtatcataagcaaataagctgtgtctagatcctaatcatgtgtttagggctctgctgggtttaataagcaacacatagggggtgcgttgtcctccactctcacatccccagtcactagacaaggtcactcccccggggggcatcttactcagaagctctaaaagactttgttgcatgactttggcccttgctcttttaaaatgtccagttagagaccatggcatggagagttttgtatactctgctcccagcatggcaccctctttgcatattgtgggcactcttaaagttatttctcatattgtaatatatcagatatgacttggatatagtcaactagatatttagtgaaaaatgtatcacccccattatcaaaagaaaacccaaagccttcaagtttggcccaactagaaggaatttctggaagggggaagtaccaggaccacacagactctggtcctggcggtgtgtttataagatgcagctcatcatgttggtctctgtcatccctgctaaggctgttcattatggaaccactggccacatgtggccactgaccgctcaattacttaaaaccatttaaaataaatgttgaatttcatttaaaatttaaaattcagttctcagtcacacaggccaggtgtcagggaccagttgccacacgtgggtggaaggtgtgtgtcaggcagagtagaacaggtatttccattgctgtagcaaggtctgccagacaccaagctgctctcagcccatcccctgaggagcccagaagggatatgaacttccacccacctctcccctttcccagttctcagtgccactccttgcctaagtgcacggtaacactcgccactatttcatgtgttgatacctgcagctcccaattttcttaagaggatctgaccctgggaactgatgagggcaccaggagtgccctctcctttgacatgagaccttgagtcttgtccatggggccctggcctggcccttttcatccccaaggctgtaacattctcctgcacaacacaacacacgtgcacacacacacacacacacacacacacacaaaataatgttacttctcagtcacccgggaactgacatggttcccagttatttccttgcagcagccctccaagcggtaacacagccttggagaaagctactaagtcatgtatccttggggtaagcacacttggttcagaatagtttctgaaagaacaaaccaggtttttgctcaagagggttttgagggactggagaaaaccttagtgcttgttcctttctcttcggttaaaaaaaaaaaatccaacatagtttccttgaaacatttggaacctgaggttttgtccattttgaaaagaagatgtagagaggtaacgtgtttctcacgaaggcaaaacaaaaaaataagatgccaagcaagtggcccttgtaccttcaagaccaagaaataaggcgtttgtttctgggaatgccttccatttgctcattttgtaagtaatcaaggcaggctgagaggggagccttctgaggcaccccagtgagcagaggtggggtcctgccactggcccctcggctccaaccttgcctcactccaggcgctggggcagagatgtgtggttggcctgtctctggagttcctgtgctgcttaatttgagtagagataaaaggccacaagagaagtcgttttgaagggtttgtgaattataggacttcctttcatgattcagcctgactccaggaagtgcagtcacgtgctgccctcctaggggagcttcgccccaccaccagcactcaggctccacttactgcaaaaggcgcgatcaagattcttcttcctgaattattgtcttaacaaaattgatacgtctaaacattgagttaacactttcattcactaaaaatgttttcctgaatgatgcttttcatgtgacttctttatagtcccacgtgaaaaggggaatgtgctcggctctgtgcttgttcccctctgtttgggagcctgcgctgctgctcacttctgcagtcagctctgtttggatcagttttgaaccccagaaccttccacatagaggtgataattctagataattctagagcaactgcttctctatctggctgtatgctaagctctctagagagctttacaagggagagattctgagtgttagggctgggaaaagagcactctgtgtgatcctaacctgcagctgaaatgcagaaccactgttctcagctggagcttttcattgttttttgtttgtttgttttgttttgttttgttttgcttgtgaattgagcttactaatggaagcaggagcttgttctgtttagcgatcgtgagaaccacctaggcagcggagcctgcccttagaatctgcttcactgggctgtactgggctgggcattggcaattttaggacacatctagatgtgtcccaagcaatctgatattttgatgtttatcttacagagaagcatgtgtttagaaggcagatagctgtgcttctgttcttctgattttcgacagagacatcagaaccttccacagtcattttagtctaagtcctgaaatcgttcactgccagccctgagtctagctggactatatgcctctggttggacacgtctgccacctctgagaactgtgtggatgtaactcttctgtcttctggctcgttgtgtttccaaggagaagcttgaggcccagtaatacttaaaaattttttggacaaatttaatcttacataattatggggtacacagtgatattatatctgtacaaggtggaagggttgaatcaagccaattaacatacccatcatcataaatgcttatcattaatcctcctctctatctgcaactttgtagtctttgactgtcatctccttattccatcactccccagcccctggtaaccactattttgttctctgtttctatgagttcaatcattttagattccacatatgagtgagatcatgaggtatttgtttttctgtgcttgacttatttcactttacataactttctccagcttcttctatgttatcacaaacaataggatttccttctttttcatggctgaatagtattccattgtgtgtgtgccacattttccttagccgtttattccttggtggacttttaagttgattttgtatcttggctattgcgaatagtgctgcagtgaagcatgggagtacagatatcttttcaacataaatttgtaaactttcttaaaacattatgagttttttgttttgttttgttttgttttttgcaattttttgtttttggctcatcagctatcattagtgttagtatattttatgtgtggctcaagacaattcttcttcttccagtgtggcccaggaaagccaaaagattgcacatccctgctctagaggttcctggataagatgctcttttaacccctgtagacaagactttttttatttctggaaattttataactttaaacatgtgttttactcctttattttaattctctatttcagggacattaattttatatattttagatcacccctgtctttctcaatttttctgttgaattcctgaagtctttgttaattcctatttcatttttctcaagctccacagatcctgtcccccatgctgcctgcagtgttaatatccattcatttttccctgcttgatataatagccaacatttcttttctggccttttctcctgatctctgctggcttatcattgttttttgttttttgttttttggccccttcctcccttttgagctgttattttaaccaagtgattattctgttaagttctttgattccatatctgtgtgtgtggacatgccttcatctgccttttgggacatttttctcatgaaagtcctttgccatttgtttctcctgttgcttctcttctttaattatttcagcatcattgtacaaatccaaggtaggatcctcatctttgaaatagatcatggaagggccttggatgtgttccagtttaccagaatatttcctcccttctcaataatttgttgtgtgtgtgtgtgtgtgtgtggagagagagagagagagagagagagggtgaaagagagagaatgaattggtttaatacatatttctccccagtgaggctgccagccattcagtctcctctcttcaacactctaagaaatggttggctttccattgctgtgtatatccttccactctgcaggccttgtctgaagtctacagcagccagtccccactaagggtcttcatgatcccagggcaaacatagctgcattgggctccgcttgtggcatgttattgctcaggatcggggtgcccactggttccattttatttctttatctggttcttgttgcagggtcatttcagagaggagggggcagtatctctgccaacacccaagcaatctgatattttgatgtttatcttacagagtgacttagagtatgtggcattgaaaccaatggttaaaaatcaacaaataagcaggaaacaacttcagaatgaccaaaaaagttcctggggcactcttagcttccaccagcctctctgatggtcaaccaggccattttgttggctttgatccgttcagcacattgagttatggggcgcctcccacgtgtcaggagcagggtgaggtatgggggctgtcgcagcagctgagatgcttccctgcacttgacttgtttacggtcagatcgtaaggaagcatgggagcccagcatcaggctctgctcatgcataatctcatttattagtgacagcaaccatagggtttttctttgtgaaaaaaattataaaatacagaacagtgcagtaccacccaaattaataaatgttgttattttaccatttatgcctttatttttcctaaaagaacagtcccaataaagtggaagctataaccttttatggatgaggaagtggagagtaatctgctcaaggctggctagctggtgagcagcaggcctggctcaggcccctctggtgcccctgatttaggcttcatggccttctctaccctgcaggaattatgctggctcagctgtgcaggttggcgactgcaaatatcaacccctctaataggaaaccaggcagatttttctcatgctatcagctgatttttggtatatgtaaataaaacctatgtttttgagagtagcaggaaacattttgttagaaaaccaaatgaatacagggagatatggctatcaggagctgagactgatattataattttccaagtactagtatctgtgtattgatttttacagtaatttgtactttcccatccagcttgtttgtgaccactgaggcccttggtgaatatcttagaagtcactcaaaatggataaagaatgaatgtgagtcacccatagcagtcttatgtgagataatatatggttgatcctcagtattcatggcttctgaatttgtgaatttgcctactcacaatcacagtcatttatctgtaatccccaaatcaataaccatgatgctttcaagaccatttgaggtcatacacacagtgtattagttcattttcccactgctgataaagacatgcccaagactgggaagaaaaagaggtttaattggaattacagttccacatggctggggaggcctcagaatcatggcaggaggtgaaaggcacttcttacatggtggcagcaagagaaaatgaggaagaagcaaaagaggaaacccctgataaatccatgagatcttgtaagacttaatcactattacaagaatagcatggaaaagactggcccccatgattcaattaccccccttccttgggtccctcccataacatgtgggaattctgggaggtacaattcaagttgagatttgggtggggacacagccaaatcatatcacccacccctggccccttcaaatctcatgtcctcaaatttcaaaaccaatcatgccttcccaatagtcccccaaagtcttaactcatttcagcattaacccaaaagtccacagtccaagtttcatctgagacaaggcaagtcccttccatctctgagcctgtaaaatcaaaagcaagctagttacttcctagatacaatgggggtacaggtattgggtaaatacacccattccaactgggagaaattgtccaaaacaaagaggttacagggccaatgcaagctgaaatccagcagtgcagtcaatttttaagctccaagatgatctcctttgactccaggtcacacagccaggtcccattgatgcaagagatgggttcccatggtcttggacagcttcatccctgtggctttgcagtgtacagcctccctcatggctgctttcacaggttggcattgagtgtctgtggcttttccaggcacatggtgcaagctgtcagtggatctaccattctgaggtctgtaggatggtgaccctctactcacggctccactaggcagtgccccagtagggactctgtgtgggagctgtgaccccacatttcccttctgtgctgtcctagcagaggttatccatgagggccctgcccctgcagcgaacttttgcctggtcatccaggcattttcatacatcttctgaagtctaggcagaggttcccaaacctcaattcttgacttctgtgcactcgcaggctcaacaccacgtggaagctgccaaagcttggggctttcaccctctgaagccacagcctgagctctacggtggcccctttcagccacagctggagcagctgggacacagggcaccaagtccctaggctgcacactgcatgaggaccctgggcccaggccacgaaaccactttttcctcctgggcctccaggtctgtgataggagggactgctgtggaggtctctgacatggcctggagacatcttccccatggtcttggggattaacattaggctcattgctacttatgcaaatttctgcagctgagttgaatttctccccagaaaatggatatttcttttctattacatagtcaggctgcaaattttccaaacttttatgctctttttttttttttaataaaactgaatgactttaacagtccccaagtcacctcttgaatgctttgcctgcttagaaatttcttctgccagataccctaaatcatcgctctcaagttcaaagtttcacagatctctagggcaggggcaaaatgctaccaatctctttgctaaaacataacaagagtcacctttactccagttcctaacaagtttctcatctccatctgagactgcctcagcctggaccttattgttaatatcgttattagcatttttgtcaaaaccattcaacaagtctctaggaggttccaaactttcccacattttcctgtcttcttctgaaccctccaaactgttccagcctctgcctgttacccagttccaaagtcacttccacattttggagtatcttttcagcaacaccccactcttctggtaccaatttactgtatttgtttattttcacattgctgataaagacatatctaagactgggaagaaaaagagacagttccacatggctgggaggccccagaatcatggagggaggtgaaaggcacttcttatatggcagcagcaagagaaaatgaggaagaagcaaaagtggaaacccctgataaacccattagatctcatgagacttattcactaccatgagaatagcatgggaaagactggccccagtaattcaattacctccccgtgggtccctctcacaacatgtgggaattctgggagatacaattcaagttgagatttgggtgaggacacagccaaaccatatcacagagtggcacaaaattttagccacatgcatattccagacgctccaactcctcctttcacctcatattataagtaagtgtctttttccccagtctacttagtgccgtattttttgcatttttgttccttttttcaaattgtggtgactttgctgtttagagtacccccagctgaagtgctatctggtgtccctaggtgtaagaaggctgtgctgtgccttacagggaaaatatgtgggttagagaagcctctgtcaggcatgagtcatagttagtgctgtcggccgtgagtccaatggtagtgcatcaacaatagatatgaaataaggtgcctttacacagaaacacataaaacaagtgatgcattgatcagttgatgaaaatatggtgacggcaggctctcaggcacataacccctgagaagcgatgggctactacttgctaattcagttttgggggtgactttgtggaatgtataacctgaaataatgagaataaactatattctacttcttttacaaagcaaggaaataatttttaaaagcaagttaaattttactgtttttgtaagagatatgttttcgaaacagttgaactgttttataacacagagaaagtctctttgccttacattttatattagttaattaagtcagcagatttttcttgggctcctgtgatgtgactggcactgttttggtaccaaaagggcattgcaaaaaaagtccagaagtagacagatcacagccttcaggattaaaagcagtctcatcaatgtgatatttcgtttaaacttagtagcaagcccattgaattctcaaaatgagaatctgctaattatcacacacttttcttatgaaagaatgatttttcatagtcaatatttctaaaatataatgtctctttctcattagcagagaccgattgtatggcagatttacttgcacctgcggatgctggagataggtgatgatttagtatagtgcacatccaccaggcggtcctcctgggtcccaatatttaggcccacaggatgagtccaggtgatattgggcacaggctcactcagaggctatcagacagaaagctctgcctcactgcacagcagcttcaagcattgccttcagtgggagtcttacttgcagtccacacagctcaggtacaaggcccctgaggtccacacctggagctaatcatctctttgaataacactgtagacatagctaccagaaaataaaagaaatagaaaggcatgattaatacaagcctcactaggttcttattgtgaagatctgagaaagagctcctcatggccctggcatgggagggaagagtgataactgtaaaatacccctaggctttctccatgacaatggttactctccaagggaaaacactttgcaagagccttgtctcagctgggaattcccaagggaattcctcaagttccagcaccctcatcactttatcacttaaaggacaaaaaactcatagtcaacaggggtcagcgcttcaaggaaattgttacagaatggtaaaggggtcgaatatccaagaagacataacaatcctaaatgtgtatgtgcataacaacagagcatcaaaatatgcaagacaaacactggtaagactgaaaggagaagtagacaaatcctgtcttatagttagagattttaatctctttctcacaaaagttgatagaccaaatagataggataaaaatgacctaagcagtactgtcactcaacttgatctaattgacatttataaaatattccattcaacaacagaaaaatacacattcttctcaagctcacttggaatattcaccaagatagagcacattcttggaaaacatgttaacacatttgaaagactaaacgtcataccaattatgttctcagaacacagtataattaaactagatatcaacaacaaaaagatggaggttttgggaaatttcccaaatatctggaaatcaaacaacagacttctatataacctatgtttccaagaagaagtctccaaaatttaaaaaaatattttgaagtgcataaaaataaaaatataatttatcaaaaattttggaatgtagcaaaagcagtgcttatagagaaatttatagaactaagtgcacacattaggtaaaaaatatataaagaaaattacttgtgattctacttttaagaaactacagaaagaagagcaaattaggcctaaaccaagcaaaagaaaagaaataattaaaatgaaagcagaaatcattgaaattaaaaacaggaaaacagtagagaaaagtcaataaaaccaatgttggttctttgaaatcatcaaccaaattgataaacctttaaccaagaaaaaaaaaagaaaaaaatgtagaagatgcaatttaccaatatcagaaatgaaggaaaggtcataactgttgatctaatggatataaaaagatgataaaggaagatcatgaacaactctgtactcacaaatgtggtaacttaggtgaaataaactaatgcttgagtgacacaaactactaaaacttacagaagaaataggtagcctgaatagccctatatctttaaaatttaaattaatataacctttaaaacagaaatcatcaggcccagatgggtccactagtgaattctgtcaaacacttaagaaagaaagaataccagttttccataatctcttccagaaaatagaaatggaggaaacagtttctaattcattttatgagttcagatttcacgtaataccaaaaccagttaaggcattacaagaaaacaaagcaatattacttatatatacaaaaaccctcaacaaaatgttagaaaatcaaacccaacaacgtatgaaaagagctatgtaccacagccaagtggaatttattccaggtatgcaaaacaggttcaacatttgaaaataaattaatgtgatacatcacatcaatgggctagagaagaaaaatcatatgaccatgttaatggaggcagaaagggcatttgacaaactcaaaacactctttcatgtcaaaaaaaaaatcttaaactaggaatagaggaaaacttttgtaacttgataaagagcattaaaaaaaaaaacctacaggtaacatcatacttaatggtgagagactgaacactgtccctctgatattgaaaacaaggtaagactgtcctctcttaccactctgttcaacatcctactgggagccctagctagtgcaagaaaacaaaacaaaacttatacagatcagaaaagaagaaataagacatcttttttcacagataatatgcatgtccatatggagaacttcaaagaatccataaaacaactctaataaccaataagtgagtctacaggatgctagatcaatatacaaaagtcggttgctttcctatataccagtagtaaactattgaaatttgaaataagaataattaccatgtataatagcaccaaaaagacaaaaaaaaaaaaacacaagaaaatacttaggtataaatctaacaaaatatgtacaggatctgtatgcagaaaactacaaaataatgatggaagaatcaaagaagatgtaagtaaatggaaaagtagtccatgttcgtacattggaagactcaatgttgttaaaatgttcattctgccaagcttgatctgtagattcaacccaatcccaatcaaaatcccagcaagctgttttgtagctaatgatgaaatgattctgaactttacttgggaaggtaaaagatctagaatacccaacacaatacccactaaaaaggacaaagttggaggactcacactactcaatttcaagtcttactagaaacagatacaatttctgcccttatgggacaaacagacattcatcaaaaattcacatgctagaaagtaaaggtaaattaagtcaaaacagtggtcagtggtacaaaaggaaagcatgttagttttgactgtggggacagggacatgtttatcctgagctcaaagggtagcctggacagtggaggatttttagcagagaaaagggccacagcttagaacatgtaggaagggagcaaggtgggggcattgacagccagagctactcaaaagagatgtggaggaaaaggatgttatgtggttttggagacaagtaggcatgtgtgggaggctgagacgtgagatgggagggattggcaaggggttgactttcagcagtgtagagaagggaatgatctaagagagcttggattttcatcttcataaatggatggagctcttgggccaaggttctcaaacttgagcctttaaaatacaaaacctagagcttcaccccagagtttctgatttggcaggtcagggtggaaccctaagaattttcatatcctccatgtttcctggtgatgctgacattgctggtccagagacgcacattgagaacccagctccagggaacaagaaggagctccaagttaggcaggaaagccccaagcttacatttggatgggttgactatgagggcctttgcactgccacctgaagatggtagctaagagaagaggcaggcttcaaatattggctccaccacatactgtgtgttcttcagcaagccagttgaccctcctgaggctcgatgaccaggtctgtgaattgaggataacaatagtatctaccattagggatgttgtgcacatcagttgataacctttgagtcaagtactcatggaatagctgttttgcattatcctcatcaccttcatcatcatggccattctggccagcactaaagatgtacagccaacctcttctgtggctgaagtttatcttctataaaatgagaacttgtttttcatgaagctgtcattttcacaagtttggggtgcaggtgcagattgcctactgttgtgtttctgaacacttccctcgcgaggctcctaaccccaccccagtaaactcatcaacatgactccttccagcttctacagctctggagagggttcctttttatcttgcgtttccagggatgtttcacggccttttgtggagtgggccctggctgagcttctggcccttcttgagtgtggaggatgtcacagactgcagtgggaaattaaaaagctgcttgcttcacagagtaagggaatgttagtagatgcttgaaaagtaccctgagggagctggtcagaggtgctctgtaaagttgcatctgttgctagcaccatgagcagctgtctgaccaggaggcctgggaacagggacagagagagctggcacccttctttcctctgccctacacattggcctttccgccattaagaccatctctgcttgactttttcagtctcctggctggcaattagcatcttgaggtctccattaagatcttttcaaggatgctcttcctatttggttcaatcttctggttgaatttgatacatgttatgatgtaggactttttaaaaaaacataaaacaatcaggaaaacctcgctatacccattccagcaattcaagaccaagttcatttttggtaaaaacacttgggaaagggcatttccaggctggctaagcactaaatggcacagccctgtccactgactccctcctcaactggtgtgtgttctggagggatccatgtctcagagcattacttcattttgaatgtgcaattaaaagaggccccgtgctgctggggatctcacacttctgctttctggtttgttttgcatgctgacactttgaggaaaagcccatttccctaattacagacatcgtccagcagcaggaagcactctggcttgttgatgcctgtcttgtgctttctctctgtttcagctgttttccttttaagatactcctctcagatttgtgtgcttcttcccttcccacattctatactgcccagcgcctgggattccagatctgcgtttgaatccaggaaagggaggtaggtcaaatttgtgggaatcaagcatatttagaaaccctaacctcaggctctgcgcatctgtgggtgtctgtaggagggatacttaggtttcatgcctgcatctgcgtttcctctcctctgccgctaacattcttccactgagcacatgtccatcttgagctggaaggtttagcggtttgccatcttgtcttgcctgcagttatgatgcagctaaagcatccttctctccttcctataacctatgccactttgctttaagcattgagtatatttatgtctcaggtttatgaaagacaattataaaatctcaggagaccatcataagctcctgtaatatcttgcagtcctgagtcacccacaattattttttaactggctaggaaaaagaatgctagcgatttttttttaaatagacattcagtaaaactctagatatttcttaatccacatttactgtgtcctttttgcttaagtcaggtgttttggtttctctagcagctgcaggatccccataaagattatgctcataaggtagtgatggaaaagtaaaatagagcctgaaagcgggaaacttcagcaaggcactaaggcacagacaagagatgttaggtctgccggctgttgtcattgcagtctgctgtggcctcacccccgcccccccccccgccccgcccaggccttcacagctgagtaggaaaggatcttgggatgggtaccagggcaggatcaaggaaagcctgcaactgcgctgcccttctcatcatccatatgtggtttgcccagataaaagcaatatagtaagatctatcaggcatattcaacgtgagttcttttttctagcatcttgttggttgtttgtgtttttccccagagaagagtgagtgatgaggtggccctgggacatggtagatggtgcagttcactggggagacatccttggccccactcagggtcaatatgcgccccacaccgctggctgcaaccccaccctgtcctcttctgctcaaaagagcatgcaagggacattgctaagtggcaattttggttgcaacccagtgttctgttaattattcacaaaagctagctctctttttaattaccaattgtgtgtgcgttgcgtgtgcgtcccttcccccttctctgagcacacctgtatgatgaggcatgtacttcttcctggtggagaagaactgcagagatgtctcccaggttgagcctgcagcctggcccggtcaccagcacagcacggtgacttgactgtcctccctggctcccttccccacccgtggcaagtggcaacttgctttcgctcacactgaacgtggtcaacttgcctccctgtcacactgtagcacttgaatagggcaatattagattatagcagaggttctcagacattagagtgcttaaaaatcacctgggaagcaggccaggcgcagaggctcacgcctgtaatcccaacactttgggatgccgaggtgggcggatcatgaggtcaggagtttgacaccagcctggccaacatagtgaaaccctgtctctactaaaaatacaaaaaattagctgggtgtggtggtgtgcgctgtagtcccagctactcaggaggctgaggcaggagaattgcttgaacccaggaggcagacgttgcagtgagtggagatcgtgccattgcactccagctggggtgacagaataagactccgtctcaaaaaaaaaaaaaaatcacctaggaagctgtttaaaatttacccttcttgtccgtatgccctatttgctgggtctgaggtgggcccagaaccctgctttccagaagggagcctgagggtggggtgccctgaagaccacactcaggaagaaccggacatgtgagctttcatgagccagagtcctgccaagaactagaatctgcaggtggctttggccagtcccacttagaggcaagaagacgtgaggatagtagagaacctggaaatcacgcagtccccaggatgaaagtggaactctcggaccagatccttattctcttactttcgtgagccatttctgcctacctgttgtcagggaggcaggaggttcatttttctctcacatggtgcctgacataatgacttgcacgtgatagatgctcaacaagcatattgaatgaatcaatcagttagattgtaaattaaatgcaccagatgggctggttgtttatttataactacacagttaacatttatattaacataatgttaacaccaaagcgtaatatctgttttctgtgttaattatggcaaggtgggcatagagaagagatttctgagtgtcttttgcagagcttgaaaatgtctatgtgttggttgagatagatcagcctttacttgatgcactttcaatcttttaagttctgaaggcacagcaagagaatttggtgttgaaggtttggataatgttttcaagtatttcaatatccctctatttctaaacattagtaaaaatcatgcctcatgctaccatccttagcttcactttgtgtttctgaattgtgtatctctatatactaagaagtcccccatgtatgcctgcaaatatgggagagtcaaccgctcagcagaatgtgcacaatgtaaggctgtgccttggagaccaggcaccctgtgcagtgtgatgcacaggcaggcctcaggatggcgccgtggagggcaagtgatacctactgacgaagccagtggagtggatgcaaggccaactcaggccctgcagctggggttctgttcctcagtgttgaggccacaggtctgtgtccacatgttttcttttgtacagtgggattctgccgcacaaggcagtgcccccagccctttgcagatgagtcaaacatgcttgtttgcagagcctggtgctgggtggggtggtcccatcacatcacctcttccttggtcatttctctgtaattaatcagccagtccctgaccaaaccagcaagatcaattctccctctggttggactcattcctcttttttttttttttttttttttgagatggagtctcgctctgtcgcccaggctggagtgcagtggcatgatttctgctcactgcaaactccgcctcccaggttcatgccattctcctgcctcagcctcccaagtagctgggactacaggcgcccaccaccacgcctggctaattttttgtatttttagtagagacggggtttcaccctgttagccaggatggtctcaatctcctgaccttgtgatccacccgcctcagcctcccaaagtgctgggattacaagcgtgagccaccacacccggcctcctctttcttatgaaaattaacccacagatgaagtttcctttcacccaagtcttgacaattttctcagcttcaagctgcagaggaaattcctaggcacatcttaacagggctgctttgcattgagggggctgtgtggtttgagcgtgataagcctggatatctttctgcactatgctgatttttgttcccttaaatggtatggatttggcaacaattgtttgcaggtgatcttttcccagagaaccacttatttcccccactgtctctgtatgataggagggctctaatggcccagggatgtgaaagtgagacaccttcaatcgctaaggactgctggaaatgtgaactacaggaagttgagggggctggaggggaggaggcagcacctgccggagccatgcttcagtgggtctcaagaaaagcagaagcctggaatctcagggctgaggccccttgataactaggacagatgggttaataaaaagggatacagagacataggctacctcttctggttcaatgccaagctagaaaatcctgaaatgaacacagatttatgagataggagtaatatatttaagaacacagtcttacatagagataactattttcccaaaacatccaaggtaaatttatatatctttatggatgaggttgggtcttttcagggaaggttggggagacggaagggaaattacttattatcagtcctcatgattcatggattccatatctccgcattcatctattcatttaaatctgtttgcaaccccaaaatcaatactcacagcacttttgcagtcatttgtgacgtgcacaaagcagtgaaaaatttaagtcacccaacacatacgttgaggtcgcacaaggtgacactctgctttcttgttttagctcttataaacacattttcttttctcttggcccatttagtccatggtttttgcatttttgtgcttttctggggtgattttgctatttaaaaatggccccaaacacaatgctaaagtacttactgtctggtgtctctaagtgcaagaaggttgtgatgtgctttacagagaaaatacgtgtgttagggaagctactttcaggcatgagttattgtgctgttgaccatgagttcaaggttaatgaatcaacaatatatatgaaataaatatctttaaatagaaatacacataaaacaaggttctgtattgattgattgacaaaaaagttgtaaccagaggatcacaaaaacctaacaccatatttccccaggagcaactgttcaggatttgcaaattcagctttcatggtgattttatagagcataactattgtgaataacaagaagcaactgtattttgtttcatgcataagatggaaagagaacagaaccagaagtatgatatcgatgaaatggagagaggagaaagaaaagaaagaaatgacactatgaagatttattagttaaaatgttactagtgataataaattaatcagaactttggcctctgcctttgatcctggttcccataatctctaagtgccaggctcagataatgtggcccttgcagggtttgggcagctagtcctctaaccattttctacaggtaaacgtggacatgaaagaagccagggtgaggcaggcagcttccagaagcacacactgggctcagctccttccttcctaacctctattttagctccacgtacctcttcaataccagaaagtcttcttctgattctgccagagcccagctcctagaacctagctcatacactcaccagccttttttgtcaacaattcattcaaatatttatttacttaaatatccattaagcactgttgcttctctcgcccaactccattgcacatgctatatcagttatctgttgctacataacagatcactctaaacttagtggtttaaaacaacaataattacttattattgctcataatttctgtgggccaagcatttgagatagctgggtaggctcaggccctctgtagggttgtagtcaggtgtgggccagggctacagtctcatctgaaggcttgatagaggctggaagatactattccaaggtggctgctcatacggctggtcacttactgctggctattggctagaggcctcagttccttaccacatgagcctccccaaagagctacttgagcatctttccaatgaggcatctggtttccccagagtgagcaatccaaaagctgaggaaaagtgttaagggctttcatgagctagcttcagagacccaacattgtcactctgcagtcagccactctgtgtgcaagggatgggagtaccaggaagtgaggatcactgggcaccatcttggaggctgcctgccatgtatacattttaactctcaaacaaaatttgaagactgaagacccatacttaaagtagcctctgttccaggcagtagagaacaaaatgtaaacgtacttacactaatggagtgtctattctagtggctttggggaatatagacaaaaaaacagaactaaaactctaaggtgggacagggagctgggagtgttagtgtcaggtgggcctatagagctcagccccccttcatcatgttggcattcatgctggctgttcctctgtaggggatgaaattttcccctgccagaagaatgggctctggacagcttgttcagctgcttgctcaggtgtgagcatctgtgcctaatcttccagtcagactgccctagaaacatcatttcttaattagctgaaagggtatctgaaacattgtacttatggtggcaagcatggatctattgctcttcatctataaagttgctgcctgataaggtagaactacacaaatgatagtttcccaactaaatgcattttaaagggcaaaggttgtatagtcagctttagtcctggcataggggaaatggactatggaagtctagttggaagagaagattgaaacatgccagtaagtgcaaaaggatacagtataatttaaataaaacacatggaagacatgaggatgctagtgggatatgatgggctcatccatttctgcaggctccaggagggtggctggcagggcttctttggtgtggggcagaaagaatcaaagcctgtagaataaatctgactccgttctagatttaactcctcatggtgtatcacgtgcaaggtgaagcctgactggcactagggaggattttgaggtaaggaagcattgtctttggttcagtccaagccctcactgactttccaccatcttcaggtgggggtgggcatgtccgtctgtctcccagcctcatgcacacacatgtgtgcacacacatgcacacacatgcatgccttcttatgaagtgtgggtctggctgcccgtgctttttccttcatctcaccatgacttatccttccctcttctattcaaagttcccacttgagagggtccagttgccctgggcacccctccacactccccactcatgactgaaattagttacagtggctttggtatactgtcatcccctttcaccagtgaagaactctattgctatagtgcccaggtcacacaaagctgggccgggtcgccagcgttcccgattctcacctctgtgtccctgggtttcctgctctctggcccagtggaaccacctccacggggtaccattcctttccagccttgtcttttgttcattggcaatgatgttaacaaattaaataggggaatatttgttcatctaatttattggtaaaaaggctagaacaagcttatccaacccatgacccataggccacatgtggtccaggatagctatgaatgtggcccaactaaaatttgtaagctttcttagaacattatgagatttctttcccttcttttctgtagttcatcagctatcattagtattagtatattttatatgtggcccaagacaatccttcttttatcagtgtggcccagggaagccaaaagattggacacccctgggctagagcaataaaatgggcacatcagatttgtgtccacaacagctgacacagtggtttccagtcaggggtaagttacccttagggaacacttggcaatatctggagacgatgtttggctgtcatgattggggaatggggtgctactggcatctagtggggagaggccagggatgctgctcaatagtctgtactagatgagacagcccccgaccctacacacataacagagaaggatccagcccaaatgtcaagagtgccaaggttgagtaaccccgagctaatgtgatgaatggtgccagatggaaatgggtgggaccatcataaggagggggaacagggtaaaggcaaccatcttaatttgtaaattgagtgtgggggatgtgttttgaccacatgcttttgaaaagggaagctgttcattctccagaagcccagcggagatgttggatggatggggccacccatagctgcattcatggacagctggacacgggcccaggaaatcttggcagcgtcactggggccggtgcacttttaagaggagcttgggtgatatgaaattgtttggacaaaatgagtgagaggtcttgaaataatgtcaaggcaggaagaatgcattgacttggagtggctgccaagagcaagcatttgcaggttgttttggggaagcagaactggctgtgttctctttgtcctgtgcacagttggaagacgggaaatggaggaggagagatggggaaggagagatggggaatcagataagaaagtgttttccaacagaagcatcggcacacattggagtgagttcccttcccttaagaggccaggagcttatgtaggaaccaagctccatctgaagcagccacagggctggagcatctcgcagattagttgccagggttctctgattctggccctgttagcctccatctggacacacagcaattgcatgtttagcatttttattacaaaagcaacatacaattttgacccttgaacgttacaggtttgaaccatgtgggttcacttatatgcggattttttttcaacaaaaatattggaaaaaagttttgaaggtttttgacaattttaaaaacttgcagatgaactccatagcccagaaatataaaaaatgttggccgggcgctgtggctcacgcctctaatcccagcactttgggaggctgaggagggcagatcacgaggtcaggagatcgagatcatcctggctaacaaggtgaaaccccgtctctactaaacatacaaaagttagccaggcgtggtggtgggcacctgtaatcccagctacttgggaggctgaggcaggagaacagcgtgaactggggaggcggagcttgcagtgagccgagattgtgccactgcactccagcctgggcaacagagcgagacttcatctcaaaaaaaaaaaaaaaaagttaagaaaaagttaagtgtatattgaatgcacaaaatatatgtagtctattttttcatttactaccataaaatgtgtacaactctattattaaaattaaaatttatcaaaacttacacataaatacttatatgccattcacagtcgaggaaaatgtaaataaatataaagatgcagtattaaatcataattgcataaaattaactgcagtacacactgtactgctgtaataatttcatagccacttcctgttgctattgtgatgagctcgagagttgcaagtacctgcctaaatcactgtgtgatgctcatcatctctgtgtgagcagttcatctctccagtaaattgcatattgcagtaaaaagtgatctttaataagtgatctcttgcagttctcaagtatttttcataatgtttagtgcaataccgtacaacctgaataacaccatgggtcccatgtgaagggtcacagtgaggctggaagtgctcccaagaagtcatgacattataagaaaaagctgaattgcttgatgaggattgtagatggaggactgtagccatggttgcctgccatttcagatggatgagtcatcttgtaaacagatgacagtaaatttatggtattgataaatacagtacagtattgtaaacatatattctattccttatgattttcttaatgacattttcttctctagcttacctcactataagaatatagtatatgatacatataacatgcaaaatatgtgttaatcagttatttatgttataggtaagccttctggtcaacagtagactattagttaagttttgggggagtcaaaagttacacatgaatttttactacagggtgggtggtcagcatccccacattgttcaagggtcagttgtatattcactgtggaaatcctaaaaagcaaagagcaacatgtttccatcaagcaggattttgccagcctctggttaaaccctgaagcctgagcaaggcagtgaaatctccagacctttggggctcacattttagggaaagggcaggtttgtgttgatgctacaaaggtaatagatgcttttgagaagttaactatgtgcgggggtggccaaggtaggccgaagcagcacctgagactggatcatcatgatgcaactctctgagtaaaggcctgagaaggaggaagccaagcaggaggcaggagaggcctcaacctggaggcagaagcacagtgtggtggagatagtgagcaaggtgaggttgcaggtctcgggcctggtcaaggagagccttgtggaggagcaatgaagatttgcgatgtgatgtggatggagaggttccttgtgagcctcactccaccttcagggtagggaattgtcagtaaggaaaggaaggaccaggtgagacttccaatacctgagagatggcggtggcttccacgagggcagcctcaggagctatggggagacatgatggcttgggaatatattttaaagaaaagctactcagaggacctggagaccagctcatctaacctgcttcaagattctccatccctgtgactgcatcagatggagctcagctcctgcacaagctcatggcttccctgcatcactgtgagtggccaatgcttctggtagaaagcacattcctttctgacttggtgagagggaagactcctgaaagcagccagggtctcatcctcagcaactgtggtgctcaatgtcatttcctcaattaggagagactgagggaggaagagatttgctgagggagtggcaggaggagtcaaaagcctcatctggagtatgtggaggtcaacttgtctgttacacatccaaggggggacgtcagataagcagacatgcagatcaggagctcagtggagagaaataaatacccattaaccaacaaatatttttgatgacttattctgcactaggagctgttccaggcatggtgatatggcagtgaacaaggtcatcctattctcacctcccagagctggccctctggtgggaagaacaagacaatactcaaattcaacagtgaatcatgatttaaagggctgctgccttatggagatgtgctgcagagaaaaattaggcagggaagggaggtatgcggcccaggacattacagaagattatttcatgtcaaaaaacatttttctacaactaagtgcacatttaacttgtgtcacaaaaaaggtctcaaaagagcaagggatttgcagtgttttcaggagctcaccagacacctgaaaaccctccttgctgaaccactacctgcccaggtgttcactgaggtgccagacccagcaggctgaggggtacaggtggagttaaggaggagctaagtggcctggtttgtttctcagtttcgtgctttggaatgaagtagtgtcacacatggaaaaaaataactgggaatgttgaattaagaaaaaatagggagcaagttctaaacactatttggaagaaaatgatccctgggaatgctaaagagaatttgagccatgagctgttcctgtagtcagagttaagcattgtgagttggcaaaagcatcaggcgggaaggactgagtctgtgtgtgcaggaggaatgcctgcaggggaaagtcacgggctccgtccctgtctcagttggtgggggtggcagagatgccacagccgtggccaagactacgctgggtgaaaagtgagactctctggatttgccatactgactgaaagctgatatctgaaaagtggagctgagaacagcagcctgggccactgtgggcagtgactggaatggagatggccatttcctgccaaggtggcctgagaaagaggaggttggagaccaggacaaggccccgggtgggtgccggtgggtgccagtcctgagaaggtatgcacaggaacaccatggacattgtttattcccccaattaagtagcccaaaaatgtgccataagctgtccttgcagtgaaccagtgattctgcccaaaccatcaccaccaacatacccaggtcaactccggcacaggaagtcacatggccagaaaagggccatcagccacatcggtgctgacactgagtgcagcacattcttctgccacctgcttgcgaacatatctgcaatgcaccatcaaagccacacagagtgtccctggcgtgtgcctggaggttgctccgggtctgcagatgctccccaagacccgaccacagcctgtctcacttcctttccattcacttcaatatgggattcatgcccaagtgccagcaccgatgtaatgattagtgacaagccaatgaatttttaaaatagtagctatgttaagatttatatgaattaaaaagtatttgctctcattttatttaaaattttgttcctacaaagttactgtctcagtttgagctgatggtgcagtctgctgttctgcaactacataaaaagtaacctgggccctgcagaggggacacaagcatcggggccaggtacacagtgacaggggtatttgagctgggtctgtaaggatgactgagatggctgggaggaagagctgcacgcctcagcagaaagcacacgtggtgagaacaagaagggaaagccacagcatcccggtgcagtccagtgtggtctgtggactgggcatgttggaataggcaggaagggctgatgtgcgctttgagggaggaccgggcagctggagagggaggcgtcaggaagcaggagggcagaaggtgaggagtgaagggcagcagtggaaaggacagggttacgccaagcagtggtcatggatatgggcagtaaggaacatgcaccaagggcgcctggaaaacgaaccttagagaacgcaagtcctgcggaggactcctgggttcctggctgggacaccgcctgggcagggaaggcagagaagatggagaacctggtctcaggtggcatcagaacccagcatccgcatcaccaggattgcaggagcagcagcgtctcaggccctgggtgtgtcagagcccccaggccacgtggaagtatgagacgtgctgggctgcaggggaaacaatggaaatgaggttggaggcccgagaagacccactgcaggaaaagggtggagtgggggaaaagcaggctgggggcagtggctggcctgcaacaaaagcattgtagaatgcaggcgtgagccaccgcgcccggccaaggcgggcagatcatgaggtcaggagatcgcgaccatcctggctaatgcggtgaaaccccgtctcttctaaaaaaaaaaaaaaaaaaaaaactgtagaaaggggaaagcagtccaaagagaagtatttcttccaagagactcatcagcacactgtgtttccagagatgtctttctgttaacagcattcttagactcaaaagtaaatgtagatatactttaaaaaacaaaaacaccttgctaagagatgaatttttagaaacttgttggacaaagaaaagtcattgatagtcaactgctgtgagaggcaagccaggaaatgatgattaataccctcaaattataataaaacccatgcctcattaggggctcgcccaggagtactgacttgtggatagacaccgtctggggaaaactctgtcgcctgtgtcaggctgacgctcttacattttatagccccttgtaggatagtgcatgttgagaagaagccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcttctgaaatgtatttatttactgcaagcagtgtctctcctgtgtcagatgtcctcgtgggctgggaaccggcactatctctttagcacgggccctgcagatgggaagtggcgttgcccaggaagtggtctggagaagcggggagaagacagcctatgggccccaggcctcgggagccagggagggtgtcactcttcatgtctcaggcagtggcttgttgctatcatagccccgggctggaggtgggaaggccttatggtgaccacaagtcacagttccgtgtgggccctcaacgtggcctcacttcacctctggggctcagcaccagcgtgtgactgactgctcgaggcagcgtctcgcagctcaggtgggtgaggtggtggtagcgtcctccttggtaatatcactgtgatgaggagcaaggcttctctaacattgtctggactcaggaggagcagttggtttgttctcatgtagattctgcctcctgtatgctgctgggaccctgagggtcagcccaagagtcctgttttgcaatagcccttctgtttgcttctctttgcggtatgtttatttttagaattctttgtctttccccactccccccaaaaaagaattatttaatttggtcacttccatcaaatgctctgattttagcttagttagaaggcatgctgaaaactgtaatgatgatgtgaacagaaagacaactgtgtgttgggagggccaaagagggaagtgcctttgttcagagatgggagggtttgtctccactttgaaagggtttgagtggttttagcaaacgttccctgccacgtggggtcctcaccaaagttctctgtctctgtcttgcccaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcaggtgggccacagctggtcctgctccctgggcccagggggccctgtgaccccacacagacttcctggctacatgcaacacatgtgcctatgtgccctgtgtgcccaaataacacaaccatctccttaagcatcaattttggccaaaaaatgcctctctctgataagagcctttcctctttcacagccacagctgagagggtgggtccctttgtgccagcagtgtgggtttctccacagcagggaaccactgttacccagtgcaaggagggccttttcagagaggcattgataggtgttgattggtttctgtttatctgacaaggtcctaccatacacactgataggcacttgattttatggcttcctaatatctcttgcagaactttctgtgtcaacactcatatagttgcatcacccgttctttggctatctggtatcacctgctatgcaccacaatttatttaactagtacctattgatggacacatttgctgtttatgaataaacgctgctaacaacattgctctagacctatcgtatactacacttgtatgcaacgtctgcaggataaactttgaaagggttgggattgccacagcaaaggatatgtgtgtttatttttttattttttatttttttgagacagagtcttgctctgtcacccaggctggagtgcagtggcatgatctcagctcaatgcaacctctggctccaaggttcaagcgattctactgcctcagcctcccaagtagctgggattacaggcatgtgccaccacacctggctaatttttgtatttttagtagagatggggtttcaccatgctggccaggctggtctcgaactcctgacctcaagtgaaccatcctccttggcctcccaaaatactgggattataagcgtgagccaccgtgcccggccatgttatttttatttatacacttgaaagtacttaagtaatgtgtaaaggtctttctggttttatttactgaatgaatgagtgaataagttttgatcctgttttaccatgccaggactcgagatagattggaaatgccttctgcatcattttcatttttcctcggtatggtttactctgctttgctctccatgtggcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgtgagtatcgtgccttccccctcacctcctgccaccaggcctgtgtggacaattgggaataattcagcttccttgtgactggccccacatgaccctgggaagaggccatgcattgccatttgacaacatgcatgctggcctgttctaaagacatttctaaccaaagctatcacttgtgacccagtgtttattttgcccagtctaactctaaaatgaacactctttttgggcaccgagggatgtaatatttaaagaaaatgtgattcagccccatattctccttttaatggcaaattataggttgcatagcacattctgtggttatccaactaaaattaaaatactgcagtttttttactcaaactacccccttgatctcagactttacttctattttacatgaaacaagatgccaacaggaaagatgttaaggaaaagttcctgggagtagcatccatgagtggtgagtgcaggtttgaagacttcagccttaggcccacagtcattagagggtctgtctgaatcctgggttctgtttgctatcctcagtggttcagtgtaaatctaaattgtagaaggttctgagatacaggccaacgtggtcagtcagttgtccagagaaggtaaagaactgtctttgggaggtgtcaaccttgttccctcgagggggtctggtcaaggtggctcagtggggcagttgtccctgggggaaatgatcccctggtcacctctcagtgtccctacagagatgcttaccttggaaacataaccagaaacagcgatgcagcctcatggtttggcaattggtgaatccccagccgacttcgtaaacttttcctagatttagaagcgttttctctgcctgtccatctattcaaaggaatttcctcagacttcactgtcataccttgtattttaaaaatgatcttagctgagtgcagtggcacgcacctgtagtcccagctactcctggcaggaggatcgcttcatcctcactatgatctcactatcgtttgaggctagtttgagaccagcctgggcaacatagtgaggccctgtctcaaaaaaagaaaaaaagaaaagaaaaattgaccacaatactcttaaaaaaaaaaaaaaaaaaggaagaaggaagagtggcccaggttgccacgcggcagtgcctagagtgatggtctttagtgggatgcagccccagccagcagcagaatgctgtggggagggaagacattgcccctcagtggaggcacctatggctatttttgctgaggtttggcttcttaccatctcagcaataatttccaacatgaatgtcatgggaccatgcacatagcatcttggcatgtgaagtcaacccaaaatagcataatccacacgatgaggctggccaacttctgctggttaagaagcctgctcatagcctctttggccacgaagctgtttcttttttcggagttgtctattcccgaaaacagcagttgcatccttcatggccatgacttttgctctctccttcctttctgggagatgtatataaaccccatgcagaaggctgggaggtgcagctcttgtttgatgaacatgccttgttccctatctgccctgtacagactgacatctcatgtgtcctcacagcacatgtccctgacactgaggcttatggtttatgcaagagagtctcaaacttgccgtgcttcctattcagctggtgtcagagctaaccaggcatgggcctgtgagagaggggcctgggcttctgtgttttcatcgagcaccctctccttagttgtcttcttctcctgggttcttattcctgggttcttattctcctgggttcttattccactttatattgcagttgtccagttatcaccccataattgccaacctcccagataatagcttccaaggctttctcccttgtgttgtccacagctcagtcccacaccttcccgtgctccctccacacctgcagggctcacctgtggactgatggtgcatagcaccccatgcccaggcctggcatcaggcagggtattagtgagagggaagagcagagctaagcctgggcagcaagacccagcttcagaacccatgttcccatgatggttgtagaaccttagactaagggaaactttccccaggctctgctcctctgggtctgtgactgtcttgaggattcaatgaaaatacacaccacgtacaccgcacagcacatgtggtcatcactgatgtagcttttcttctctcttcagtgctctttctccatcatgagcaccaggaaagtctccttgtcagggtatcttatggtgtttttaacagagaaagtgtgaggaaacaccttggaggggtttgccacctggcaatttcacctcttgacaacctttcatctcctacagaacctggctggggttcttggctgttgctgggtgtgtaaaccttccttgttgcagtgtagtgggcgtgttatactgtgagtgtttgaatatggttgtgtatgcttgtggagagcagggagagtttgccagcatactggatacagtccaagtctaccatgcttccagcacggggcagggtctgcatccctgaatacaacgtctcccaagtccaggttgcctagacgttggtccagattctttcatctttagaagtgtttgtttgtgtgtttctttcatgggaaatagagctaaaaggctccagggaactcttgtaaaccatcaccagatcctgtggctgccctctcagtgtgagtgcgtcagctcctgattcactgtgggagtctgtcctatattcccctgttgggtcaggccaacgttgcaggaagtcccagacctggttttgaatcatccaaatctgccctacttgcagatagttttataaaatgcacattatttgcaacgaatagccacagcacaaggtctttggagtcagaactagattccagtcactgctggatgtcctcactgagccagctgctgtttttttcccactgttcttctcgggccttcattcagattctcctaacgaatgtgctcatgtctactttccaatcatcatgtcagctaatccatccatggaccaacattactggagtctgtagttgcatgaagcactaagtgccaggcaccattctggactttgggaagggagaagtgaatcagcaagcacctgccctcatggaccctgcatttcagtgggagaaaagacgctgaacaataggaaagaactgcatttaagtaagggcgtagagcacactggggtatggatgctgggtcttctttctgctgcgtggggaggatggaccttgctgtgagggaggccattgagaagaggcctgaaggcagcgaggaaccatccccacccagggaatggcaaattcgaatgccctgtggcaggagcgtgcctggggagcagggcacccacagaggccagtgtcactggcagagagtgagtggagaagggtggagttgagggccaggttgcagagcactcacggcactgggaggaccctgctttgggcaagttgggggggctgtctttaggaagcaaagggccagggccagctgacattcggtgggctctgcctggctgccacatcatcggtttgctgtggggagttgtgcctgtacatatacttgcaaaccaaatgtgttgatttttttatcgtgatttcagggccttcactttctcatgcctgagcatcagtcagtttgtctccgctctgatctcctgtccaccccacccaccgtgcttttacctgggtcctgtacaggcctgtgggctggcccttaagaggttttcaatgaatgcttgtcacctaaatcaatgaattgtttggatccattctccatctcccagctcgtttttgctttccacttcctgacatgtagtaataccactgtagttctgtatgggggcagctccacacctgtctatgttggggagggaatggggattcttgcacctctttctacctcctcttaaatcattactgatggacagatgcagggacacagcaatagatatagaaatataaaaacatgacactgcgcactctatggtttgtaagattcactttctctgggtaggaggcagtgtggcctgttaacaacataccattcgggttgtctggcctcaaatgctggctccaccttatcaccagctatgggaccttgagcaagttactcagtggtctgtttccttcatttctttgtctgtaaaatggctttaatgtcatctctgactcttagagtcattgagggttatagagtatcataaaccgaaggcctgctgcacggtgcttggcaccgaacgaagcagcttcaccccactcctgcagtggcctggaccacacttggatacatcagtaacatacactgaaggtcaggtcctccatgcaaactctttccatccctgcatcacaggtgtaccatgacctctgcaggtgagtcattcttctgcaggtgagaaaaccaggcaggtcccccttatccttcccttctcttcttcagtctgcagtaggtgtgtttatttccactctgtggctatgaatagatagagtgagagtcactggccataaaaggattcacactaggcttttgcttttatgaagtgacagacttaaataaagaataattatttcggccgggcatggtggctcatgcctgtaatcccagcactttgggaggctgaggcgggcaatcacaaggtctagagatcaagaccatcctggccaacatggtgaaaccccatctctactaacagtataaaaattagctgagtatagtggtgtgtgcctgtagtcccagctacttgggaggctgaggcaggagaatctcttgaacccaggaggcggaggttgcagtgagccaagattgtgccactgcactccagcctgggcaacagagcaagactccatctcaaaaaatatatatattattattattattatttcacagagggggttggaagtttatttttgcattgcaagccataaactaatcaagaggattttactagtttggtggataatatgggtaaacaaaatcccagcgattactcttcacactttcatcgtgagtaccaatatgctgtctccaccattcagatgccagcatttcagtctgagaatcgctttacgtggaaagtggcattggtaagaattggactaaaaggtaaaaaaaaaaaaaaaagaattcctgaaatgcatgcacctccatagccatcacaaaatgcctttgctcaaacagaccttgaaaacactgagggtaaggcagcatattttggagatcaaaatctgattataaatcctaggtaatgcagttcaaaatgcagatgatggaagcagattacgtctgggagatgctgtccaactcggatcccagttttctctcctcagaactatatgtgaaatccacttacagtgagagtacacctgagctagagggcatttaccacttaagggggctaaacttattgtttttcaaacaagaactcgggtgtggaggagcttgtccaaggcaggaaggcaaaaccaggtccctgatgttgtctggggctaagcagaaacagcagccagcaaccaaatccatctccagatggatccatctccacaaccacaggcccctccctattccccatgcaagatgcagcaccagggcatgtccatgtgaaatctcagaacacacagaggcgtccatcagctttcccctctcttgtgtcctgtccacagagcttacccacaccattcaggagtgactttgagaaggtagttacagggcctttgcacatgtgcttgaagaataacgaatataaacagaggctctttgtggaggggctgggcagtgtgggtcagtggttgtccctcacagccgcctgtggcatttctggaggtgatgttcatcacctggcctttgctatataagcactgcccttgtctggggtctagctggccagaagcgagcactggagggggagtcctccagcccacgtttggtgggtgagggtcagagtgctgccttgttggtgacgtcagggaccaaggcaagggagaggagctgagtggggaaggagatcccctgcccccagaggccttgtatagcagcacagtttgctattttgagaagctagtcacagctgtctgtgaaaaatgaatttgttaggaaaaggaaacaaagcttactttataaaaattatatatcccttccccaaaagggaggatccaggattgaggggtccgaagcatatacaatttgaagactctcttatttttttaaaaatataaaattaggcatacaatagaatgtattttttggactaaggaaaaaaattcaataaattagaatttttttaaaggctggtcaatactacaagcatacaaactttagaaaagataatgtaatattttaattaactgcctgacacgtctctataacaccttttgtttcctccatgtccttgacttcactgtgtttgactacatcttagttcaacaatatttaataatatatttgtctatatatagaaaaagagactattcattccttcctctaggttcacacttcattattaataatatcatgtacatttttagaatccttgtcaaatttgggaggggaagataaagtagaacagagtgagcttccctggctgtgactaaaatatcttttgcaatctgtacaaaacctaaggccgtgcagtcacattgctgggctcctcttggtctggaggaggctgtgatcaactcctctctgaccctcatccacttggttcacacaatgtggtttattgccattgtgcacagccaattctcccacacacatcgctctgctaaaatgtaatgggatgtggccttcatttcatcttataaatgatcttagaatggaaatgctctaaaaagtccatgccaggcaaaattttaaagatggaagtattgtttctttgtattaagtgtattgtttttggctaagagtccttgtaaatcttacaaagccaagaacaatttcaaggtgacctttaagacacataagtggctgctctccaaatagctcgattaatgttaaaaataaaaggtagtatttcagatttgtggatggagtcgtccaaccagtaagtcaccaatgctattttaactacagtttctaccttctgactttagaaaaaaaagttacaaaaacagtcattcattcaacaaaataggcatgttttcaaccagacatgcagcaggcattgtgataggacttggctactgtgaggaataagtcagaccttagtccctgccctcaccggactttgactgcagggggaagatgacaaacgcaagctgatgtgctgcaaagtctgcaatgcatggcagtaggtcccctccaccacgacactgggcctacgcagcatgatcttgattttgttttcatttacttgtttatagtccccacccccacttgtgctggatgcacaagggcagagatggggctgttgccttcacgagtgcaacccagcacctagaacatggtcttggtgggaaaaatctctctgggtaaaggaacattctggctgctaacttgaatggtggccactacttggataggaggagggacaacatggttcatcgggcctgtctcaggtgcccaggctggactatcatctagtgtgtcgctaactataggaactgggaagtggccttcagagcaagtgggctgactggatttggcagagcttgacacctcaccaggcagatgcaacaaaagagcagggcagacccagccatcccattactgggtatatacccaaaggactataaatcatgctgctataaagacacatgcacacgtatgtttattgcggcactattcacaatagcaaagacttggaaccaacccagatgtccaacaatgatagactggattaagaaaatgtggcacatatacaccatggaatactatgcagccataaaaagtgatgagttcatgtcctttgtagggacacggatgaaattggaaatcatcattctcagtaaactatcgcaaggacaaaaaaacaaacaccgcatgttctcactcataggtgggaactgaacattgagaacacatggacacaggaaggggaacatcacactctggggactgttgtggggtgggaggagcggggagggatagctttaggagatatacctaatgctaaatgacaagttaatgggtgcagcacaccagcatggcacatgtatacatatgtaactaacctgcacattgtgcacatgtaccctaaaacttaaagtataataataataaaataaaataaaataaaaaagaaaaaaaagagagcagggcagcaagagattcacggggtagcatgggtatggtggccagggcaggcctggatgcctgcaggagagggagggaagtgaagcggtggatgccgagtgggtgtgcaggagcccgggcatctacagaaccccagtccgagccccaggaggcagcaccatgtcatggtcacgtggtgccctgagaccattttggtgccctgagattctatggatggtggcagagttttccttgatggtggcagactggccgggtggtggagggattggcacgtggctgccccaggccacaccatgaggtgttgagagagatcctggctgctcagctgccccgagtgtgcagcatggagcaggggcggctgctctgacggctcacagcaggagaggcacctggagagctgggctgtgatcaggcccagtagtttgcagatgtctggagagaaactgagtcagagaggaagcccaggaggttgtgagcctcagcgatctgagaggcatgcatgttgaagagtgagtgaggaggatgggaagcctgcaggcttggtgggtcctaaagttgcaagaacatcactgtcccctgcagctaagtgggcctgatgtactccactcaggccacagttgctgtacatgatctcttgggaccctagaagtgctcctttccatgatagctctttaatacattagttaaaacgattcccaggaagcccttgttccaagtatgcaggatcagataaaaagcgcagaaaccctcagagcagggaccgacggtgagtgcagtttgccctcagaggccttggtagtcaccccttcccaacccccatgccaccactgaatccccatgtggcttgttcttatatgccctgcagctgaaattcaggtgccctcctgaccttccttcccctgtccattttgaaaagaaataagcagtgtaatctttgagtcatcccttttgtactagccaagttccaggtgcagcatgacacactcgttatctccacctctcttctccccttcctttccctcatgtctgcacacactcccatcccctcacttcttccccctacagcccgcctctctctctctcacacacacacatacatacacacacacacacacacacacacacacttgagaaccgcggctgcatatcatctcctgtggacctgtgcacaacctgtggggcccaacttaaagtactgcatccattctccgtggtttatcctaatttaggtttgtttcctggtcatatagaatactgaagtatatgtctttaggaactgtctcaatttcttagagaaatgggatatacgtgaataaaatttttatgattcccttatactgagtcccacttgcactgcaaaggattaataacatctgtttccaaagcaaggcgtcacctgccatgcaagccacctgctggggaggggaggtgaagggtgtgagcattggtgagaggtgttgttctcatgttcaaggtgacaggtatgttatctggtgtccccaggctgggtcccacccagggcctgctcctggacgagggctgtatggctctgatttgcacacccctgattctggtggacacaaccctttttcttagaaagccagaatcactgtatcttctagtccttagctgcataaaaaaatggggtgcaaaacttctctggactgtctattcttattgttcattggtttatcctgcagggccacccatggagcccgtaacttaagatgcacaaatgagctattgagtgaatatgtgtgtgtgtgtgtgtgtgtgggtgtgtgtgagagagagagagagagagagacagacagagaaaaagaaagaaccatctggagggctggcaaaagcacagatgtctgcgttccatcccctgagtttttaattcacaggtctgtgtaaggactcttccatttgcattcctgccaagttctcaaatgatgctgatgctgctggtctggggatatggtgtgagcctgtttgagatacctgttacctacctgggctggattaacaactatgatcatttgagattttcatagttcattggagggtctgtaactgcatttgcagttgcaattcctgcaaaatgcccaaatactgtattattggactggttccgataaagttatctttgaaaatgcctctatttctagaaacttaagttagatagtaaagaaattcaggccatgagtcagacaggccctgccacttaatagctctgtgatttggacaacttaattttgctctctgagcctctgtttcctcagtaataaaatggggagactgatgttttatctgagtcattatggagatgacttaagtaatgtgtataaagctaagccaatggttctcatgtctctgtggttcctacatccatgaattcttttctttcatcagttctgaaaaacatcttgctacttttttcttcaaatattgctctctgttgttcttgcccatttcttccttcagagactcctattaaatacagtttgaccttctcaattcatcctttatattttttattttcccttgccttttctgtgtcctgtgctatgagtaacgtcgttgaattattcttccagcgcactaatttttccttcatttgtgtccaatctgctcttacgctcattcactgattttttttaattacattttttagaaaatttctagcagttctgtttgtttgtttgtttgtttgttttttcaaatatttctggggcatttttagagtatcttattggttgctaatttccatggttccgttttttattttgttaaacatttcatagtttatattctatatctgattattctactaccgaaacttttggaggatgtaaatctctctctctttccctccctaccccttttctcataactcatgcttccttatgttttcagtgatctttctgagcttatgcctgattgatattaatctgtgggaatcctgagtattcgatgctgggaacactttcctccagagttgaaggggatttcctcttcacaggtccttgctttaaggtgggaatcccacatccaggtgctcactgggctgctggcctgagattctgtccctgtccacagctgtgctgatattggcattggccctttggccaaacccactttaattgctctcatttgccactcactttttgctgttcaagtttcaactcactttttgtcctatacttcaatttcaaaagtgaatttgcggcttaggaaaaaccttttccttgttcattgaggaatgagactgtgttaggctgtcacgagcctcctttgccacaacaaaaactctgttccatcagtgctttcatatgctgccgtaattgatcaaagtatgccattttatttgacacatgtggttttgcagacctaggtcatcataaagagtcatgacctgtctgaagttaaaacttcaaagagagttgtgggctgatgtcaatatcacttcattgatgctgatcaaagtctccttgaagctgaaagacaagatgcgttaaataattccaccttcatgaactaaagcagagggagagaatgagagggcgtttgtaataaaatgttttaaacgacaggtgtgttaaaacagcttggtgtggcctcagatagggattgtgtactgatcttgctcttctttgtgtggaatgcacatgtgcctcagtagtgctatggcgcaaggcagaagcactcagaagttgcattatctatatctttcatggatcagtaaagctggcatttctcctgcctcttgctgacatacacactgttcaggacctcattcgctcccacatcctcctcttcccctctcccagctctctttgagaaaccactgttgggagatggctctgagtgagaactgcccacccaacccagcacaggccccctctgtccatctgcccagcccaccttagccacagtgagcattcatcctttgcacatctaatgcacacagccaatcccaggcatcttccttccccttgtatgagtctgacaactgacccggtgatactctactctgccatggaaaaaaaatggcaggggagaatgagaacacctagtgggctggaatgtgcccggcttttctgttccgtctacagcagatacaggcagtgtccccgtagccctggggaggccaccttgagtgcctcactacttcttacatcctcactttccccttggtgcccgggcatcacctctgtatattctctctcccctaggagggtgcaggagagtagaggagtccagcccttccaggccatgccccagcagagtcaacatgcctcacctttggatagtgttctagtgtctgtgaggcacaaggcctgctcaccccagaggccaaggctgcctaccctgggaaagtagacatgccgcaggtcaaggactgtctcaagaccagttaggacagcttctcagcatcatctcaagctcaagccctggaaatctcaggctttgcaatagcaaaacacaaatctgttaacttactcctcccaagacaattactgggaaaaaatattttgtaaatattcaaaggcttctgtgaacagcctgaggccagatgaccctgaaggcggaaggcagcaagccagacaggagccaggagccttgcctgtgtgcacgccctctctgggtgtctgtagagccataagcctgggtgggtgtcctgatgccaccaccagggcaaagctctcagtaagaggacacagccaagaggaggagcaagccttccaaatcagtttgtctcctatgtttaattaaaaatagcctggtccaggatctgcctgcagccaacagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgttgccaggactggccagggctgcttggtggagcacaggaagagaggggatcgcctgcagaacctgtcctcttgaagagcctcaaggaagtgaggcctttgcagaaactgcttgttccaaagcaaagggcactctctgtttcctctgggttgctctctatttcctcctggtaccagctctctttttatactgcttttattgtgaaatataaaacaaacacataagagtgcataactaaataggtacaacttaatgaatgattatcaagcaaacacaacccagtcaagaaatgaaatgcacccagcattgcaggagaccactccgccctcacacactcatacccatctgtacagctggcctcctgggaggcaccacctcctgaactcttgtgttcatcacgcccttgctttttttgttatttttcatttgtttgtttttttagttttaccacctaggtgtacatcactagataaaacaggtggcttttgtctgtttggggactttgtgtatatggtagcatggagtgagttttatgtttgtgagactcatctgtgctttgtatagctaccatttgctcattttattgctttagaatacagtattgtgtgaattcctacaatttacttgctctgtggtcacttacgttgtgtgcagtttttgataagcacagatgaagctgctataagtagccttggggtgcatagtgcacacatttcatacacctaggggtggaattgctcattcacgaggtctgtgaatgaataagttcagtttcaggagactgttccaaattgttttccaaagtgggtgagcccatttatgctcccacaagcaacgtaggaggggccttgctgctccccactctcagtagcacttagaatgatctttctaacttccaccagtctgaagagcgtggaatggtacttccctggggtcttcattcatgtttgccagatgcctaatgaggttgatggcatcatctctcagggaaacctgtgcttgtctgtctcagtttttaacaagaaaatgtcaatcaagacatagggtaagatggagtacagcagattggacatggattcagaaaccagagttcagatcccatttattactactatctttttttctggagagatggcgtctcactctgttgcccaggctggagtgccatggtgcagtcttggctcactgcagctttcacctcctgggctcaagtaatcctcctgccttggcctcccaaagtgctaggattacagatgtgtgccactgcacctggttcagatcccatgtattatctccatgaccttgaggtcacagacgtaaaagattaaattataggaaatactttggagtgacatattgtcaccattctttcaaggccaacttttataggcatatgcatccactcttactgctgtagtatttggatagctctctataccctcaaactataagccactgatatgtatagaataaacataaatagtctcactttataagatactttccctataaaacagactcagttctctctttatatgaaaagattaccatgtggttttttgttgtgttgtgttgtgttgtatttaacagtcaccaactgctggctgtagtcggccatgtggctgtgaaaagggagctcacaccttgggcgctggcaactcggttggtttgggaggaagaggttgttctcacagtggggaggtttcagcacagccacctgctgaggccacagagaacctagatatgtgtcctgtaccctggccagctgccctgagctgtggggtgctgtgcatggccaagcaccgctagaaaagacacttattctgaatttcactcctcccatgccatcgttcagctttcaagtcttgggttagctttttgagataagtctccatggcaagggacaggaaagcatggccatgtccagttctgaaggccatctcaactctccctgtggtcgtgtatctgacttcttgcaaccaggaggaggcatcagaaatttccccagtacccagacgtcccaaggcagttgggcacacttgaactctgccccaagtacagtgcatttgggcacgtggcttaacaattttggacctcagcttcctcattttagaaaatgcaggggccaaagaggcttcctgggacttcatgactcaccctcagaacctaagatctcatgaaccaaagggctgcagctgtggagaggggagaatggggcagtgtgtgtgactacgaagctaaactgggggattcgcacccatttcgtgccttttcagcctccactgggacctcgaactccccaagtcccacaggtcttccaggggatctctcacctccccatgagtcataagccttacgtggcatgcactgcagtgggggtgttgttccctgcctggcatcagactcctgtgtttctgttcaccaggacccagggcagggggttgttctgagggtcgcccagcattaccatgaagacagagccttggctgctcagcacggccagcacagctctggtttcacctctgtctcttcaccccacagtggatgtcattttcttctcctgggggtgttacccgacaatatcatcatttgaaactgtttgaagtccagccctgcctccctttcctgcattgggagcttggaagtccagccctgcctccctttcctgcagtgggagagtggaagtccagccctgcctccctttcctgcagtgggagcatgggagggactgaggaaggcccgggggatggaggcttccataaccctccatctctggtccagaagatggctggttaaaatgcccaccaaacacccccacccacactccaagctaggtggtagagctgtccatcttggatctaacccaaatgcaggccctggtgaagaaaggtgagtccacagtgctccacagataatcagggcccgtggtgcccctgtgctcatcaccctgagaagcgtcactgctactgagcaccaggctctcctgaccactgcccagagctcctgggccctgctagagcttagccatggtccattcatcaccaacctgctagcatttccttgttgcaagcttgcccactggcatcatccctgagtggtaaactgggccttcctgggttgggtaaagcccttgaccctgaggctccaaactctgccctccagctgccttgccaggtgacaggccccagagagcggctgctgaccattcaggccagggtgcttcctcccagggtcccacctggagactggcgggcctggggatgatgcagttccatcctctcttctaggatccgagccagagacaacaacggctcctacgccctgtgcctgctgcacgaagggaaggtgctgcactatcgcatcgacaaagacaagacagggaagctctccatccccgagggaaagaagttcgacacgctctggcaggtacccagcctcctctccccaccttgtgggtagagtacagggcacgtggggctccttgtcccatggactcttagacatgagaggaactggaccacccactgcccacagtgtggtccccaggccagcagcagctctggagctcatgagaaacacacacctggaccacacctgggctcctgccccacctgcccatcagaccccactttcagcctccaggtggcttctgtgtttgagaagcactggtccagaggccgtcatgtgaggtgaacgaaggttccatggcttgttcagggccactcagccctcagtgccacaaggtgatgtaagtgcagggctgtgttcagagtttaacaagacactctctttggagatctagaaaatatttcttcctaggatattctaactagagcccagaacagcctttcagacaaagacacacaaaataaaggaatggatgcctggggaaggaggcctaggaacagccaagcaggactttgttggtggtgtgagaggctgaattagacagcaaatgtcaggtgccctcctcattgtaaatcgagtctctctctgtggaaactaaggcaatttaggaagcatactccctgggctccaggctgctgcttatgctgattgccacagccctggtctaaaaagtgcttattcctgacccagctactagaaaaccctgaaacaactcccaatttggaagttccttaggcactaatgagcactaaaataatgctcatcactgctttccctgaatcgcagtgagcacagattgcttgtcttaattttgcatcacagctacactggctgatgatgaaggaaataaccgtaacagtacttcgtgcatcatcttcgcagagcatcctataaactgtagtaggttcagaaacagggagaaagccaaccgactctgccaccaccccaccgccccagagcaccagctaccttgaacatgtgtgggtgaggggcataatcagggcgtgttccaatgtcctcacccaagcccagctggggccacacatgcagtcaatgttgaggaaaggactcaactcaaaatcctgtcttttcaaaaactgagactacagagccttagcccctttaaagcacttaaacttactacttccaaatgtgatttgctttctagtgctgtaattggaaaaaaaaaatactccttttttgaatgctggatatgatcatattaaaaaatgttagtcacaacatttacattgtcttttgattttgtggctcattgccatttgtcatcattaaccacaggcttctttcttttaacgatattgattcgaaagagtatttaacctttctacactcaaagccccaaagcacatcagggaggtgagtagggaatgtggccttctggaatgcaaaggcacctggagtcctctatgccagcttaatgctccaaggtcccaggccccatcacttataaacagccattcattcaccttctcctgaaagggcattttatgtgtgtggcgttctgtcaccatttcaaaggctgagcactcaccatagtgttaagcatctctaattattgagaatgtccttcccaagaatctttactatttgtattgattcccctggtagatcatagcattcatccctaattaaatattcctcattgtatattttctaggcactgtgtttaggaaactacgtcaaaaatgccagcaatacgttccaatttcccatgcatgatttcattgatttttcttgacagcgttctaaggtacttctgtaccctacccaactccagggccccagtgctatttcacggagagttggtgattgccataataccctatttcaatattctttactgtagaccagggatctgcaaacccacagaccaactctggctctcagcctgtttctgtgtagtccctgaagagaatggtttgtatgctgttaaaggtgttgttttggataaataaataaataaacaaaggacacagatacggtatgaggcccacaaaagcctaaaataccactttctggccctttacagaaaaaatttgctgcccctagcccaagaggggggatccctagctgtgggcccacttccccagccacccttgtggagtggacttaagcacataaaagcatttatgtgtcttggggccacttcgaaagcccaacagtcagtcagtagctctcagtcactatttgtctatttcctgaccttggtatttaccactttcttacttttttctctttcagctagtcgagcattattcttataaagcagatggtttgttaagagttcttactgtcccatgtcaaaaaatcggcacacagggtgagttcccaagacactggagtctcagtgtttgaggtatcagtgacaatcagcctcattttagacttagctgattgcagatttgggttggatgaggacttctttttacgggttgattaataatgatatcagagcactccgattttgtatatcgtgaatcaaaaaatagccagttgctttaactttaaaaaaattgtaatttatttgtcttcattgcatgcgggaaaaagtaaaagagggtcgaaagaagtacctgcagaaagcgtgctcacttctcaagcagcagcacatcctgatctcattgattgatctgcagtggggaggggaaggaagtggtttcctcagatagagcagtaattgtccatgctctctctaaccaggaaatgttaattttggaggccgtccacaacttccaggttcccatcctgcggtaagtgtcactaggaataccactgaatgagaagctgttgcatatttcacaaatgaaaagcatgttttagctaacaggagtagtaggcattgatattttgattgcgcttcaaaacatactccgtgatgagctgggattgctagtgagtgttaggcagaatcagcctcctattagtgataaactaaccacattttcttttctttttttcttttgctttttttttttggagatggagtgtctcactctgtcaccctgactggagtgcactggtgcaatcacggctcactgcaacctctgcctcccagcttcaagccattctcatgcctcagcctcccgagtagctgggattacaggtgcctgccatcacacccggctaatttttgtattttttagtagagacgaggttttgccattttggtcaggctggtctcaaattcctggcctcaagttatcctcctgcttcgacctcccaaagtgcttggattacaggcatgagccaccacactctgcctagccacattttcttaacttcttgtctagatgaaattctcttcatttttggagaatatacacaatgcgaatgaaacccaatattaaatcagaagtaggcctcttgcaatatttgagaaatgggaacatattttttagcttcatccttgagccgtctatgttaacacacgtaattcacaggacctcagctgtctcctccctccagcctgttaggaggtcaggtacagatttatgctctaagcaggaattattttcctgctcttttcttggggctacatatggccttttttttttttttttttttttttttttgagacggagtctcgctctgttgcccaggctggagtgcagtggcgcgatctcagctcactgcaagctccgcctcccgggttcacgccattctcctgcctcagcctcgcgagtagctgggactacaggcgcccgccacaacgcccggctaatttttttatatttttagtagagatggggtttcaccccgttagccaggatggtctcgatctcctaacctcgtgatctgcccgcctcggcctcccaaagtgctgggattacaggcgtgagccaccgtgcccggcccatatggactttttatgccctttaatgccatctgtgaagtgcgccctctgcacctcactttttgcctggtaacccttgaaaaacaaaatctgcagaaagccaaatatacatcctgcctccagtagggacaattggctgcccagtagctgagcccaggttgaaacaggggaggctgtccaggggcagcacttgttatcaaatgcagggaacgtgaatttgctaaaataccagtgacctttgggatcaaaatgtaatgcctttatggaagtgtgactttattttgccctttacagggctcacaggcctggcaactctatcttaatattataggctcggtgagacagatccatacacccttcagatggatgagggcttagggctgagaactcttaaaagaatgtcaagccctgtgcttagccatcatcacccaatgactacaagaagttagatattttggaataactttttaattgactggtaagatacatacgggaaaaaaaaggcatacgccctatgtgtacaactcaattaatttccacaaaattttccaccgtggaaccagcacccaccatgaagaagcaacacaactgagcactcagatctacttgtagtttctttcggtggtttgtcttgagcttacaacttaataattccacgtgaagcatgagctagtgaatgtaacagctctaattttgtagccttcagtggaacatatttcccaaatatatttctagatccttcttcccaagtggcaggcccttccagaagccttcccaatgatcaggtgttgcccgtggtcgatctcattggcagggacaggagggggttagtggtgcgattatagaagcaaatttaagtagcatgtcatggaagggatcctgtatttgttttctgaaacatttactgttcctctttgccgttgtggtttctagacttggtcagcgggtggaataatctcaagaatcaaatcatactccttcccaaagcctggccacagaaaggtgctaaagcaacccctgcttgctgtccaactaagtggtaggaccaacgcgcactcagctcccgcccgcccagtctgccctgtgtgtgcgctgccccccatctcttgccactctgcttccaggcctctttgcccttgctcacacctgctgttcctgggcagccgcgccccaggtacatcatgtgcttttcatgtgggtcctcagtccgtcagctggaagtccaacagtgtgagcatgctttctgtgctcaagcgtcattttaaagtcgtttcagttggcgtcatccgtcatagctaattatcatgtcggaaaatcttttcaaagatggcccacttactttttggtggccagactcacgtgttgcagtgttctggtaattgattatgtaagttacgttgtgatggagggaacaccaaggttttgtgaggcgcgctgcacagtgaggtcaggcagtgcatggtaacttcattatggcttagacgtctaacatagaactgcaaatgtgacatgtaaagaagaggtgtaatctgaggtctagaaaaaccagttttctttttgaggcagtaatgttgacatctcattgatttccatgttttgttctattattggattttgagggaaaataaaaataagttctttttcatgacttttatttataatgacttatttattccttcccccaaaatatgtatatataatgtgtttgaattgctttttttccattctacttttattatcagtggggtaaaattggttcttttatcagtaattctttttattttcatattacttggtgtttttaccgacattttagcatataattgagcatccactcatgaaatagattgcctaaagtatttactagaaacaacagaaataaaagacataaaacccttgagattttatttagtaataattttccaagtttactcatactcaagaagttctcaatcgtgttgaccatagaacagaaagatttaatgcagtgttcgagaggaagaaaaggtttattttacacttgaataaagtaactatgtctgtttttcatgtttacccaaggcaaaacacccccacagattactcacagtggctaaagaaatacctagaaaataagttttggtgcatctttagactacaggagaacatgtcagaaaaaagttgaagaaaatatcagtgaccacctaaaaataaagaagtatatgtgtagataacaaccataacatcatcaaaagagaaatgagaaactgggagtaagtagcactaatgctgacacatagattaatagctttagtatacaaagagattctaaaaataattaacaaaaatattaactgtctactaggataattggcagggaatatcagtagtagtttatagtaaagcaaatataaatagttcttaaacatatgaaatgttgtttaacttcatgagaagagaaatgcaagttaaaactatggtgcttaactgtgtccacctatgatccaaattttaaaagcttgataacactgtagtaaaggcatggtagataagcactttcactcttccttggggaagtctgaaatgatgcaatctgtaagaaaggctctgcaattttatttctaagtatgtacagatattcttgcatttgtgtgaaatcatgtacatgtgaaggtgttttttccaaaattgtataattgacaaagtctgataataatttaaatgcctatcaatggaaaacaaatgaaattggttacagtaaaattgctactatgggaggcagctgagatctagaattgttttcaaaatataattttaagtgtaaaagtcaatgtcctgcaacacacacatacacatacatatatgcagaatgtgttgatatcgtatacagtatcctagaaaaatacagaaaatgctggcaatgctggttgcctctggagtaagagatgggaatgttaagaaatcccacttttcattgtaaactctgttgtatctttttaaatttgaacctgttaagaaattttaatcaatttttttaaaacagaaaattaaatagtagagagtaattaatctgattaatattgtgaaaatacctttctggcaaaaaaaaaagtttgctttctatttaagtttagaagaactttaaagtatacattgaattttttatagaaataagaaactggaaataaatattactaatgatgacacatatataaggccaaaaatatcaacagataatttttaaaagatcaaggttgtaaggtttaagctatagattaaaaatattttaattgcttatcagaaatattttagagctaatatgtatattttcacaaacaaatggggaactttccattatgtaatcagtcatgagaaaagaattgtgagaattatgtcaaatgtcccatcatgttagctaagagataaataactttcttgaacttgttaatttgctcagtgtacatagttgttttaataattcaggcacaaaaaatacatgttagaacttgaactacctatagcatctagatagttaatgaaaagtatgtttagatttgaagatgattatgaatcagataatttaaatttttcataaaattactaacaggctgatgcattttaaacttgtctttagaaattagtagcttactgccaagcacagtggctcatgcctataatcccagcactttgggaggccgaggcaggtggatcacttgaggtcaggagttcaagactagcctggccaatatggtgaaaactcatctctattaaaaatacaaaaattagccaggcgtggtggcacacgcctataatcccagctactcaggaggctgaagcaggaaaatcacttaagcctgggaggtggagattgcagagatcgtgccattgccctccagcctgggagacagagcaagactctgtctcaaaaacaaaaaaagaaaagaaaagaaaagaaattagtaacatacttataaagtataaacaaaattaacttaagaatacaactagtagtctttaaatgaattaaacccctcccaatattagtcctggaatttctttctctgctgctttaagcacagaaccttatccttcttttatggaaaataggtggaaattaaacagcaacatctctaaaaagacttccagggaacttttcagctttgcatttcaaaggcacatcccctaagaggattaaactgaaatgtgtcccagaatttccaattaaaacccatttttcatgttttattccaacacatacattggtgattataatattttaaaacttacatttaagtacagggctcagtgggaagagaaaaaagaaagaaacatcctcaagttgtaccctgttgcttggtaatgccttagtagaccagacccttgagaaaatgtgttttcatataattataaaggaacagattttagatcttcactgtaagagaacagtaattgcagaggtcaagtgttattttcatggatctcagagcaaagctaatagtagcctattccccagccaacagtctgccctcgcctgtgggggtctactgaaccagggtaattccaccaaaaaaaggaaaccaaacctagtttattgcagccaatatttctaaagccagctggctcttttgtcactattattgtgatgactaatgactgtattgtcatctgcattactgctgttgcctaatttgaaaatggcccaagaatctgggagtaaaaattaagatctagtaaatggatgttaggacacttggcaatactctggaatcaggaaactctgaatggacctatcagttccacagaccaataattttttcctcttttgttcacttttggatcaccagcttttaaacataggcactcaaagaatgcttgtcaaatacattttctattcgcagttaaaccttaccaataggaaatcagggataataatttataactggacttattattgcagagtgatatccttacctgaatttataaaatttaaagaaaagtcaccagttgttcttttggaaggtagaaagcgaaggtggctaatgccatctagcggtggactgaaggtttgagcctgttctgagtattagcaaaaatgaagaaagtggaatggtcaacatttcatttacaccttgttgctcactgtgcagaacagatgacacttattgattgggacagaatggctctctcaaatgcaaacataaagaataaaaggttaatagtaatgtagaccggaaatatattttttattaaaattaaatgtcattacattttttaagaatagtatttttacaatttatcattatgccactgtgctcattctttacaaactcctcaaatttttctttttaactgagcattttcttttagagattgttttggttattgttctactaagtggcatattcaccaagtgctttgggaaagatgaagcatggattttgcatcttcatctttatcataaagtaactactgttcttttaactgactcaataggaaacctcccatttcttccacattcttccagttgtggcatcattctttgctccagtcctgttagtcaccagaaagagataggggcagggagcccagggatctgggtaggagagagttgatgtggggttgttgagagacatgagggttctttgtggcttggcttaaaaggcttataatcacatagtggtctgtgttgggcagcatggaaatgaagccccaagctttattggctataaacgtggagttctaatttccgaggaagatctcccatctgtttccctatccataagccaagatagactaggggtgaacaacacactgctagtgagagtataaattatttgtgcccaggggtttagattctctgtgtccatcgctactaattcttactcattcctgacaccctagtatccctttcagcatattttgacaaccccatctctgttttaaaattcttccctgcaggattcatatgtcagggaattgcgttctggtttaattggaacaagccatttggaagtcctcctggtctggagaacattctgtgaggtagagaggctgcaaccccaggataatgtcctcagtgggagggacaggaggtcttatgtcaagaagaggtgatggtccctctcctcaccagtgatggctagtccgaggacatcctttaattccacatctgttcaagttttgtctttggatctcagaatgtgcctgcctgcagggaaaatcaaaggagttgaaatgacagtaaatattaaccttgaaagagactttaaaaaaaataaaactattttcagcctagaattggttgcgggagaaaactgggcaaaagaggaggacagaaagcctaggggatcacccagtttctgtcaggacagttttccagaggcaggataattatattataaatcagaagtgaaaccacagcacagtcctgtaatcatatgtaaatgtttaaaagaaatagattgtcatttggaattattcattcttatttctcttcatcagcataaaggcttgagagagagctaatttttaaagcacattagattatacttcacatctcctagtttttagaagtgattttcattcattcacccatccattcattcatgtgtttgttcaacacatttttattgagcgtccttgtggacgtggcacagttccgagtgcagtgaataaatgtctccccctccttgagcttatattctatttttatttttgatgtgtcatagttacttctgttaatcagttcagtagaagtgctgagatactctgtgacaaaacagatcccatcgacatcatttttacaaataagaccagatgtcctttagccttgtcaacaggcttgggccatggtgaacaatgtctgcctctgaagtgctcagcagaccgtgtgaaagaagaaggtccgggtgtttggaaacaatggctgagtggcggtagtggtgcattgtgacctcattattctgcttttggtttctcgccttgtaatatgaataaggcacatgaggatttagtgtgtgtcataagataagtgactgtcacgttaagcttaatgtctctgtttctgtaactttctccataatctggcagtatctcatttcttcgtggccagtgtttgggcactgaaaaggtcaatcaatacatagaattgtgactcaactcacgctgaaaaaaaaaaaaaagcatctgaatcatggttctcctgtgaattaaatttagtagcaagaatcttgttttaatttggaagaaagggtgggtcaggaaaactcaagatagagactttcaaaagggaaagtccttaggataatgagtagatttccccccccagttgtttcatgatataaactgatgtggaccaaataaatacctgtctcacaggggtactgatttccagcattagctgtggcagctggagcattgctggcctaggtggcagcaactggccttcccttgggacctgtagttactgaccagtgccaccctctgccatccaccccaatgctgctgcatctccaccgaagataaagacttgggtggagacttggaaaacatatgtgcgttggagttgggaagtaggtaggagcagctgatgagtactaattttcctctttaaataatgtccatgtaatatgaaattgaagagcacaagttaaagaaggaaaatgcttccaaggcgaacatgcaaatcatcagcgatctttggtaggtgggaataggatgtgcaagggggtgagtggggaagcagctctatccaggccagtagagttgactctcaccacaccctctgaacacctcacagagtcccttgagttgtagcagcacaagcttgctttagcccttgcaagatccaaataattgcccgaagaatgagatcagccttattttcttccctgtttttcgtaattctttcctttgtctttcctgcaaaagttaaactgtgattattggaaaataaaaataattatgcagatcaacttaacagttttgtggatgaagaaaaacaacctgttgtcctttatgtactttagtcctcccctgcccaagggaaccggcaagagagtactgtgtcattcaatccgtatgagccagaacttgcaccctgggctgcagacaaaggtgagacttcctttcattcaagggacattcacagagcaaagtgcgtggtcacttgtaagtttgtagagttggttcacgaatccacaccacgtccgtgattgcaatacagccacagttagccatggaaacactcacatctagtggcaggcagcaggcaccacatgcccatgagcagtgatggtgctattgaatgaaatggtctttcccacctccctcacccaacgacgttggaaatgtccctgccactcttcagaatttctcatcccttgcaacattgatgctactctgagttcatattcccatgaagatcatgttcttggaaggatgaatcctggtgtggggtccagccccaggtcgtatgtttcttgactgcattgcaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaagtaagttgctatgttccaccagcctcaccctcacatgagctcaggttctagacatgactgagaataacaaaatgtaacctggcatgactaaaccctttttttattaatgctaccattcttgttaatttctggtactattataatgaaagcgtccattacctttaatggcaaaaactgcaattacttttgcaccaacctaatagtacatgcaccttatggaaaattaggaaatagaaacaagcagaaacataagaaaataaaaacatcaaattggcatggtggctcatgcctgtaatcttagcaatttgggaggctgggataggaggattgtttgaggcctggagcttgagaccagcctgggcaacatagcaagaccctgtctctacaaaaaaaataaataaataaataaataaataaaacataaaaaattagccagacatagtagtgcacacatatacttccagctgctcaagaggccaagaagccaaggctgcagtgagccatgattgcaccactgcactctagcctgggtaacaaagcaaggccctgtttcaaaaaacaaaacaaaaaaaagaaaagaagaacatcatatttgtataataccatcccaacactactactgttaactaaacattactactgttaacttaatcttattgtatatatttttagatctttatttgtacacacagatattatttaattaaaacaaaatcattccattataacaatagtttttacatttattttctttaattttatagttacatctcatttttcttacatgaaaattattgattccaaatatgattagtataattatttattggctttatcctatgatttcagataacaatacatattatacaacagttaaaattgctaaatttcgaaaatatctttgtatttcttttggtctttagaaggtacccaacatagaatgtacaagtaaaactactggtttctaaagtcctttgaaatacaccctctgtttgaattggtatgatactaatatgaatgtggttagatttagtagcttcatggtatttcaaatgtaagggatttttgtaaaaaaaaaattcgtgagtaggtaatttttatgattcaagggttaaaaatatagacaaaaatatacacagacatgcgtgctttccggccgggtgccgtggctcatgcctataatcccagcactttgggaggccaaggtaggtggatcacctgaggtctggagttcaagaccatcctggccaacatggtaaaacctcgtctccactaaaaatacaaaaaattagctgggtgtggtggcatacacctgtagtcccaactacttaggaggctgaggcaggagaatcacttgaacctgggaggaagaggttgcagccagccaagatcacaccattgcactccagcctgggcaacaagagtgaaactctgcctcaaaaaaaaaaaaaaaaaaagaaagaaagaaaaaagaaatgcttgctttccaatctgtcccttcgatttgtttttgtgcatgtgtgtgtgtgtaaattagatacacatacatgtatgtatacacacacaaacatacacacatatgtatacattcacaagtatatacatgcgcacatatatacacacacaatcaaaattggctgtgatacttattttaaaatatatgtttgtatatcacagtcattttgtacaatgagtaaaaatgtttctgtattaatcctaagctttttcagattatgaaaggttgtgatctttattctgtgcttaaatttgtgaattaacatagacatgactgtggacataatttcaactagagaatttggggagaggagaggctctctcggtcaatttggggcaaaatgatgtctttacaatactgagtctttcaatctataaacacagcccatctctccatttaccaggtcttcttcagcctctctcaggagagttgtttaccttttcaatgtattacattgaaatatatgcttttaaattctgcacctagaaattcactttcaacaattatgaaaggcattttatattcacattcattacatgtaatctgagatggtgaatcccaagatgttacaggaattcgtacatgtcatcgttggtgaagtttatttacaagttatttaaatattttacagtttagggtttttgcttggttgggacattcttcagtactgttcttcaccattctttttattttatattattttttagaaacagtgtttcactgtgtcacccaggctggagtgaagtggcaagaagctcactgcagccttgaactcctgagtccaagtgattctcccacctcagcctcccgagcagctgggactacaggcttgcactgtcacgcctgggtgattttttttagagatgggggtctcactatgttgcccaggctgaccttgaacttctgacctcaagcaatcctcccctttcaacctcccaaagtatggggattgtcagcatgagccaccatgcccagcccccaccattcttttttagtaatggagtattactctcattgtctataaaataagggaatataggttggaaggccagccatccattacaggcttctgaagacacattgccactctgtggcaggtatttccgtgggactgtttccacagggggattatgcttcacaggataagattatctagaagtgaggcattttggaaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacagaatgatggccaccgaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggcattgagtcctgaagagctatatgctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggtaagtacaacttagctaatattcagagcagcaggtggtaaaaaatgcaagataaatgtacgttttctttattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcaggaatcgaggtattaagtgaagatttgttttgaaaaaagaagaatgggattccttcattaagttaatttgaaaagtttgcattggacagcttgattcttgcaggatttccccgaagcccttttcatgctacttaacattacgaatctcagtagagggtttactgcactgcatttctcaaaccagattcatccatggcatccttttctgataggacatttcataacatgtggtggaacactgtcccacagcatggagctattggagcttggagctccagtactgcagttcagagctccaatattgcagcttggagctattccaaaataactttctaatgaacacctacctatacatgcaaaagttagaaagtgaagatttaccaaataaactcgtcatctgtgtatgtccactacatatgtagaaattgttctattggcttaactggtatccagaagagttgaagtgtcaaaaaatagatgcagtgctggaaagaagagatctagatagttatgtgactgaagctaaaagaaatatgccccttggtttggtgaggcagagattatcaagaattaagggtggacttccagcaaaacataaagtagaaactagttctgggtgcaggtttggacttcctaaaaaataatttcacagtgaccaatccccttgctaatataacttgacccctctctgaaccctcaaatgaaccaataacaactaaaagaagaaaagataagaaagctctatcttcatattaactcatctgtggtgtatacctagggtctatgttaaccaactggaaaacgtgatggcaccaatcccactgagtcaaagagggtgccgaaggcaggttaacaaccctgctagtctctggtgaagtccacatgctcagaaatagatggcagaccttcaaaatctacctagtgggtggcagataggatcctgtgtttcatgccctgcagtggtcagagaccccaccctgagtgacaatacccacccactcacctttccctaagaggcagtccatggactggtaggtgatggggaatggtggacctcggccagcaaagggactgcatgaagggtaagccacaagagccaagctcccaggcaggcaggcagactccaccatcttgagcacaaaggccaggcgagagtacagcaggggtcaggctggccctcctcaccccattcttcatacagtagcttcccagaaggaagccccttcagaggtgaaccactgtgagaaaggcatcagcatgggcctggatagaaatagcagggaaacagagcaaggaagacagcagcctaggatgaccagcatgggacatgctggagaaagaagcctgttgtaatgctggatgtacctcatcatgatcattacagaaaagaagacagcctgtctgaaacaaggacacagaggagatagagaaaatgaaacatgaatgctgggcaccttatccactgctgtataacaaatcaccccaaacttactgccaaaaacaccaccaggtgttggtttccctgccgtcctgctgtgtgggcagggccaggtaggcagggttcagtgcgtctgctcacacaggggattgcacagtggcccgagggacaggaggaccgtttccactctgctcactcacactactcagccactgagcagctggttagacacagcccatgctggagacctctgcggggctgtcagccagctcacctgcacatggcctctccttggggcccttgggcttcccttgggcccatgcttcccttgggcagcatggcagctgcgggctgagagcagttacccaagaggcaggaagtgggggctgccaggcctataaaaccaggcccagaaactacctcagggtcacttccacctgatcctattggtcagagcagccaaggccaccagcttcaaaggatgggatagatagaaccacccttttgaggagaagtgtcaaagagtcaaagaacatggggccaattctaaaactgctgtagatattaaacagcataccattaaaaagtaaactaaactaaaaagtaaaccaaagattgtctttggacaatcaatgaagaaaaaaagccactagggaaataaaagccatcttggaagcagcaaaaagagacaaaactaccgaaaagatagggtagtggaagatttctgtatgaaaacaaagcaaagtgaaatggaaaagaataaaaagtgggccgggcgtggtggctcacgcctgtaatcccagcactttgggaggctgaggtgggtggattacctgaggtcaggagttcgagaccagcctggccaacatggtgaaatcccgtctctactaaaaacacaaaaattagccaggcatggtggcaggcacctgtaatcccagctactctggtggctgaggcaggagaattgcttgagcccgggaggtggaggttgcagtgagctgagatcgtgccactgcactctagcctggccaacagagcaagactctgtctcaaaaaaaaaaaaggaataaaaagtgaaacaagatcaaagaaaagtgctagctgtggaagcaaacgaacgctggcactcgggaaaccatgcgtgacagggtagatttgtgcagcatcacaactgaaaaacacaggtgttctttgatccagcagctccttccgagagcaaacacacacatctggtaatgtgcactctagcacgggctgccacggcaaaaatctggaaactgcctgacgactgctccgcagggtttggtccaatcagtcatagcagattcacaggaagctcacaatgcaacccttttaaaagtgacttatttgcatgtgctgacctagaaatatgtctactatacatggttaggtagaaaaattaaaaagtacagtgctcaaagaatatgcccctagttttatgaccagaaaaaagtatacactacctatttatgcatgtatctaggttattctgaagacagcctaaatttcattgcatttaagatttgtcaaaggtttacttttttcatcagttcaaaattcagaagaaacctgaaataacacacatggttgtattgttcatgacttgtaagatcaaaattttaaaatagcacacaaggtgatggaaacagaagtataatcagttgtatcatttggaagagaagtgccagggcaccttatggtctccagattgatgtcctgaatgtctccttgtgatccactgtagtgtcatgaaatcagttttcactgaaatcatgtccccctctccaccccaatgagacctcacacaggtgacatcagcagaagataaccagactccgctgtgtgccccctgaatcccaaacccagagagagggttttgctatgcagttttgacctctgtactatcacttgctttttaaaattaggaaattagaatgcttagatcattttttaatgatgctagcaagtagtgcatgctaaaataattgacctgggtggagaactgatcaagatggacgactaaatgcaactagtatatgctcctccgtagagacggaccaaaataacaagtacatattcacacttccaatagatggtctaagagagaacacagatgcaaccaaggagcgacaggaagcaccaaaagcaaagcacagggaaacaaggcagcctgcttggccaggaatgactgggagctgggagaagcttccagatatggggaaagcataaatgagagatccccagggctccacattccagccaaggacttctacaatcctagcgacagaagaacccctcgacccacgtgggccttaagactaacatagggagctgcctagggatcacacagaggcattgctccatagagggaactcacgctgagtcccacaggcttccaagctctgagtagctgcagcttggtgccatactgagaaccaagtccccaaaggactgcatcttgccctgggactattgctgatgctgccatcaccaggccaaggacagaggggagaatggacaccttcacacaccccagggacagatccccctgctgctacaggctgctgtggggctgagacacaagcaaatcacaccccctatagctgcctgcctacactgctccccctgagaatgtccgcagcctccccaggagcaggcccatagccagcgccattctgagagccaagcctccaaaggtctgtgtccttccttgggccagggctgatgctgccactgccccgccacatagggagaagggaggccaggcactttcacatgccacaaaaacaaataccaccaccactgctgagggctgctgtgggaccaaggctcaagaagactgcatatcccacagctacctgcctactctgcacctattgagagtggccctaccctttctggtggtaggccttcagggcagccactgctggcaacctagagaccacccctccctgcgtatcacagccagcagctgaatgcaccaccagggagcctgagcacaagtccattggcctagtcacatgccccaatacttgagcatgacatcctgttgcagccaccgccaacaccaacatggaccacttgggttccagtgagttgccctaccaccattactgccatcacccacatcacacccactccccaggaacccaagaacctgcccacatgcccagccactgcagcatccacacaatctacctgaaagcccaagggtcagccttcttagacctactaacaccagtgctagtgtataccgccctagggcccaaggacaggcatactcagctcactgctgtcaccactggggtctgaagactggcccacctagcatcctattcacagtacaccttcacaacagcctccactaataaccataccctaaggcactgagaaaatcacaggtgtcactgaggctgtttatggccatagaaattatacatagattaaatactgcattcaccccaaatcaaacccaaagtgccctacatatatatatgtgtgtgtgtatatatacacacatacacatacgtgtatatatacacacatacacatacgtgtatatatacacgcatatacacatacacatacgtgtatatatacacatacacatacacatacgtgtatatatacacacatatacacatacgtgtatatatacacacatatacacatacacatacgtgtatatatacacacatacacatacgtgtatacatacatacacacatacgtgtatatatgcatacatacacatatgtgtatatatacatacatatacacatatgtgtgtacatatacatacacatacacatatgtgtgtacatatacatacacacacatacacatatgtgtacatgtacatacatacacatacacatatgtgtacatgtacatacatacacatacacatatgtgtacatgtacatacatacacatacacatatgtgtacatgtacatatatacacatatacacatatgtgtacatgtacatatatacacatatacacatatgtgtacatgtacatatatacacatatacacatatgtgtacatgtacatatacacatatacacatatgtgtacatgtacatatacacatatacacatatgtgtacatgcacatatacacatgtgtacatgcacatatacacatatgtgtacatacacatatacacatatgtgtgtatatacatatacacacatatgtgtgtatatacatatatacatatatacatatatatacatatgcacatatgtgtatatatacatatatatacatatgcacatatgtgtatatatatacacacatatatgtgtatatatatatatacccaacatatatatacccaacaacatatatatattttcaggaaaaagacctcctctacaaaagcaatttcaaaaaactggaagaaatgactgttgtaccacatgggcagatatcaatgtaagaacacaggaaacatgaaaaagcaaggaaatatgatacctccaaaggaacacacaattctccagcaaaaaaatcccaatcaaaaagaaattcacaaaaccccagatgaacaattcaaaatattgattttaaagaagctaaataagatataagagaattctgaaaaacaatagagagaattcagaaaaacagttcaggatatgaatgagaaatttatcaaagaaatagatatttttaaaagaaccaaacagaaattctggaactaaagattcattgaatgcaataaaaaatacatcccaaactccaccaatagactagatcaggcaaaagaaagaatctcagaacttgaagacaggtcttttgaaacaacctattcagacaaaaataaagagaaaagaataaaaaagaatgagcaaacccttcatgatatatggggcagtgtaaagcaactgaatattcaaatcatcagtgtccccaagggtgaagagagaatgaaagattagaaatcctatttaatgaaatattagatcaaaacttcccaaatataacaacaaacctagacatccagatgcaggaggcccaaaggtccccaaacagatacaatgcaaaatcatcttctccacagcacgttataatcaaaccacttaaagtcaaagcaaaagcaaatatactaaaaagagcaaaagaaaatcttctaattacccataaaggaaccaccattagactaacagtggatttctcagcagacaccttacaggccaggagagaaggggatgacattttcaaagtgctgaaagaaaaatactgccacccaaggagaccatgtccagcaaaactattcttcataaataaaagaaaaataaagcctttcccaggtaagcaaacactgagggaattcatcaccactagactgatcctagaagaaatactcaaaggaatcttaaacgtggaagtaaaaggacaatatttaccatcataaaaacacacaaaagtataaaactcactggtaaaccaaacatacaaataatcctgttaaatagtgggctaagaacatagatagacatttctcaaaagaagatatacaaatggccaacaggtatatgaaaaaatgctcaatatcaccaaacagcagggaaatgcaaattacaaacacaatgagataccatcttaccccggctagaatggctgttattaaaaagactttttttaaaaaaatgctttgcagatgcaggaaaaaaaggaactcttatacactgtttgtgggaatgtaaattagtatagtcactacggaaaatattagagagacttctcaaaacaaaaacaggctgggcacggtggctcacacctgtaatcccagcagttttggaagcccgaggcgggcagatcacaaggtcaggagatcaagaccatcctggctaacacggtgaaaccctgtctctactaaaaatacaaaaaattggccaggcctggtgacaggtgcctgtcatcccagctacctgggaggctgaggcagaagaatggcatgaacccaggaggcggagcttgcagtgagctgaaatcacactactgcacactccagcctgggcgatagagtgagactccatctcaaaaacaaaaagaagaaaaaaaaactaactacacatagaattaccatatgatccagcaagtctactattgggtatttatccagaggcaaataaacttgtatcaaagggacacatacactcaacgtgcttatcatagaactattcacaatagcaaagatgtggaatcaacctaactgtccatggatggatgaatggataaagaaaatgtggtgtgtatatatatatatacacctctagaggtgttcactggttacttagggtacaccctatgtaaatgaagaggctaaagtgaagttacaaagttatttacttggtgtacaccctatgtaaatgaggaggatgaagtaatgttacaaagtcatttactgagtgtacaccctgtgtaaatgaagaggatatttcctgtcatagctgaagtgtttccatttgatttagttctaggaagtccttaggttccctgcctccaggccctattctcctgtctcaatttcactcagcataatgtcctctaggctcatgcatattgtagtgaattcccttccttttgaaggctgaatgctattccattgtctatatagagggtgttttgtttatccactcatctgctgaaggacacttgggttgctttcatgttttagctattgggaataatgctgctatgaacatgaatgtacacaattttatgcttttctttctttctttttttttttttttttgagatggagtctctcgttgtgtcacccaggctgcagtgcagtggtgtgatctgagatcactgcaacctctgccttctgggttcaagcaattctcctgcctcagcctcccaagtagctggaattacaggcacccgccaccacacctggctaatttttgtatttttaatagagatggggtttcctcttggccaggctggtctcaagctcccgatctcaagtgatctgctctcctcagcctcccaaagtgctgggattacaggcatgaaccaatgtgcccggcccacaattttattcttaatggaatttctccctctgctttgcttttaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagtgagccagtcctgcttcattttctcactgtggggccattagaacagataagcaccagattgtctttacaacaacctgaaaatcctaatctgagtctctcattatcttttaccagtaagcagttaatgtgccctcagtctattccaaactgagaatgaaatatctgatgctcactgaagagtgtgtttttcccattgtgtgtcaacacatgtaaatatacacaaaatataacccagatcattactcattagagttgaaatagaaataatgactatttacagtatcttaattacattttttagatcttttaattaaaacatatataccaaaaagggcacaactcttagcatgcagtacagtggttttccacaaatgaaacatacccatgaaatcagcccccagatgaagaacagaaccccagaagcctgtttcctctgcacacacagccttccccaggggtgacccaactgactccaacatcacagattaagtgctcctgtttttatacttcgtataattgaaatcatacaatgtgtactccttcatgtcttggagtggctgttttgttttgtttgactaacacctttaaaaaaaaaaaagcttatgcatatcttgcatgttgtaggggatgaaaggaagtgaagtcaccgctatgttagagaaaggagagcggatggggtgccctgcagggtgtccaagagagatgtacgatctcatgaatctgtgctggacatacgagtgagtacctgacactgactgtgatgtattcagatgctctggaaacaggtgaaatggttgggcgtctaaaaaaaaggataaagttcaccttttcatgaatcaggaatgtgcccgctttctaaacaaacaacggtgggggctggtcttgctttagagaccttgctttctggcccatgcacttacatgtagtagagcctaaagagcaagtttagatggggactctaacccgagtgtccaaatttaaatgtcgataatggtggagagatggggcaagggcagtcaaagtaaaaaagtgtttgtaagagtttggggctggatgccatttttggcatagaggatggcagaagcactcggtaggggatggtatactttcctgactccctgattaccatgagcagtgaggggtgacctcggactctggccagctcacagatacattggctaaggttgcacttccctagaatctacctcatccttgaagtggtggcctcagtccaccctgactgccgtcatacgtctcgcttagtggatcccaggtgctgttatgcttttaaagtacacctggcattattcttaggtgatgttcagggcagctcagcaaggaaggaaaatgcattgccactgaaaattaggagtacagttttgccaggctcagcagcctgcttgtgcgtgcatagcacggtgaccccaagccgccatctccagttccctggtactgaactgtgcacacagagcccacacagctgagaatcgatgtggtttgtgatcaggaggacatcacaaatcctggccatggatttgatgctttgcggaatcaggtttgccttcagatacagctgacattgccagagcctctgaaagatgagggctattccaaatgctgcagatgccacctgggattccgagacctcccctccccaccctgggagtatcactctaccacaattgtgagtgacagggaaataatctcattctgtatctagaaaccacccagggggcagccacaaaggcagcaggcaaactgtgggtatatgcttccctgcccctgctgctgccgtggctcaggagaggagcctggcctgggccccggagcatcttctccaaccccaagtgttagtgcaacagggagagctaagtgtcagcaagagggaagtgctactcatggatctaagaggatgtttattcctaagtcttggcttaattctcccagtgcctaaactagaatcgtaagaaccattggcaggtaggcactggcagcactggaccctggggagggcagcccttgggcacgtggcagcctatgaccctttactgaaagtgttctttggtccagcctgcagctccctttgcaaggcttcccttcttgtagaagggtga

SEQ ID NO: 1245 - DNA, 2541 bp, Homo sapiens
gaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaaaaaaaaa

SEQ ID NO: 1246 - DNA, 1839 bp, Homo sapiens
atggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaa

SEQ ID NO: 1247 - DNA, 50396 bp, Mus musculus
  misc_feature (2660)..(2731): "n" at positions 2660 thru 2731 can be any base
  misc_feature (46151)..(46186): "n" at positions 46151 thru 46186 can be any base
aagagggcactagatctcattatagatggttgtaagccaccatgtggttgctgggaattgaactcaggacctccggaagaacggacagtgctcttaacctctgagccatctctccaagccctttgttttttgtttttgtttttgtttttttaatttctgatattagaaatttcttttattttttaattagatattttcttcatttacatttcaaatgctatcctgaaagtcctctataccctccccgcccccaccctgctccccaacccacccactcctgcttcctggctctggcattcccctcctttgtttgttttttgagtcagggtttctctgagtctctgtagaccaggctggcctggaagagacaaagagatctcactgagatttttatacacactcagagaaagagacagagacacaggggtgagggtggctggtattaaaggtgctggccaccactgtccaactaggatgtgttcttaaaacattctaggtactggttgtttataaggcttgaggcagaattgcttgaagatgggagatagaccagcaagaaggccatgaggcctaaagggtgttttgggggtggggtggggcaggggagagggttggttgttttatatcaaggcccttccattcctaattagcaaggcttcatttaggtcccagatagcttctagacttggaaaaaaagttttttttgtttttgtttgttcgttcgttttttttttttttaaagcaacaagggctctttttttttttttaaagatttattaattatatgtaagtacactgtagctgtcctcagagactccagaagagggcgccagatctcattacggatggttgtgagccaccatgtgtttgccgggatttgaactcaggacctttggaagagcagtcagtgctcttacccactgagtcatctcaccagccgttcgttttgttttttttaccacttggactactgacctaggtgggatttgccgctggggttaagggagtaggatgaggtctataaagaactgagagtaataagtgctcctgaggcagcagagccactttgtttctaacgcttggggtctgaacattgaaatcaccgtttatgtgtggtttcacagattcagctctttaaatggacatgatacttagctttgaatcctctccattcttgggctggtgagcaggaagccggccttttcactatagctcactctgccccatagcaggtacttcagtcagtgtgggggagggaaggaaattgtttgtagaggagaattttaaaaataaggcattgctgaatttttaaaaagaagcattacctttctcaggactcagccctgacaattagctccattaacacacaaatacctgtctccactgcaaaagggtagaaaaacttcccatgctatttggtgaaaattgagttgtgcccagaaacgatatctttgtttctaagcacaagttgtacttacagttccttccctttggagagggcatgctgccactttcatctgacttcaggtgagtttccagaggatcatacctagaacagtgtttaagagtttcgaagaagccaggtgtggtggcgcacgcctttaatcccagcactcgggaggcagaggcaggtggatttcagagtttgcggccagcctgatctacaaagtgagttccaggacagccagggctatcagagaaaccctgtctcggaaaaaaaaagagttacgttgttgctgataggtacatatgccatgtacataaaactttctttcacccacttttcgagtcatgctgatacctggccatggccttcatgtagtgtgagaaagtggagagaaagagtgggcagcaagccaggatgttaaactgttttggggtgtggggtggtgtagtaaaataaacgggaagtttgacaagagaattaaaagacaattcctgaatattagtttttttcacttctgaaacatggatatataagccccaagatccgccatttagatgtttaaacaaatttggataagtaccgaggttgcatcattatgaaactaaccagaagtggctgtgcgctccagttgtaccggaacaaaatgatgctggcacagcaagcttcatgtcctttagaactttattataaagttggagatgttttttagatacattggtatatttgcattatagacttaatgaatgtatgtaatgccaaacaatgctaaaatactgactttttaaaaaaaatattagtaagttaggagtgttggtgggtagttcaaggtaatcctaaactacctagtgagtttgaaatcaattgggctacataagaccttgtctttaaaatatcaaaataataattaaagaaatgatttaaacatacagactatattacactatattacaaagatctctcagtttatatttacagaattccgagttatatctaattgcctttcttctctttcctaatccttctttactctcttgaagtggttttaaggcaaacccccaaatcttgccccccccccccccgccccaatgaataacaagttaggagttcaaatctggtaggatatctagcaggaaaacaatagttttcttctgttttctgtctgatttttcccttctaaaaatgtatatacagctgaattttttttttttttttnnnnnnnnnnnnnnnnnnnnnnnnnnnnnnnnnnnnnnnnnnnnnnnnnnnnnnnnnnnnnnnnnnnnnnnnttaatatgtagcccaggttgacccagttctcacagtcctcctgcttaggtttgtttgtttgtttgtttgtttttttaagatttatttatttatttattatatgtaagtgcactgtagctgtcctcagacactccagaagagggagtcagatcttgttacggatggttgtgagccaccatgtggttgctgggatttgaacttctgacctttggaagagcagtcgggtgctcttacccactgagccatctcaccagcccctgcttaggtttttgagtgcttagattagaagtgtgtcccacctcaccgaatttgaaaatgttaattatttagggaactatttacaaataaattcaacactagctcatagctgaacttcttatatacgtccctatccatttctctaccttttgctcgttttgaggaggctttttaaaaattaattaatttattttatatatgtgggtacactgtagctgtagatggttatgagccttcatgtggttgttgggaattgaattttaggacccctgctccctctggcccaaaggtttatttattattatacataagtacactgtagttgacttcagtcaggcgcaccagaagagggcatcagatctcattacaggtagttgtgagccactatgtggttgctgggatttgaactcaggacttttggaagagcagtcagtgctcttacccagagtcatctcaccagcccccaaggagacttttcttaaatacttttttgttcctttaaatataatcgtaaacggtactattatcacactttaaaatgttagcagttgcttcttatatagcccctcagcacacttgtttgcttgggtttggctttatggagttggtctaatcttacaccttccttcttcctccctccctccctttcacattgagacagtttttcattttgcagtcctgtctagcctgaaactcactatatagaccaggctggccttagactcacagagatccaactatttttgcctcccgagttctaggatataaagcattgacctactattcccagccacgatcataactttaaatcttttagaaattcttgtctttggaaatagcatctgaaagcttggtggtagtgactggtggatacatttagtcccagaacttaggaggcagaggtaggcagatatctgtgaatcctctaggctagcatggtctacagaaggagagttctgggatatctagagctatacagtgagaccctgactcaaaaaaccaaaggaaaaaagaaagaaaaaagaaaatagcatctcaaactaggacaatagtgttctttgtcaatgtgacttctcagatgtcaggcattaaccttggagttgtactgttgaaggggacacttcagtagtatatcacttcagtagtatatcacttcagtagtatatcacttcagtagtatatcactgagaggcttatgggatgagggcgtatcagactgattatctcactatgtgatatagatgatgtttgtttctttgtttttcaaggcagagtttcaggttaaagacatgtacatctctacccagcttcataaataaataatatttttttcagaccagagtgaaaagtgatttagtgaggccctatttgtatgttggagaaattgaaattatttttcaagacatgcaccattaaattttaaattctagtttattttttgtatgtgtgcacacagagaaatcagaggacaacctgaaggagttcattctcctgggcaatcaagtcaggctctgggtttgacagcagataccttctggcgaagccatcttgatggctcgtatttctccttttcatcagtggcaggcttgcagcccaagtatcgtcagtaactgtgtgagataatggggtcctgaggtcactgctgtgcctgtcctggctccttcacagggtcttgaccagaggagcgctgtgctgctgatgcctttgtcacaaagttgggggctttatatctcataccatcacgtgaactgttctaatcgtgctgacattttatttaaagatatagcatgttacttccaggagatcacaccaacttgtttgtcacatctttagtcccatgttcttacatcatttaaatttcctgaacagcagctctaatttaaagctgacggcagatgtgggtcatgggcagtcgtgagcctcagcaggtgctgtcttagtggattaggctggaaagtgctacctcagcacagccagagcttacctgggaggctctggaggaggagagctgcccaggcaggcagaccggatggtggggtttccagaagggtcaaaggactaacgacactaaagagaaaggcagaggagacgaaacgtaagtaagacgtgtttctaattgctaaagttgtgtaaacagtattatggcagactcttcagttgtgtgctgcacttcactcagactgtgagaaggtaatattgggacagcaggtaaaggcactcgctgtgatgttgcatggcaggagagaaccagctatttcaggttatcctctgtccttggaatatgtgttgtggtacatacccatacacaattaaataggtaaaatgatagaagaaaattactttaaagatcgttttctgcccagcagtggtagtagtacacgaggccagcctggtctataaagcaagtttcaggataaccagggctatacaaagaaaccctgtcttggaaaaaaccaaaaacaaacaaacaaaaagttgttaaaaaaaaaaaatcctgctgtgtgggaggcagagggtgactcaggcgcagttttctcctccctcctttacatgggtgggttctagggggtgaactagggtccccaggcttgcatagcaagggacttaacccacagaacctggaaatcattcttttgattgaatgctttcttcatatacaagaaaaatatgtgacagtcatccaggtaatattgcttaaaagtagaaaaatgtatttaccagaaacctagtgaggaatagaactgatgggctattgagataactttgggtaaggttggtggctgccatgcctgaggagtttttgaagcagctcagaaagatcccctgtttatacaacactggttcagcatagttgtattcggtctcatgatgtaagagctttagtgtttatgtcctgctcaactgctgcttgttgattagactaaatcaggtacctcaggactttggttgctactttttcttacgttaatgctggattggatggaaggtctttatagccagagttcctttcagtcaagtaaggagtgctgaaaggtggtgatcttgactctgttaaactagtaagagggtttcttctttgaccctttgtaaggtaaaaacaagtcaaactcatgcgagacaaaaatggcagagtatctttctgtgtttttattcatttgggattttattctgccatataggaatgaatattcctaaatctagtaagagggtttcttcttggaccctttgtaaggtaaaaacaagtcaaactcatgcgagacaaaaatggcagagtatctttctgtgtttttattcatttgggattttattctgccatataggaatgaatattcctaaattttagatcttaggttttgtgttctaaagagaatggctcagtcttctcctgcaaaagtcatgccaggtaccagggaggcccaaggtgtctcccttggtgaatcaggatccactcaagaaccagagatggtggatataacctgtaatactagccctggggaaggggagggagtaaggtcagagtaggtgccaagggaagttttagtatatactgtactgcttagcaagacactgtcttaagaaaggcaggaacgtgactggagagatggctcagcacttttccagaggctctgagttcaattcccagcaaccacacagtggctcacaaccatctatactggtgggatctgatgctctcttctggcatgcagctatacatacagacagacactcaacatacataccataaataaataaataaataaataaataaataaataaataaatatttaaaaaaaaagacaagcaggataaggagcatcaacagaaaatgagagtatcattgtggtcagcaatcttttagaagccgtcttgatgtataccctgcttttcaagtgagcagcagcagcagctggtctaggaacatggaagccctctttcagtgcacagctttaccttgtaggccttggttgcccgtgccccccccccccatgttaagtacttagtaagtcgacccttctttttgttctgccagcagcaaagacacttagttggaagggattctgtcaccatgagcatatagtgtggaactgtagaatagagaagtaaggaacgtgaacagttctggggtcatccagctgatttattgtagatgtgtcttactctaacagtgatctcaggacacagcaggcagagctcggtgtgaagccagcccagtctacaaagcaagttccagaacagctagggccacacagtataaccctctcttgggtggtggtggggggcaaggaaaagaaattaatattggttagttaagcatttggtattttttaactttgacttttgacaaaaagttgatcttgatacacaatcctaagagatctggagcccactatattgcccgagaggtcttagactcaaaaggaatctttctgcctctgcatatcccaaattctgagattatgggtatgctatcatacctaactttattattattattataaaatttgtgtgtgcgtgtgtgttttatgtttctgtaggtatgctcatgtatgtatgtatatgtttatgtatgtatttacatgtttatgcaggtatattcatctatgtatgtatggaggctgatcattattttattagttgacctcacttgtcaacacagggtcttactgaaccagagcagtggttctcaacccgtgggtcatgaccctttttgggagttgaatgactttcacaggggtggcctaagaccactggaaaacagacatttatattatggatcgcacagaggcaaagttacaatcatgagtagcaacataaataattttatagttgggagtcaccaccacatgaggaactatattaaagggtagcagcattaggaaggttaaaaaccactagaggttttcatttcaactagattaatttgtcattgaacccaagaatccatgtgtatctgcccacaccattttgaacctctttaattattacacaaaatttttgaagattgtgtggggagtgctggaagatgattcagtagttaaatgcacttggtgcccttccagaggaccctagtttcattctcaatgcctacatgacagctaacaaaccatatgactcagattccagggaatctgtatgtgtgtgtgtcaaaaacactcatattctgtgtaatttgcatggggaactaagattcttgcataaattatattggtattaagttgtttcaccttcaatattatggtgttataatcacatttataattgatttaataaccaacatcaggtcagaattgtagcctgtgtgccccaggtacagtggtagatgaggcctgctgttctaacacttaaagagtctgaggcaggagatttgctattagttcgaggccagcataggccacagaaataagttcaggcaggcacgcaggcatttctatgtacagcttcctctgggaagtgaagtctttttgtgctgttgtttattttggattgggcttttgagacaggatctctgcggtcttggctggactggactggtgcataggtctggctggccttgagttcggatcctccctttcctgcttcccagctgctggctcgggttaaaggcaggctctacactctgaggtattttatttaaggcatgctctacactctgaggtattttattttctgaggcagtgtctcatggagcacagactggccttagactactgtgtagctgaagatgacattgaactttttgcttccacatcctgagtggaattataggttagcaacacctcatgtgggaattcatacattgtaggtaatcagtctactagctgaactatatctccaacccaggaggtcaggtttgtttgtttgtttaacaatctagttttgaaacagtcatatcctaggctggcctcaagttatgtagtcaaagatggccttaaaagatgactcttggttattttccaagtgctgggattatagatatgcacaccaccacacctcatttgtctcggggctggactcaaatccagagcttcatgcatgtgaggcaagcactgtaccaactcgacttttgcatactccattgaaagtcatttttataacaggatcatctcagttgtctctgacaatggggatgttttatatgactgtgtatggctttgcagctttgacagccttattcaagcccatatctagaaggtatttctgagcttcctgggactcctcagcatagagtctggggagaaatagaagacttttgaatgtccctttgtctttcggctcatgataactgccatagcttcaaagtactggttttccagattacctcagtcctgtttcttaaagaaattactcctggtttctctgtgtggtagctattctggatgtctgtgtttgttgttgttcttcttcttcttgatttctttcttttattattttttaaagatttatttatttattattacatgtaagtactgtagctaccttcagacaccccagaagagggcatcggatctcattacggatggctgtgagccaccatgtggttgctgggatttgaactcaggacctctggaagagcagtcggcgttcttaaccactgagcaatctctccagaccctgttcttgatttctgagagactcagaatctttccatgagaaggacctgtgctgttttaatattgattgattgattgattgattgattgattggagattgggtctctgtggtacagattggcattgaaattaagatcttccttcttggccacctaagtagtggaatgcaccacctctattggcattaattttctttttcagtccaccacaatattttcagcagtatattagtacagttaataaaagtgaagattgtgtttttaatccagttctagatagagtttcaaaagttctgatgagtgctgcagaaaaggtctctgcattgtgtgattgtagctgtgacgttttcagttaatcataccgtatcttatgcatttcttgccatgtttctgttgcagagcttggattctgaagtgtggaaagcactgagacgtgaagatgagtgaacttgaccagctgcggcaggaggccgagcaactgaagaaccaaattagagtatgtagtcatgcgggtttgatatgtttcatatcagaaacatatctattgtgtgtggataacagagtgagatgaaattgatctattatatgctagttatatatctgaataacttatgttgtttcagaaattttgttttcttattagctacaagttgttgcttgaatgtacatggcccatgtctgtaatacttaccaaagcttttgaacgtcttcctcccggggaactaggttttggaccctctgtgtggccactgtggccgctgtgtcagttctgaagcagctctgaagagcacggctactaaactgagagcagaaatagatactttaaatgaagggatccgtaaagtggcattttagatgtctctgtcttatttttcatagtttcgcaatggtttgtgctccaggaagaccattggaatgtatgtaacagctcttaggccaccatagagagcagacttgtctacctgggtacaaaactaaatggaagataattccatgtattctgagttgttctttctgtgctggggactagtgttagaaatggagctaagagcccacacatcccaggcaaatgtgagttttttggttttggggtttgtattttagttttgttacttgagacaggttcttactatgtaactttgtcctgaaactcagtgtagaccagactggccttgaatgcaacattatacagagataagtatgtggggttttttgtttgtttgtttgttttttgtttttcttagacttgatctaagagcatggaaaaaatgacttaagacttaacaagaaaatcccagtttttcgtttgtgtaaggatttgtatatttgaaatagcttcctctgattttcatgttcttgtctgtaaggatatggctgtctgtccttgagcgtctcactaagcctttagaatggttcacatgtctttaacttgtcagttgtgttctcaggctgccaggaggactaggtggagaattgccagcatcattttagccaacttttacttgaatttaagaaaacataccagaactgcataagttttagagcagagataaaacaaaatatcctctgctgtaagcacctcactggacattggtgtctacgctgttcctccgtgtgtcagtttctgtaaagttaataatttcatgtgtcaggcaagtttatagcactgaactatacctagcccttgcctaaaatctttttagggttaggatttttggaagtggggcatcaagttgggttttactatggtactaagatgatgtcaaaatttgagttcaaatgatcccatgtgtcagtctcccttgtagctgggattgtgtagcatgcctgactttccctaaacttttgcatgacttaaaaacttaaagccaacttaaagccaggggctgagcattttaatcactgcatttaggaggaagaagcagagcgataagagttcaaagtcatgatcagctacatagtgagctcaaggctcaccacgagaccatctctcaaaaggtaacaacagactggagaggtgtctcaacaattaacagcccttactacactttcgaaggactccattaggttcccagtgcccagatcaagaggctcacaatcttatgtaactcttaactccaaggaatttgacaccttcttctggcctctgcagatactttcatatcccacacataaacacacacaaaataaaagtttaaagtcaggtacaatagggcatgtctgtaatgctatcaagtctgaatactgaaggagtattgaaggtttgaggcctgcgcatgggccatatgcttttgagatttttatttctttgtcccaaagttctgaaaattaagagtatagaaatgacagaggagttttcagacaaggtctcactatgtagctgtggcagtccgagaactcactatatagaccagtgctggagactaaaggtgactaaagccaccacgcctggcttttgtggtttgaacttcctggtttttcaagacagtttccctgtgtgaccctgtgactgtcctggaactcactttgtagaccaggctgccttcaaacccatagaaatacccttcctctgtctcccaatgatgaaatcacactgcttggtgtgatttcagtttttaaaacgggagcagggtggagatggctatgctgttttaaattaagccaacatggagatcaactgcacagcatggagggaagatttagggaaaggataagaaagcccaagtgttgaagaaagcatacttagaacagatagaaaggagaaaaagaaatactcagaaaaactagcggatttactaagccatatggttgtagctgtgtagctgctgagactcaaatcatttagcagtagataaagagatttttaaaaaagatttgtttgtttgtttgtttattatatgtgtgaacactgtagctgtcttaagactctcaagaagagggcatcagatttttgttacagatggttgtgagtcaccatgtggttgctgggatttgaactcaggacctttggaagagcagttggtgctcttaactgctgagccatctctccagcccagataaagagagatagtaaatcaaagataaatgtcatgcaatattttgataagcaggtttacatactctctagtccctagtacccacccgcctttctgcatccaaatagtgcccctgtaattatagcattcaagaggtaaaaacaggagggtcagagttcaaggccagcttcagtgacatatcaagtttgaggccaactgggcaacataaagtgttatgtttaacatatgatgttatgttaatatatattagtaatatgaaatcttaagtttcatctagtcccatgtaaagtattatttcagtcaatagattcttactgagatagtttacagtacttacatttcagttttgttttggttttaaagttcagctcatgcctccctataagggcattctacagttctctctcactgtgtctgacatgcacagatagttggtgacccccccaagacctctgttgtggacagcaccaatttgactgttccttatagggccactttgtttcaaccttcatgatgagcatcatcttcacaaatggctccatgggtttggccttgcctctcagcactgcactaattttagagtcgattggtgaggagatgtgaaggccattgagtctctaaatgggaagggaagacttttgtttgtttttgagacatggtctcactatgtagccttggctgccctgcaacttgatatgtagactactggcctcaaactgcttgcctctgcctccccagtttactttggagactaaagctgtgtgctaccttacctggcaaggaatactctttaaaaaagtaaaattctggagttagatacttaagtggttaagtttaatcccagcactgcttataactgtagctccagagaatccaagactgcctgtcttttggtttcaataggtacctgcatacacataaatttaaaaacaaaaacaaaaaacttttttttctgatataagggaggaaaaatgtaaaatgttctttactaattgcctactaaatacatgcttgctaaagaacttagtacaagggctggaaggatggcataactcagtagtagtctagtgctttcctagcagtgtggtccccaaagttacagggaaaatacgaggattatcttcactttgaaggccagcctaaactaccaatcaagaacctgtcttaaaatcagaagcaggaatccgggcctggtggtgtacgcctttaatccaagcactcgggaggcagaggcaggaggatttttgagttcgaggccagcctggtctacaaagtgagttccaggattgggtgagacggcgagcacttttaatcttagcagtcaggaggcagagttaagtggatctctgtgaattctaggccggcctggtctacttaacaagttccaagatagaattatataaagaccctatctcaaaacaaacacaaaatcagaaatagcagatgagttaatcaatgaagtaaaggttcttgccacccaacagtgtaagcctgaaaacctgagttccatttctagagtccacgttaaggtggaaggagagagtactgtctctacaaagttgccccatgacctccatactctgtagcaagcacactgatacacatcagtcacactcttgggtttgtttgtttgtttggatttttaccaacaaagcgtttgtgggtgttttgttctcccctgtccccccactaacaccaacacagggtttctctgtgtatgcctggctatcttggaacttgctctgtagaccagactgacttcaaactcagagatccacctgcctctgccacttgagtacgtactggaataaaagctgtgtgccaccaccacctatacagtcaatatactttcaattattaaaaatcaacaaaaggcttctagctggtgtgtttatacacatacacagcttctcaaactcgggggccgaggcagaggatcaggagttcaaggtcatccttagccgcatagtaactttaagaccagtttgcttacacagtgaatcacacaagaaatggcagttaactgtaagaagtgttgtctggccctttgatttgttttttatgtgaacttcccctgggggaaaaaaggaaaaacaaaaaaagaagcttgtcattcttttgttgatcccaaggaaacaggctctcaagtagatgtttaattaaagcacacacgccttaaatacagaggaactgaacttactactctgatagaccattgcacacatggaccagaatgtagcgacccagagctgagggtgggcccagactttccaatttcactgtgagacaacagtgctgcatgatacgggccagcctcttctgtactcaaaccaaacaggacagaatgattgattaaatggatcagtctacatgaatccatcaagaaatcattgtaaagccgggggtgggggtggagttttttttttttttaaagatttatttattatttattatatgtaagtacactgtagctgtcttcagacacaccagaagagggcatcagatctcattatggatggttgtgagccaccatgtggttgctgggatttgaactctggacctttggaagagcagtcagtgctcttaaccactgagccatctctccagcccgggggtggaggttttaatcccagcattctggaggcagaggcaaacagatctctgagtttggggccagcctgggctacacagagaaaccctgtcttgaacaagcaagaaagggagggagggagggaaaggaaaggaagaaaggaaggaaaaaaaaagaaaagaaagaaagaaaaattattgtagctgggcacggtggcacagttctttaatcctgtcacttggggaggcagagacaggtcaatatgtataaggttgaggccatcctaatcaacattaagttttaggccagccaggtataagggaccctctcaatcataaatcaatcagtcattctcaggccagcagggtgagtcatcaactaaaagtatgtcaatatttattttacttataagtgaaaacactttaattaatatggtaaaaattaaagaaaaattactatagtatattgttttgtaggtcttagctacattggtatgttttataaatagaaaagattgctgttttgttaccagtcttattgaaattttattaacaattttagattccttggtctattcatagaacttagatttaatcattgtttggcttaaaaataaagtccttgcataatgcattctcaaagagaagctgttggcctgaatagctagttggttttcagcctgttctttcatgcaaccccttgtgctcccatataacctgggaaagacagagcaggtgtgtgttggctgtggggagtcagccttggcttccaggctgctcactgctgtaccagctcccagtgtagtttctcccgggcctgcccagagttctatggggtctgcatgtcttagttaggtttaggtgttgtgagttgtgtctgttttggcctgaacaactcaaaagtggcagtggacttgggactattagagaagaattaaggaacaagacagtttgtagaggcttcttgaaactttggtaaggaatgtcgtaaagttaaaagtatggaataaaactaatttccatttgttatttcataggatgctcgtaaagcgtgtgccgatgcgactctttctcaggtaaggaataattccacctttcagctgtccgtaatgcgcagtctgccgcgggcttgtatcatgtggggtgagcccttttgtgaggtgaggttgtagggccactgtcagggcttttcatttggaggttgctttgctgatgggcagagaggacaggaaccactggttcctaaaatgggagtgatagctctaccgtttgacccaacaatttaatcaaactgattttaaaacatgtaccaggctgatgagatgactgctaccaggcttgacaacccgagttccatcccagagctcacagggtagaaggagattcagaggtggttctctgacctctgtgagcatgtgccgctgtcctgcccaagtaaatacagttaaaccgtgggcatccagctcctgctgtagtgtatctactgctgtgagaaacacttcaaactctaagggaggaaagcatttatatcggtttatacttctaggtaataatatatcattggaaaatcagggcaggaaccatagaggaaaattgcttactggttgctttctcaaacagccaaagataatctaatctgtttagaagttgtcttgttcagtgtaggctggaccctcctacatctattagcaatccagacagtgctccatacataggcccacagaggaatctgatctaggcagtgtttaattgaagttctctcttctcaggtaactgtgtgtctagttaacaataaaaactagcaacacacacacacctatactcacacctactcttgggtaatcaatggcctgatcctcagacctaatagacatagatttattttccctgtgtatccatggcagtggtaaagtgagtatgttaggtaaaggtggagataactaataatttaataaagcagtaataaaatggtagctattctatgaaatggtagttacatgtgatatcagatgatcttaaaatatcttactgcatgtactggtgcgacaggggatgacagtgcctatatccttgataagaagaagcgaggtactgagccatgtaaaaagcatagtggttgtggtgtattgctgataaacatgctgtatacttaaagcatggactcactggacaagggagttaggacccaggcactacagagtggatagttaatagtgctacttaagggagcaatgtgcagccgggcagtggtggcgcactcctttaatcccagcacttgggaggcagaggcaggcggatttctgagttcgaggccagcctggtctatagagtgagttccaggacagccagggctatacagagaaaccctgtcttgtgggggaaaaagggggggggggaagcaatgtgcaatttaaagtttatgaattggctgctggagagatggctcagcagtttagagcacttgctgctcttctagaggactgggattctgtttccagcactctgtagtggttcacaactgtctataaatcttctggtctcctagggcttctgcatgctaaaaatattctctcacataaatataggattttccatttaatatatttttggttcttggttgatattatattacagagcccacagaacgcaaaccaagagtctatttgctaaaattaatcttcactaattttattttttaagatcacaaacaatattgatccagtgggaagaatccaaatgcggaccaggagaacactgagggggcatctggcaaagatttatgccatgcactggggcacagactcaaggtatgaatggggccttcctaaagcagtacttgaaatgttgcctatctgctggatttctaaaaggtaatggttagaaagttgaattggtgtgggtgtgatagcacactttgaatctctgtactcaggagacagaagcagacaaatctttgtgagtttaaaggccagcctgatttacatattgagttccaggctagccaaggctacaatgaaatccatctcaaaaccagtaggatggggtggggtaggaagtttgtggtaccagttatctgtatccaggtctcatgttcacaggtcatactcagatttccgtttagctggctgactgcactgctgtcccttgcatagcagcacctgcttttcttcaccctataccttttagctgttgggtctctgttgtcttggctactctgtgggctgtgttttaagagttgggcaatggaaggtaaaaggtactgagtttacaacagcagactgtggtcccaaaaactaaatgtagacttcagtggtctcttcaccctcactgggaagccttatggaaaatgaacgaatggctatccttatcatccttccacatggccctgcctgccatctactggtgtatcatttaaagagatactaccatttgggggttcctttcttttatactttgataactaccctttattggactgagtctctcctgacttttccactcataacgaaataaagtgcgacatggtttgtgttctccttccagacctaaaggaatctcagcatccttttcttctgagtcagttttcatttctgcttagctttctctttgtgaaattatctgctgtagggtgtaaatagctagaacaaaagattctatctttagttctctgcagggtcccatacaattgcttgtgcaaatgagcgctatctgaggctgtttaataatggaaacagtcccatcaaaaaagaaaaagggggcggggcattgtgttcttgctgcagctgcagcttcagttagatagatcatggatgtattctattgttgctgtcagaattgttaagtgcagatttgtagatttattgattgattgttttttcagtgccggacattgaacctagggtctcatgactgcaagcaattggtgtaccactaaggtgcacctctagtccaagaatagttaccatatggtcctaaaaatgtgagataatgactgtgttaattcacttagtttatattctgtaatataaacattaaacaacttacagtccatagttactgtcaattaaaaataaagatcataaaaaaaaaacctaagcaaagttagaaaatggacaaacaatggtggcactttttttttttttttttttttttttttttttaaactacagcccttggaattaaagcaatatagcaagttctaggacagcttgggctacacgaaaccctgtcttaaaaagcaaataaaccaggggctggtgagatggctcagtgggtaagagcacccgactgctcttccaaaggtccggagttcaaatcccagcaaccacatggtggctcacaaccatccgtaacgagatctgacgccctcttctggggtgtctgaagacagctacagtgtacttacatataataaataaataaatctttaaaaaaagaaaaacaaataaaccttgcaaagcattatttagggattgctttaaatgagcatactttctggctagtcagtggttgcattttaaaatctaaaatagctgtttaaggagttgttgtgggtatgcatacccctctacccccttacatcattttcatattttttgctctaatagtaaagggttgttattgagcttggtgtggttgcaaatgtctttaatcacagtacttgggagacagaggcaggtagatctccatgagatcaagggcaacctggtctacatagtgcgttttagaccaaccacgtagcacaaacttgaagacctaggtttcgatctctaggacacatgtaaaactgatcatggccagatacttagaaccccactgcttcagtctggtcgaggtaaaagaattattgggatcactggccctagcggaaaaatgatgagcttccggttcagtgtgagactgcttgagaggaataaggcagagagtctagaacagggaaacagtctgcttcctttgacttctgaataggaacacacacacacacacacacacacacacactaaaattcagctttgtgggggtgtgtggaggagtggcgggggtaggcatgtggaggtcagggcattatgaccaaggaatcagttctacttctaagtgggttcctgggaccaattggttggttggttggtttttttggggggggggggggtctttcaggaaatgtttccctgtgcatccttggctattcaggaattgtgtagatagggctggcctcaaactcagagatcctcctgcctctacctcctgaatgctgctggaattaaatggttgcaagagcccgggattagatttaatggaagggcttgtttgataggcacctttacctgagccttctctttagccctaaaatttaacttgtaatactattccagtagtgcttttccaggtctgtggggtttttaatcccctctctacagagcctgatgaagtagtctctttggctggtcttcctctgagtaaactgaagagtatgtggggttggtctatgagtgcctccttttgttctaggcagctaatttggctagttctcagtttctatctctgtttgaggacagaatatgaaaagctttagacaatgaaccgtgttgattcctccaagttacatgacctgagattagaaaggcgtgtcttctttcaccttctggaggatcagctaacagcttagcattgtcttaattcctcactgagttagcaattattgagctctctgaaggtgacttcttaaatcagaggatgagctactaaagatgtctcttgatacccttgctcagagtcaaaaagaccaagcagaaatagagcagcagaggggcctcatactgtctgtcctatagaaatggttgaaaggaccttgggtataatgactgaactgcaatagatggggagctggaaagactttgagtgactgttagccttggctacacagtaccctatctccaaggaaagtaaaagaatcgtctgaggagttggaaatactaggttgtagttgagttccctgtattctcaaggctccagagtttagtccctagaacctcataaagaaaaaattttaccagaggactgaggtgcaattaattggtgaagtacaatttactgtgaattcaatctctagaactgaaaaagaaataaaagttgtagctgaaaagaaactggatgtctgtgcctagttctgtgataaattttgtgactaaggatggaaaaggattttatttcttgtcacatatatatgttgttctttataaaggaaatttacatatcagaacatagcttggcagggtatgatgtagtacagctttaatgcaagcactttggaggcagagacaagtagacctctgtgagtttgaggtcatcccggtctacataataagttccaggacagtcaaagctacataatagaggaaccctgtctcaaaaaggcaagtgagtcagtcatacaagcatggtctgattaaaagtgtcagagggctcaaaatggcgtggttgagttttacctcaagtctttgatgagcttcagaagttcaaatatgcccaaatatacttgtggctgaaatacctagaatgtatatattttgattacaatttgaagttaaaacctgtatgtcactatcacatggtagacctgggagagcctctcacccttccttaagagcacattgtgtctgagtaatggtgcttcccagaattgctctcactcagttacttcccagataactgagattcctttgcttgttggtcatgcttgccttatgcagtatatcctgcctcagtctacaatgcagagaactgcaggttccaaactaggacagagtcatgagcaattcataattcactataattggtggcctcttttgcccaaccatgtgcaattctgatgtcatttatcatctcactaccacacagttttatagagacaggtattctaatttatctctgtctgggaagtttgagagttcgtttttcttttaattttgagggatagagtctgggccttaaacttgttacatagtgaccttgaactaacactcacacacacactctctccccctctccctctccctccccttccccctcccttcctccctctctctgtctgatttatggtttctccacatcccacatttatgagttacaacgtatgctaccattggagctcatggttgtgttctagtttgatttctactggtgtgattaaacactgagcaagagcaacttgaagaagattttgtttgagtttatagttgtagtctatcatgaaaggaaatcagcaaagaccgcagaggaataccgcttactagctttctctttagggcttacttagcctgccatccaggactacatgcccaaagacgacactgcccacagtaaactggccatgctcacatcaattattaatcaaggacatacccataggtttacctatgtgccaataagatggagatattttctcagctgaggctccttcttccttagaggactctagcttctgtcctatcccaccccacccccaatataaataaaaacagggcaggtgtttaaaatggattaaaatggttcctgagtgggtagtgtttcaagcttttcccataatattcaagctttcttgctgtcagtatgaacaaaactgtgtcctaaatatttgacatgtctcatgtctctgtgtatctaatttaacttggaataaaaaagaaacccgtcagaagcaggtcagatcagtaccatctctcgggtgataagagaagagctggggagtctggtcatccaggtgtccccagggctgagttgttatctgacactcatggtattccattgctcaagcattgagatcctctttcttattattaagtgtattatattttaagcgaatgtagctttaaagctctagttggtcaccaagattttttgtttctgttttttcttttcctttatcttttctccaggctccttgtcagcgcctctcaggatggaaaactcatcatctgggacagttataccacaaacaaggtgggcagtgcaagaccctccctggaacagtgacagtctgttcatggagcaatgatgacctcggagggtgatagaagagcttgtgttgctgacccattgagcttggcacacagttgtgctgtggttcctgtcttggcatgtagataggagctgagtgcttccttgtccttgcacaagagctacactccactcctagttttgactggaaactttcctaatttattactagaatactgaaatgcagattccatttagttagtagtttgttttgtagtaacaagagataatctaagatgcactatactttaatgtttagtggaggattgggaatgtagctcagtggtagaatacttgtctactgggcataattccctggatttgattcccataaccagaaaagataaaaaaccaatgtaacccaacagattggtaaaagtctgtgattctagtaactcaggaggctaaggtaggatgatcgaataaacccagagggcaaacctgccatggctagataggggaaaggagaagacagagatactaggtagaatgtttgcctcataggtacaaatctctgaattaaatttccacttctcttatattgaaataaattacactgggtatggtggtacatgctcataatctatcatttgagaatgtaagcaggagcctcaagcattaaagattatgcttacccacataataaagtgaaaccagcctgaactacatgagaccttgtctctaaaaaatagtattcacaaaaaaccaaacaaacggggctggcgggatggctcagtggttaagagcaccgactgctcttctgaaggttctgagttcaaatcccagcaaccatatggtggctcacaaccatccgtaatgaaatctgatggcctcttctggagtatctgaggatagctacagtgtacttacatataaataaaaaaaaaaaaattaaaaaaaaatttaaaaaaacaaacaaaaaagaatacatttaaattctgagtggttgcagtggccagtctataattctagcatttggaagacagagacaaggaatccacaaagcaatctggttatctagacctacagacgagctctagacagtcctgaggaacactgtctcacagaagaaggtggagagcagtcaggggagggcccgtgtcagcctcagcctccgtgtgcacaagcacacatgcgcataaagtacggggagccgagccaggcgtggtgatacacgactttaatctcagaagttgggaggcagaggcaggtagatctctgtgagttagggggccaccctgtctataaagtgagttccaagacagccagagctctagaaaccctgcctgcaaaaacgaacgaaaaggtgcagggctggaaagatcgctcagtcactgcctgatttttccagaacgtcttgagttttatccccagcgtctgcgtagtggtttgcagccttctgtgtgtcagttaaaggggaacccagagccctccctcctttagctttccaggctctgtactcagttaatcaacagttaatcaaatgttcctacagataacatgaaattaaatctcaagacaagttttaatgctgtcatcaattaaggaaaaaaaattggacagttgtattttccctcaaaattagtaaatacatgccaagattacagaatgttaactgctctatctaaacagcaagactaactgtgttaccaatgtgcagttaggttattgcatgtgtgtgtcagagagaatgaatatgaatgagttctgcctcagcttctttattgctgggatcggcatgaatcaccatgcctggctgttttttatgtgcttgtctttgtttttttttaagctcatagccatgataaattaaaggggaaagtaaatcttttcaaatcctattaacatcactccttaaatcattaaaatgcaaatataatttgtgttttctttgagatagttttccattatgtatagctcaaaatatcctcaaacttgccatcggggctggtgatatacaccctactggacaagacttttgagttcaagtctcagaaccaaaaaagacagacacgacaaaaagccctctttttctttctcttagctttccaactcctagattcactgacgtatgccatcacacctatctactcattagggttttttggtttggtttggtttggtttggtttggtttggttttgttttgttttgtttgtttttgagacagttttactatggagccctggctggcctcaaattcagagattcacctacctttgcctcctgagtgctggggctacaacataaactatacacccagctgtagtcatattttcttgaacttaatagtgtttcctgtctgtattcttgttatttaggttcatgccatccctctgcgctcctcttgggtcatgacctgcgcatacgctccttctgggaattatgtggcctgtggtggcctggataacatctgctccatttacaacctgaaaactcgtgaagggaatgtgcgtgtgagtcgtgagctggcgggacacacaggtacacatctcatgttccagtggtgtaagctgctaactgggatgtatactgctcttgtgatctgttgattattggttcaagtaaaagtgaaagtaacggccagaaattttctgaaagtgaagccaaaccagggccaatatgccttcatctttaagaaacatggaaactggttttttagccagttttcgaattcccagctgcttcagccattcttgtttatcaacgaattgatgtttcagtcctgtttttaaactgccttccatgcttggacattagcacaggaattctcctagtctaagcaagtgtccatatgcacagccatatctgtttgtgctcactgaccagtgcttttttagaggaggccgaagagagtctgtggtccattcaccttttgaatgtaaccagcattaaaatgttgggtgcatatttttggaattcatacaacaccatttaggacacattgcctttccaaggaagaaagtctcatagtattttctatctatcctgtcccgcagtgataggtaaaacactcttcgcatgtaagcaaaggattgttcataattaactgtcatgaagaacatggcagttttgtgttttaacccttagggtcaggtaggattgcatcctttggtgcttcttaagttacattgccagtgtttataactacttcaggaatgcttgcttcttaatattctggctttagctggaagcataagccaccagttttagatctcttctttctcaaatatatgaacttaaaagtggccaaatccaggctgggagtggtggcgcacgcctttaatcccagcactcgggaggaggtagaggcaggaggatttctgagatcgaggccagcctggtctacaaagtgagttccaggatagccgagactatacagagaagccctgtcttgaaggggaaagaaaaaaaaaaggcaaaatccatacaggcatggcttcctgtaaattttgatcagtagtatttaaattactcttctaggggctggcgatgtagattcgttggtagagtattttcctagcacacacagttctaggtctatcccagcaccataaaactggacatcatgataatttgtaatcccacctctcatgaagtggaggtaagaggatggagaattcagtgagtttaagggcagtctgggctatatgaaaccctgtcttaaaaaagaagcatggtatagttctcaagtatatgatagaaaaagaaaacaatcggggagaagtctcggtgactaagaacagccactgcataagcacaaggacctgggctccatcccagcgctcacaagcaggcctggcgtgtgataatttcatcattgtaggctgactccagcctcgttcagtgagaggcccagtctcaacggactatagcaaacagtgatagagcaggatattcaatgtctggtgtcctctgttagtctctggataggcatacaccacatacacaaatacaagtaagacggatatctaaaaatccttgggggggggggggtcctgttgaatttgtattaatttttttaaagatttatttattttatgtatgtgagacactatggctgtcttcagacatagcagaagagggcatcagatctcgttacagatggttgtgagccaccatgtggttgctgggaattgaactcaggacctctggaagagcagtcattgctcttaaccgctgagccatctctccattccccctaaaatatattatttagagatttggagagatggttaaaaacactggctgctctttcagatggcctggattcagttcccagcacctgcatgtgccttacagacttctatatgtaattctagtcccagggaatttcatgccttcttctggcttctgtgaacaccagacatgcttgtggaatacagacacacaggcagtcctggttttattgctgtgatgtgacatcatgaccacagcaactcttagaaaggaaaacatttcattgaggctagttatatagctcagaggtttagttcattattgtcatgggaggaagcatggcaacatgcagacagacatggtgctggagaggtagctgagttctatatttggattcccagacagcaggagagagtgacactggcctgtcttgagcatctgaaacatccacccaccgtagccctcttcctccaacaaagccgtttcaacaaggaggtgttcctaatagcaccattccctatgggcccgtgggggccattttcattcaacacaccacacaggcagaaaattcatatacattaaaaattttggggctggagagatggcttagtggttaggagcactgactgctcttccaaaggtcctgagttcaaatcccagcaaccacatggtggctcacaaccatagtaacaagatctgacatcatcttctggagtgtctgaagacagctacagtgtacttacatataataaataaataaatctttaaaaaaatttttttttgagaaatatttaacttactagtttttagctaattttaaatttgaactggtggtctaccaagacatcatgctataagaaacagaaactgtattatctggttgttgggcatagtgtgtgtctgtctttccatcagaaggaaagaatctacatctgtgtatttcaggtgttgcatgtacatttattgctgctgtctgtatctccttgaatgatcggttgttttatcatggcttagtatcccctctcatataatactttactgtgaatctacttcatgtggggttttcagccagctcagcctcaatgctcactgtctgcatgacattttttcttgttgattgtttttctaataagttgtctcatacacagcatagagttaagtcttcacttctgtttaaagtctctgcctttaggagctgggaacgtagctcctttaggagctgggaaaatagagtgcttacctaccatgaatgaagctctaggtttgatcttcagcccagcataaaaccagatctggtgatgtagccctgtagttcaagcacttagatagatggaagctgggagttgaaggtaatcctttactgtgtagtgagtttgaaactgcctgaagtacacgagaggtagcttttaaaataaatggttggggcaagtcctgtaccttgtaaatactttacatatagtttcttcttgacttataatgaggttatatccagaaatatcaatcaatcaatcaatcagtctctctgtctctctgtctctctgtctgtctgtctatctgtctatctatctatctatctatctatctatctatctatctatctatctatctatctatctatctatctagggtttctctatatagccctggctatcctagaactcactctgtaaaccaggctggccttgaactcagaaatctgcctcccaagtgctgggtatccagaaatctctttaatgtttaaaatattagccactgaattatgttgactctgtctagcctgccatcccacatcttcctcatcttatattgaccaggctggcctgaaatctgcctgcctctgcttcctgggtgctcagattgaagtgtgtgctgcttcgatgggtgtataaactctttgtagcctaggacatttgaggctgctgtgttacattcttacagtcctgacagagagcttcagttcattgctgataaccagtaccctgggcagattatacataccacttattgataggttgaaagaattgcatttaaaatttgaagttcatttgcactaaaaaaatcctaagtgttgctttggatgtggttggagttggtacttagggtggttctctctccctctgctttcttttctgctgtctgtctttctttctttctttctttctttctttctttctttctttctttctttctttctttctttctctctttctttctttctttcctcctttccctccctccctccctccctccctctccctctccctccctccttctctctctttctctctctctctctctctctctctctttctttctttctttctttctttcttcttttgggttactctgtttctagctctagcttgctccagcctctgcattcttttccctctgcctccccagtgctgtaattacaagtgtgcaccaccatgcctggattcaacattgtgtttgaagagttgtataggctcacatgcactcagacaaacaacgtcctcatttccagtgctgtgtactccttcctgggggggcatctctttttctggtttcctgtatgccaaaaagctactccctcataacacctacagttgtacattttgccagtccctttatgtgctattttttttaatgtctgtatgtttgttcaatgaaatttaatttacaaattaaagaaaagagattaacagtaagcagtaagaaggtagtgcaatatagcaatacactataattaagtttttgttttttttttttttgactcatggcactgagaattttatttatttatttatttatttatttattattttttaaagatttatttatttattatatgtaagtacactgtagctgtcttcagacactccagaagagggcatcagatttcgttacggatggttgtgagccaccatgtggttgctgggatttgagctcatgaccttcggaagagcagttggtgctcttaaccaccgagccatctcaccagacctattttttattttttaaggaattatttgtttctggaatttgcttggtttccatgggttaactgaaaccagatgaggctgcagtggttagagtaaactgcttgtgagaagtcttgatttttttttttttttttttttttgaaaagatctgttttatagtagtagtagtagttgttgttgttgttgacagggtttctctgtgtagccctgactatcctggaactggctctatagatcaagttgacctcaaactcacagagatccatctgtctttgtcaccacctttgagttaaattatttttattgcttttatttatgtggtgggggtcaaacatgaggagatcgaggatgattctatagagttagttctctcctctcatctctgcatggggtctgaagatcaaactcagtaggaagttcctttacccactgattcatcatgccagtctttgactttcatgtgtgtgtgtgtgtgtgtgtgtgtgtgtgtaattaagaggacaacttgtgggaagttggcttttctcttccaccatgtaggtcctgcaaattgaactcaagtaatcaaatggcagcaagcacctgtacacatggtcccatcttgctggcccttgacctttattcctgaaggatagttttgctggacatacaggattgatgtcaccttacatacagttggtgtcaccttcatgtgtatgtgtgtttcccctgcataaatgttgatgcaccacatgcatggctgatgccagcgaagccagagtgagggtactgggtttctcctggaactggagttaatagttacaacccatcgtgttggtgcaatgaattgaatctgagtcttctagaaaagtagccactgttcttaaccactgagccatcttctcagctttcaacatttaaaaatataacatattaaaggtgtatctttgatttttgcagtttgatggtgatattcctagacgtgtaactttctttatattcttgtgtttggcatttggaactcactaaaatatgtcttttgctaaatcgtaaggtttgagctgtgtcttccaatgccctggtttctatggttttggggtgagctgcttcagtttccacttcctcacgtgttttgtttctattcaagtcaattcagttgactttggtcactagacaacagctttccttcttgttagaccagcagtgagcagcatttgaaggaagctcagctggagtagacggcaagggcacagactgggctggggaggcatggagagtgctcacataagtgtccacatttgtgtcacatggtctcttcagattcagaatttctgtgtttttattttaaaagatcccctctacaagcactgaggctttatgtcttcttatttataaacaagattatttctcatgtttctgaatataattacaagagctaaatgtaaaatgtcagctaattgtagcatctgatcttgaggtatatctttgtggtcctttcctcttgagtgtggatcacactttgccatttcttagtgcacttgcagccttggcaatataattgtcatagcaaccgtgggctcgttatgttcctttcagatgtctgttcagtttcatcaggttaagaaacacatacatagcagcaaaactcttacttgtcctcctgtcactggagctgtctgtgggtttgcttgctgcctgtgtgctgttgctgttaactattaaagtgcctgtctgtgtaagttaggactgttggaggctgctttagcacttctcagggatgttccagcagactggctgatcatccaactgtgtaagacaaaaccattgaagtccgttgaagaacaggcggttgtccatttacgagtttcctatgccctccagggtcaaaacttaatagaatgtataggctatcttataggataaggaaaccctagaaatggatgtaattgggttcacaataactgaaagagtgttcattattactatttatattattatttataatttataggtagaatgtatattctttttttttttaattcaaaataattagccaggtgctgtggcatactcctttagttcagcactcagaaggcagaagcacaggactctgacttcaaggccagcctcatgtatagacttgagttccagaacagccagggctacaaagagaaaccctgtcataaacaaacaaacaaataagacaggcacatacatatgtacatgtgtgtgtgcgcatgcgtgtacgtgcactttttttcttttttttttttttgaaaatgtgactgttgcctagatactatttttaaggcgactggaacgtaggcacagattggtctcaatgctaatccctagggactgatgaagaaagagtggaaaggtggcctcagagctgctgttttgagacctttagttctggtcccgagggccatgatttgcctgcccttctgatgtaacatggcgttgccatttagtattgtgacctcgtagagtgagtagctagaacattctggtgtataatttttttcatctaatgaataattgggtgttttacatatttatgaatacagtgggttgtctttgggttttttttttgttttttggggggctgtttgttggttggtctgggtttttttctcccctccctctgaagagtattggtgaccttggatatagaaaaaaagattctgtctgtctgcaaagtcagctgtgaaacacagagctggtcagttacttacttctgttactgtcgtcttggtgtcccctccctccatgtcactccagcaaaaaggaagtgctactttcagggctaaccacacaggcaattgcagcacgtacctgtgcacagaacccatacatatcagggaagttctcagtgtcctgccttgttgagtgaaatttttttttaaagatttatttatttattatatgtaaagtacactgtagctgtcttgagctaagacaggatcactgctacaggatcactgtagctgtcttcagacgaaccagaagagggcgggtggtcgtgagccaccatgtggttgctgggatttgaacttcggaccttcagaagagcagtctggtgctcttacccactgagccatctcaccagcccccattgtgtgaaattttatgtaaccatttataatttgtcccttggcttggcagattttactccactctggcagaactatgtgactttcagatatcagtcttttcagttactcattttcttctccctcaaaatttttattgtattttgaggcagtctcgctgacccctgttccatccacagcttctaagaaatctttccagtgggtgtcagcagaaacatagctattctgtgcatactccatatcacagctcttgagaaagcaagcgcagtcacccgtatttttggagccttcccactggatactttcagtgtgcttgctgttcctctagttggcctgtagccctttctcccttggttccgtcactatctcccttctcattggttctgagctcctttgtgtccagctgctctactcaataagtagatgagcacacaaatgaggataaaaggaaatggaaagacacaggtggaaggatgaggtgttcccaaggcatagctcactgctatgtgctgtgcaggtgtgggtccgtgtgaatcatgaacccattgagtctgcctatagtttcacccatcccgtgacagacgttctgggcatttttattaacgtggttttcacagggagaggctcctaagattgagactttctagtcttggttatttatttgtgtctgctctttttcaggttatctgtcctgttgccggttcctggatgacaatcagatagttaccagttctggagacaccacatggtgagtacctgacaaggcagcaattgaggcttgaggtctgtctactgttcttgttaatactggttagtagggttacttcccattgcaagataaatgcttcttgatcataacctgacaattagaaaacaaagtatcaatgagtaactcattgcatcatctgtggatatgcaaagtttgattttgaacaaagaactaaaatgtagatatttaaactatagttgtatatcaagtacctggttttttctccatttatttttactcatgtatgtggtgtttttagccctgtggggttctttttcactgtaaaagtcaacttagcatattgtgagaatgagtaaagctttcaaacagcagctctgtcagatttgtttattttagaatgtttgcttactagtagatggagacacattcaagtaatttttccctttgtttattaatgaaatgaccagctggttattttaagagaatcattttaaacttaagctgcccttgtgggtttttctggtcgtgggagacattcctgggaggtcagtagcaatattttaaatttgatttagtagcatggcttacaggctggtgaaatccaacaatggactattgatgaaaatgttagccaggcgtggtggcgcacgcctttaatcccagcactcgggaggcagaggcaggcagatttctgagtttgaggccagcctggtctacagagtgagttccaggacagccagggctacacagagaaaccctgtctctaaaaacaaacaaaaaaacaaaaacaaaaacaaaaatgtagtcaggtggacagtgaagattagtcattacaaatttcaaattgcatgtgttgattattttcttggttgaaatatgtgaaacttttgtgctctgtgcttcttccttccagtgtccctcatgcctagcaaagataaccagcattcattgtagtgaacttggttgattggattggtgttgctgggtgagacaagctggtgaggttgacaagaatggacagtgtatcatgctgttgcttctgcgggttgcagcaggaagtagcctgactgccatttccatagccagctcccgctttatgtaatgctgatgatatcgtggcttttagccactctgtcaagcagaggcccttggaaaaccttgtacatccatgaagaccatctttggtttatggtcctcgttgcaagaggagttggagcatcagtttctctgagccacttatttacattcctagtgtctaggaaggtggaaaatgaggggatggaaagaataacacaggtgaaacaggctcctttctttcagaccttagcattttctgccatcccacaaactgcccatgattatcttgtgtgaaggacagtggctcctttgctgtagtgtgaggtaacctggaaacagcaggcccatatgctcatccatatggttgtttattgttttcattttcttttccttagcaaaatctcatcacagaagtaaatgtgtcttccccgtggcacagaagtcatctgtgattctgggtagtatagaggatgttgttctaggtgattggtcccatgtgcgtgcctgatacctacttttcatttcttcctgcaccagtgccctgtgggacatcgagactggccagcagacaaccacatttactggacacactggagatgtcatgagcctgtctcttgctcctgacaccagactgtttgtctctggtgcttgtgatgcttcagccaagctctgggatgtccgagaagggatgtgccggcagacctttacaggacacgagtctgacatcaatgccatatgtgtgagtttaaattgtctgctttagatctcaacctttgttgttgttgttgaagatttgggtttttttttagggtctggagagatagcatattagttacttttctgttgccggaacaaaaacaccatgatcaaggcaacctaaagagaaaaaacatttcattgaggcttacagtttcagagggcgaatccatgtccatcactgtgaggagcctggctgcaagcaggcaagcatggtgctaaagaagtaactgagagcttcatcttgagatataaataatcacaaggcagagagtgagtgagcgaaaacttggaatggcatggccttttgaaacttcaggcatccaacaaggccatactttttaatacctcccaaacagttccacgaactaggaaatgaagtgttcaaacttgagagcatgtgggatccattctcatttatatttgtgtctgcctgtctgtgtatctgtatctgggtgtgtgcatgcgtattagagccaagtaggctgttaggagacacctgatatagattgggtgaaccaaacttggttgtagtaaatggcttttaaagtacctttaaagtaccactacctttaaaaacattttttttcaaagtttgttttaaaatttgtgctctggttttttgtttgtttgttttgttttttctttgtgtttattctgagaaaaggtctagtagtataacctaggcttacctagaactggaagtctctctagcactaagatcacaggcaggcctttctaccaaaccaggttgtccttttctttgcaaatacaaccagagtcagagtgttttagaagcagctaaaaccctgtgctgtgcatatatttcagacactgatgaagccattaggtgccagctcaactcttccttttttttaagtgaccagtaatttagaggctgaatatcttgccagctaagggaatggcaaatttagaacttactttcttgctagcacctcctgaagagatgagtctggtgactagagcagtgacttgctccatcctccacaagtccctcctgacagctcgtgtccagaggacagaagcccttcagcagtgcctcagtctcattgcttttctgtactgaagtctgccttgttgacagtggcagtccatgagtactatgtcagtacccccctagtacatcccccattcactctaggatgacagcccttattcttgctggaacatcatcctgttttcctttccatggcagccatgcctctgcattaacatcatgtcttgttgaacatttacttttatgttagtatatataattcagcttgaccttgaattcactatgtgcctgaaggctgtgtactctattccatggttgattacagattactacactttttagcctcctgtgcttgtgcctgaactatgggccttacccacgccaggcaagtgttgaatcagctggcctgtgccccaggcctcattgtttacatatgtcttgatttgtcttctctttttagttctttcccaatggcaatgcctttgccactggctcagacgatgccacatgcaggctgtttgacctccgtgcagaccaggagctcatgacctactcccatgacaacattatctgtggtatcacatctgtttccttctccaagagtggccgcctcctccttgctgggtatgatgacttcaactgtaatgtctgggatgcactcaaagctgacagagcaggtcagtggccacatggcctttctgtgttttgggggcaccagcttgcttctttctatgtggtaaaatgaggttcagatgagctgaaatgtgtacatttgtatcatcagcttagttatgtcatagctcagcagaggggacagttaaaggccacataatttgagctctggcactccaggaagtaccaaaagctctcctgtgaggagaatgtgggagttgatagtatgccagataccactgagttcaatgttcaagtttcccattttgtcctgtgggtatccatggttagcctaaaacactctattagaccagatgtccttgaatttaaaagtcttctgattcagccttctaaatactagaattactggtgagtaccatcaattttcaatctttctgactcattctctgtagtcacttagcttctgacatattccaccatggacagctccatcttcagctgtctgagcctatctatacagctttggcatctgatgccatgccccttcgtctgtacaaggttgttgaacactgtgctggttgctggtaatgattcaatttaaagcctgaatttaatatgtcagaatcaagtggattaaatacaagctggacaaaagattagaaagtttttgtctcaagagtctccctttgagctcaagctggccttaagcttcaagttgaagagctttattacattcaacaaatctgctttggaggagggagggagggttgtgaccatgaatctcgtgggtcccactgtggctgcttataacccaccagactactgaattgaggacagttttggtggctcacacatttaatcccaagtctcagaagcatgcaaattctgtgagttgtaggataaccagggcctgtctcaaaaataaaaatcaacatttctgcctttgccattgtagcccaggaagttgactctgagtttaagagaaccttccagcccttgttcttagttggtacatcaatagctacaggactaaatgtttctgaagtttcaaacccttctgtgagagaaggggtgttttagcaggtgatgtgccatgtgacaatgggtccatgatttcaactgtaggctctgtgtaccctgtggttagttgttctgagtttactattcaggcttttggttttttgggtcattatgttttgttttgttttttttagagatttatttattgtagctggacactggtgggttatactttaaatcccagcacttggggaggcacaagcaggcagatctgagtttgaggccagccaggtttacagtgagttccaggacagtcagagctacatagagaaatctgtctggtggatggggtggatttatttattttatcaatatgagtgttttgcctgtgtacctgcagaggctggaagagggtattgcattcctctggaactagagttacagatgtttgtgagacgccatatgggtgctggaaaccaagctcagatcctgagacacagatggatgtttattcattatttacttgtttgttcatttgtattttctagacaaggtttctctgtagccttggttagcctggatcaccagatctgtctgcctctgtctcctgagtgctgggattaatccagcatgtgcgattaaaaggcatgcgccaccactacccatttttgtatactatcagctttttgttggtgtacaaaaattatcccaagggggtctgtgtttatgtccttgttcttcttagagaagaacatgttatgattggttgctctcttaacagaattgcccatacacctaaggatcgtttctacttggataagaaccttctccctttgtagtggccttcccttgccctcttaagtgcttgttttaccaaagtcttgtagcgttgttcatccagatgagcctcctgctttgtcacagcctcatgtgtgtttgtggttgtgctctttttgttctcaggtgtcttagctggacacgacaaccgagtcagctgcttgggggtgactgatgatggcatggctgtggcaacagggtcctgggacagcttcctcaagatctggaactaaagccaggaggtaatggggcagtcccattcccaggacatggcattttcctatatgggttatagatttacagagatcttgttgatctggcattgtagcagatctgcagtgaaggcccttagctgtgatgcagagaacagtgggaagagctcgggttctttctgtgtgcactgactccaggctctgttcacagcagcaggtggatggatgccatggcgactggaagaccattccaaccttgaatcgttacagcgatagcatatcctatccaaccatactaacgtggacacccacacctcccctcagaacttcaaaagggcaagatcttttttccttcacttattgctgaaaccaagagcacaattcccattaagagaaggatctctgtgctgtaaactaaacaaattgtgcattttttctggggccattgtttttggtttattttgttattttgttttgtttttgtttttttggtttcattttgttttgggttggtccaattttaaaaggaaatactacaataaaaatgttaaccagaaggtaaccctgagtgtgattgtgagagagacacgcctttttactagttcatttgcatttaaatcagtgatcctgttctgtggcattcatgaaaaacaagttgaagaatttgtttatctggaattgtttctaaatataagtcatttgtagcaagactttggaagcattctttcttaaacatattcctttatgttcagtagttaagagaaccagggcccacggcggtctctgacttgtcactgatgtttttttttttttttgtccctggcttgctttttttttttttttttttgtctcatgtcacagatgactgtttcgcacaaacacagcatagtggaagaaaaaatttcagaagcaaagtagccaagcacatgttaggatggccacgaatgcttggtcagagtccttccttcccttgctcagcagcggacttactcccagcgccttccctccctcctgtccctcctgtcccctcactgtccactttctgttctttccttgggtttcctgtgaagttggagggacgtttgtagtcatgtgacactagccgtcctgcccctgctgtcagagatttttttctccagagaggtgcctgtcctgtgcttggatagtcagttggttatttgtgtatgaaacaatgtacaaatcaatgttttgaaaataatgatctcagactttctaagttaaattttaaacaatttgattgtttgccatattgggtggggttactcttagaatcgcatgctgtagaaatgctctaaagtgcatataggactcagtccttagatgttctttttattttaagaaataacctcttcaagttgtaaccgtggcggctttgtccattactgttgctattctgcacacatatcggaagcagcaagcgctttacacacttgagtagtgggataagtcactgttttctttactttacaaaacaaaacagtcctgttgggaatgattgctgttggattctggaagggaggggaaagctgctctgctgcctctttgccacttcctggaagccttcctccctggaagaacagccttttgcatctgaggcgaccatttttacaccatgcagatcttcgtggttatcatctcaaagccatgttcagcagcagcgtttggacagcagtgttctgtgggccctcccctcccccatatcctgcaccccctcatagcagtagtggcttcgccattctgttttctgcagtgtcctgtacaaaactgtgctgtgactgtgcggtaggcctggacatggcaaagagaatacagcgaagccccttctcttcctaccaaacaactctgtagagctctctgcaccctgtacccttttcaccttttgtatttaattttaaagtcagtgtactgcaaggaggctggatgcaagatagatactatattaaactgtactgttatttaagatgtaataaagcagtttgacatgagggactctggtgtgatggttatttgagggtcatcttcagtgtgtgggggtttgccccaactgctgactcaacagttatataacgtcatgagagacccttataaaagtgtcagctcgggctgaatgtagtagtacacacctttaatcacaacactcaggaggcagggccagatggatctctgaggttagggccagcctggtctactttgcaaattttaggactgccaagcaatatagacactgtctcaagggacgtggggagatgggctcctgggaggtttctggtatatatctcaggtctgcagagccacatgtttatcacgacaagtggcctttcaccctcagcacctgggccctgtctgccgtctcctgctggaccagccagctgcttcgacttcctcttcctgcactaaaatgtctgaggacctgcccctccagagatactttcctgttgactaagcaccatttccttctctgtcgataaaggtcactgcatcttgaaggagcgagtatcaacccctgagttgttggactgccattccagcttctgacacccattccactgcagtgcctgcttctaagttttatgataaaaattttaatcttaaggttttttttgtttgtttgtggtgagtttttttggtttttttcaagacagagtttctctttgtagaactggctgtcctggaactcactctgtagatgaggctggcctcgaactcagaaatccgtctgcctctgcctcccaagtgctgggattaaaggcgtgtgccaccacacccggcttaatcttaaattttaagattataaaacataactgatcttcaggctcacatcccctaaacattgactggccccagccaccttgtttggacaatggtaagcaaacaaatccatccagggtcagcggtggcccctgataccacacattgtggtgtgatgggcaggtccagcagatgggatgggatggcctagtctaatcctctcctagtctccttgaaataaatgtatttttcaacacacacattttgcaagtctttacctacctcaacttccactgagaatgcaaaacatttgaggtccttctgatctagaaggtgaagctctgaccctaacttcaaattctctgggagtacatgtcttaaactgcttctaacctacctgacaacaagcaggccccaaatggactggggtagatctgtgtctcaggcctgtcctacttctcaaccaacatccaggccgctgcccacttgtttaacaagcagtcatggaagacatgtccactttggatatgtgggcagtattaatgaccaaagagcgtgcaggcttcacaaatgctcaggcttacacatctacatccaccattaaataccactcatgctctggaagctgaggtgcccgtgtgctctgtgtgttgctgcccatggtggaagtacacctgttgaagtgcacacaggcagataaggggctgctgctatattttagacccaccatgtctcatcattttcctccagcgtatgggctgatgccattccatgaccccaggattccaattcttctggcctgtaaagggagccacctcatttatttgccaaatactagaggctggaatcctgatgaaaggccagccgggtccagcttgtgccgtccaccgtttcctttggcgcctactctctcctgccgctctcactgtgctcctgtattctcagtacaacctgacaccaccagcattctgttagaccagtccaacccctcaccatccaagagcagccagcagtctttcacctctgcctcttcacacagggtgatcttgggacaaggtgtttgctctgggaacccatgaatagtctggcaggaattctatgagaacaaagtgcctggtgtgagattacagctggtgactatgtaacccactgttcccttgcctgagacatttctaagcaccctaggcaagactactctgcttgctgtatccaaaacgtgagtacctggcagctgtcccactgatttggcagaagaagggataaggttgcccctcacccaccccagtgaagtgaccctgatgatgacctcagtattggtctttacctatgccaagtgcactttcggagaatggacaagataactagtatcccatgacaatcaactctcctctaaaatacactcttctggctagctgtcaccttgtttaggtactggacagccttcacaaagcagtttatcccaccctggtcacatgaaaccaactttcctcttagtactaaggcaggacccaaagagctacaaagcctccctgatgcctgcgcctgagagcttacctgaagggacaccccccccccatgtgacaacctaactttgggcacaggcccatcctgtttcctccttgttcttcctcctcccttatcatttagcctttgaagagtaacctccaggtactggaggcctgaagcaaaaatgtgtgtaattgccttgatttcgtcctgctacctcactcatcccatgtgacctttattctgctgctccttgaagccagcccaaattaaacactctaggagtcttttgagtaccctcttgccattccaagccttgaccttgaccttggcgactgtctttagcacagtggtgggaatgagcacttggtatctgagtcttcagagtttgatggggcccagtaaaacatttcacaatgtcagctttgttccttcctcagaaatggagaagccacctgcataatctaggccttgcccccactgtgtaaaacagatttccctagcaaccactggacatctgctcttttaatttaaggctacacaggttacttggtatgtgaccttggactgcagaccatagactgggtgcctttgcagaagaatatgactgctcccactctggatgtctctccaggtctgctggccatgtgcctgccatttaccactagataccaatcaagtgttatataatacaatagcagcatagttacagccttcggtgggtgtggctggcgttcactctggggaagaagttaggcttacaaaactcatgaggaagttacaaaatttaagaaatccccgcaaattcccaccatcctccctacccactattttccgtccccactgcattgatgtgttctttttggaaggacagcacacaggtctcaggagttcccaccagagaacatcctgactgcagcaggtatggggggctgtggggaagcgtggagattgggctatacaggaagggcaatagtgtgaacatcttaaaactacagtgctgggagtcgggactgcgaaaacacctactggtgcactgtgcacactggtggatatcaatgcacgagcatgtccaccagttcagcatatccctggctcagctacaaagtcggtggcctccctctttccctccttacagctgtgggtgaggcacgctatttacacagtcgcttctcaactatcaagactttgtttttctttttgagatagggtctctaactatggtacccctggctggcctcgaattcctagaaatccggagctctcatctctgggattaaagtagtgaaccattgtatcaaccagctgtcaggtttgttactttcaggctcaagtccttgacagttgccaaagggtgtcaggtcactgctggtgggcctgagagccatatgagcgctgtcacccgagttctgcttctgaaagataccaggtccatgcgctggacattaagaacaacgtgggaacaggagcctggcacgaagcccaccttcccacaaagctggcccgcgttgtccacatggtcctggagacctcgccagcaaaaagcaaactgagtgtgacgtaggacaggaataaagatcagaccgcgaggcaaggaggcaaaaaaagaaagaaagaaagaaagaaagaaagaaagaaagaaagaaagaaagaaagaaagaaagaaagaaagaaagaaaaaggagagaatctggtggttttctctgttgctgctgggactgagctttttgcccctcctcggttactctttttttttttctttttttcttttttttctccctcacccctctgccccgcctccccttccgccccgactcctccaccctttggccccgcccactctcccgatcttccccttccctccggcttagtctccttagttccgtccctttccagctctgccctcttgcgacctgtccctcccactctgcctgccccttctcctaccccgtctgcccctcccctttctccaacccttggccccacccccccgggctgtcttccgctccttggccccatcccattccgctatgccnnnnnnnnnnnnnnnnnnnnnnnnnnnnnnnnnnnncaccccccagcctctgatccttggcctacaaagggttttgaaaaacccgaagtttgcgtgcacgcctgtgtaggtgcggctgcgccgctctccccacgtgccctgcagcgcatgcgtgcgggctgcgcttgcgcactgacagccgcggcgcagcggggcttggtggtgccggtctctggaccgagcggccatggggtggcgggcggctgggtcgctgagagccaggtagcagtagggcagcagggaccgcctgctcggcccagcatgtagacgtccacgcgggcgcgcggcagccgacggtgagtgcggggcctggggtcgccctctgcccggcgtcactggccgggacccgtgaagacagggtcacggcgccggccctgcccacctgcccgaggccgggcgctggtggctctgacgcgcctccctgcgtccgaacgtgggttgcagccaggatgacgcgtggtctcggggaaggagcctaagggacaggtctgaagatctggtccggccttgggtttagggggacgagtcagaggttcgggtcccgggagaagccatgtaggccgccgttctgttctaagccagttcagcgcgcagcaccgcagccgaatcggctccattggtcttccagtggggccttagcaagcgccagagaccttggcatgtgggcaaagtagtcagacgagcgttttgtaagcaatcgaggtgtgaaactctccaaaaccccatcgtaaacttggtatccagtacttgccaggagcttccaaagtcctgaagagtccatggagatgttcctagaggctgctgcctctcaggatgtcacactcacaggccgcttgtcttggcctctggcaggtttcttcgttatgggaacagggcgtgcccagcgcagtcccaggatctgcctttgcttggccaagatccggcgtctctttccagctctcccaagcaatgggctttctcctggcattgattctgaatagcgacttgtttttcctttcttgtttgggaaactctctgttttggttcaaaacttattcgtttggcttgcctcttgagaagagtgttattcaaacttatattcattggtttcatgtatcactgtcagtttccacgggccggaaagctggcatcctcgccttggtaattaaaagcacggcaccttccctctgaacgtatttgtcctcagcagtgacttcactgtgacttacactgcccatcttgggctctgggacagccacgggtgccaatatacagtatgaccaggtagcttcttcatttggaggtggcatctcagaatgcttctgcattttcttctttgtagatttatttattaaaaacgatgcagttttattcattttttttctttttcatcttgtttgaagtgctacaggtccagcccagatcctcacacaagtgctgtcccactgagccacaatccatcccccacccctccttttgggtagaagtggctaacagataaaacagcagtacttaaatgaatagtttagctctctaggcatcacttggagatggagagaagcaagtggtggttttttccttttttttttaatgggagtggacacttgctactctactgctcatgaatggaaggaagagcttccaagtgttggttttctcctcctgctccatgggctccatggatcaaacccaagacatcaggcttggcagtaagtgcctttgtctactgagccatctctctgatccttcctttgtttttagacataactttatgtatgccaagctgatttctaattccctgtgtagccaagggtgactctgaacttcttgtcctgtatgttcctctgcatgttgggattacaggcatgaaccaaaccatatccagttgggctttttcttgttttaatgtgatgttgggatgaagcccagggctttgtgtgtgcaagcactgtaccaactgagctctttttcaagccttgggtggtttcactctttttttttctttctttctttcttttttttccagggtggaggatggagttcaagacagtgtttctctgtcctggaactcactctgtagaccaggctgcccttgaactcagagatcccctgcctctgactcctgagtgctgggattaaagacgtccgggcaccaccacccaaagtcctactcttaatgcttttttttttttttttaaagatttatttatttattttatatgtatgatgcaccagaagagggcatcagatctcattacagatggttgtgagccaccatgtggctgctgggaattgaactcaggacctctggaagagcagtcagtgctgttaaccactgagccatctctccagcccccactctaagatttactttattttggatttatgtgtatgcatgtgtgtttgcgtgtggttattatgtgcacacgagtatgtgtgccttggaggcaggaagagggtgtcagatcccttagagttggagttacagatggttgaaagctgccggatgtgggtgctgggaaggaagctcaagttctctgggagcagcaagagccttgtaactgctgaggcttcgccctctcaggtgttgggaatggattcatctccatctttaccttgaatctgtctgttttctggtgtcgcagcaagagggagatccgtgcaaaatgctcagcacgcggaggaggagccttgggaggacaagaggggtgggctttgatctcaggctctgctttctaggacttgtgagatctgtttacagttaccacatggctcctgccctcctgaaggcagaggtgtcgctttcaaccccaggaaaccatcctaattgtttgtgatagttgcttagcttatcattgtcctctattctgatccatggcacctgtcctcccagggctactgcattgggaacaagttcgtgaaaacaaatgatcgggttaaggcagagacggtactagcaatgtacgccagtgctgtccacggtgcagtggaaagggcagcagcgcctgaccacttagccttctagaccagagtgcctctcttgggtctgtgaaactattccaccactagatgggttctgtgatcccgttccttagaactttccagaaacagcacacttctctgacctgtctgctagcttgggtatcatttatttgtagaaatgaggtaggtattaggtaatcactaaacctggactctgtggctcacagtagtgataccatcatgtttgatacagcaacacgttgtctcataaaacaaatgaacaagaactggaaacttttccaacttggtattaactaatgaagttaaacatttacctgttgctttcactaattttccttctttttattttttttctctccatttcttccttcattccctctattttcaaagactcagacttttgtcacacagattgcagtcttcctcctgcgtgctgagtgcttgggtcacgggtacgcaccaacacacctggcttcgcttttcatttaccgcttctacatatatttgaagttcacatggaattgaacgtttgtattacgtttcttgggctgactctctgtgtgttcatgcctgcctttggttcctgttgtacatgagcttattgacattttgatatctttcttgctactccatgatggtgactcagttccttttccaagccagccaagctactcaacaatgaaaaaaatcccaacagggataactaagtgcactcaccccccccagctacctcagcacctgataatcatcttgcctagcctttgtttccgcttcactttctagaccttgcttgaagagttacctagggaaaggttggcgacgaaagaattaaataatggaattaaatagaattaaaaacagaggaggagggatgatgggtcagtcctagcaaccacccgggattcactcccagggaccctcagggtaagaggagggatttaggggctgcccttcgattgccacgggcagattgtgtcatgcgagtgagcatgtgtgcaccaacccataagtaaatacgtgtatctgtttatttacttaattgggttttttttttcttttaaaaaaaaattgggggagggggtgttgggatgttcaaatcagggtctctctctctgaagccctggctgtcctagaactcaatctgtagaccaggctggcctcactttagagagccacctgcttctgctgggattaaaggcttttataccacgatctcctggtttat

SEQ ID NO: 1248 - DNA, 1410 bp, Mus musculus
gcttggattctgaagtgtggaaagcactgagacgtgaagatgagtgaacttgaccagctgcggcaggaggccgagcaactgaagaaccaaattagagatgctcgtaaagcgtgtgccgatgcgactctttctcagatcacaaacaatattgatccagtgggaagaatccaaatgcggaccaggagaacactgagggggcatctggcaaagatttatgccatgcactggggcacagactcaaggctccttgtcagcgcctctcaggatggaaaactcatcatctgggacagttataccacaaacaaggttcatgccatccctctgcgctcctcttgggtcatgacctgcgcatacgctccttctgggaattatgtggcctgtggtggcctggataacatctgctccatttacaacctgaaaactcgtgaagggaatgtgcgtgtgagtcgtgagctggcgggacacacaggttatctgtcctgttgccggttcctggatgacaatcagatagttaccagttctggagacaccacatgtgccctgtgggacatcgagactggccagcagacaaccacatttactggacacactggagatgtcatgagcctgtctcttgctcctgacaccagactgtttgtctctggtgcttgtgatgcttcagccaagctctgggatgtccgagaagggatgtgccggcagacctttacaggacacgagtctgacatcaatgccatatgtttctttcccaatggcaatgcctttgccactggctcagacgatgccacatgcaggctgtttgacctccgtgcagaccaggagctcatgacctactcccatgacaacattatctgtggtatcacatctgtttccttctccaagagtggccgcctcctccttgctgggtatgatgacttcaactgtaatgtctgggatgcactcaaagctgacagagcaggtgtcttagctggacacgacaaccgagtcagctgcttgggggtgactgatgatggcatggctgtggcaacagggtcctgggacagcttcctcaagatctggaactaaagccaggagcaggtggatggatgccatggcgactggaagaccattccaaccttgaatcgttacagcgatagcatatcctatccaaccatactaacgtggacacccacacctcccctcagaacttcaaaagggcaagatcttttttccttcacttattgctgaaccaagagcacaattcccattaagagaaggatctcagtgctgtaaactaaacaaattgtgcatttttctgggccattgtttttggtttattttgttattttgttttgtttttgtttttttggtttcattttgttttgggttggtccaattttaaaaggaaatactacaataaaaatgttaaccaga

SEQ ID NO: 1249 - DNA, 1023 bp, Mus musculus
atgagtgaacttgaccagctgcggcaggaggccgagcaactgaagaaccaaattagagatgctcgtaaagcgtgtgccgatgcgactctttctcagatcacaaacaatattgatccagtgggaagaatccaaatgcggaccaggagaacactgagggggcatctggcaaagatttatgccatgcactggggcacagactcaaggctccttgtcagcgcctctcaggatggaaaactcatcatctgggacagttataccacaaacaaggttcatgccatccctctgcgctcctcttgggtcatgacctgcgcatacgctccttctgggaattatgtggcctgtggtggcctggataacatctgctccatttacaacctgaaaactcgtgaagggaatgtgcgtgtgagtcgtgagctggcgggacacacaggttatctgtcctgttgccggttcctggatgacaatcagatagttaccagttctggagacaccacatgtgccctgtgggacatcgagactggccagcagacaaccacatttactggacacactggagatgtcatgagcctgtctcttgctcctgacaccagactgtttgtctctggtgcttgtgatgcttcagccaagctctgggatgtccgagaagggatgtgccggcagacctttacaggacacgagtctgacatcaatgccatatgtttctttcccaatggcaatgcctttgccactggctcagacgatgccacatgcaggctgtttgacctccgtgcagaccaggagctcatgacctactcccatgacaacattatctgtggtatcacatctgtttccttctccaagagtggccgcctcctccttgctgggtatgatgacttcaactgtaatgtctgggatgcactcaaagctgacagagcaggtgtcttagctggacacgacaaccgagtcagctgcttgggggtgactgatgatggcatggctgtggcaacagggtcctgggacagcttcctcaagatctggaactaa

SEQ ID NO: 1250 - DNA, 50396 bp, Homo sapiens; identical to SEQ ID NO: 1247
  misc_feature (2660)..(2731): "n" at positions 2660 thru 2731 can be any base
  misc_feature (46151)..(46186): "n" at positions 46151 thru 46186 can be any base

SEQ ID NO: 1251 - DNA, 3088 bp, Homo sapiens
atgggcggcgagtggggagcggggccgggagtggagcagccgccgcggcggactggaccgagcctcgccggcgcgcacctgcccgcagcgcccgcggacgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatatgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagccaaccgtactaacgtgacaaccctacacctcccctcagaacttcaaaagggcaagatcttttttccttcacttattgctcatatcctatgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacaatgcggggacggtctcaaaatgcgtgatcagagaatccttcaccttatgctgaaaagtgagctcagatccacctccaatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaagttttaaaaattttgattgtttgccatattgggtgggtttactcttagaatcgcatgctgtagaaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaaagttctgttgcaaacgactgctgttggattctgagggtggggagggagagagagggagggagagggagtgaagagcctgccctcctatagtggattcttcacgggccctccacatctgaggtggctcattcccatcacacacagattgtcctggtgttcatttcaaggccagttgtcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgaggg

SEQ ID NO: 1252 - DNA, 1023 bp, Homo sapiens
atgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatatgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaa

SEQ ID NO: 1253 - DNA, 40545 bp, Mus musculus
  misc_feature (435)..(454): "n" at positions 435 thru 454 can be any base
  misc_feature (5796)..(6304): "n" at positions 5796 thru 6304 can be any base
  misc_feature (8692)..(8987): "n" at positions 8692 thru 8987 can be any base
  misc_feature (18464)..(18526): "n" at positions 18464 thru 18526 can be any base
  misc_feature (26666)..(27403): "n" at positions 26666 thru 27403 can be any base
  misc_feature (29717)..(29995): "n" at positions 29717 thru 29995 can be any base
  misc_feature (33859)..(33878): "n" at positions 33859 thru 33878 can be any base
  misc_feature (40256)..(40275): "n" at positions 40256 thru 40275 can be any base
ggagccaaacagccccttttctctacttacaagccaagcaggggcctccagtgttccattagagtgatggagacccaattaacctcacaggcagatgaggggtgggcacacctctcctgactgctggccagcactcttctcatgattccattaatccaaagacattttacagagagatgtttaggaagtataccaaatacaatagtttattgaccacatctccctttttcagtagccacactgaaaagcgccatgtttgtaattctaggaacaggtatcttgctggctttccctgaagcagagagtacccaaacaattagggtttctgatatagtcaaagcatcaatattgaatgagaaaaaaaaatgggacctagatatttcccctgcatgtcgctagatactaagacatgtcaaaaagagagagagggagggnnnnnnnnnnnnnnnnnnnnaaggaaggaaggaaggaaggaaggaaggaaggaaggaaggaaggaaggaagaaggatcctgtctaaatactgcaacgtggtggaatctgcgccattcttttgccaccaacagacctgacactgtgtgagttccacacagctcaaaattagcctcccttaaagaggctcactcaggctgtaaactgcctgtcacttaatcacttggaagaggatcttcaattcagaacccactccaaaacaggggtatatgctctaacaggatctgtcctgaacatgccaggatttccttaaaacatcccagaataacattatattccatacatcctcattctcaatatgcctttcagacttgactgtattctagtggccagggattagacaaagactactgcctctcagcagacagcaggtgaaaatgaataagaagactccagctgtcaaatgaggttaagagtctacaaactagtgagggagtgagaacatcggcaccgtttaagatctttatataaaagagagactacacagacgctgccgatgctgtgtggattggagtcccattttgtcagtgatggtaagggtgggtgatggtaagggtgggtgatggtaagggtgggtgatggtaagggtggtgcctacagagagctgaggagggatgtaaagatcccttattacagccagtggattctgtggatgagcaaactctgtcttggggtcacaaacgccaaccctaaggtcacaatagtagttgaggggacaccaggaagcagaataggagacctctgacttccaaggtagcgctgtctcacttacatgctgccgaggacaagtaccatgttctgatgacatgcaagctactaagactttctgccaggccagggagatggctcagtggttatgagcacagactgctcttccagaagacctgggttcaattccaagcacctacgtgatagcgcccaactatctgtaaccccagtttcaggacatccaacatggccacacagacaaacatgtgggcaaagcaccaagcacatgaaattaaaataaattttaaaaaatgtagtcttaatttaatctttaaacagggttggctgtgtctgtatgttgcaggatgagctattttaacctcaagtcacccctcaaaacaagaatggtacactaattaccatcctgtcagcttccaggacaagcagacactccgaaacacacagccactcaccaaaaaaccaggacgctcacagaatgaggggccaaagacacaggtcatctttaactagtctcaaaggactagttttcaatgtttgacatctcccatcctggtctctgctgtgcctctaacagattacaaattaagaacatgtttgcagagtggaattttaaaaccactgcataacccaggtaatagttcctggactcagtctaaagagaagacactgtatctccctggtacgagttactcaggtcagcacagtgtctccttctaaaccctttgacctacagactcattctggttcactctgggcattgtgcatgtcaggaaaaaaaaccactctatgaaacagctactctcatacccagactttattattttaaaataccactcattatctaatatgttaattctttcccacatgtaatcactagagaatgcactacttgactccaggagcccttctgtcaattcttttccttcatatcttccaacacatttactgactgtctatcagctatatgcccattatatcttaatataatatattaatatatatattatatccatagagctatccctgagttcagcttttagaaagatccagttttaatcaaataaatgaagtgcaaaagccagatgcatagaaatctctgccctgtcagctcatccattaacaccactcaaattctaccttacaagtccaaattaagccgccggcgagccctactgaatttgcacatagacctgtgatgttatcagcccagcacatatgcgatctctcagcatgaataaccctggcggatgctatgtaaaatttctacaacagactcctgaactcgggggcatatttgatgactgcccaaaacctcaggaggtccagccctaagcaagactgcatctaatctatggtccagatcaacgcttgtcttccgccaagtgaagcacacagtctgccaggcaaccttcagtgactggaggggaggtctaactctgtttctcaaggtaagtatggttttcgtctcaactgtaacaaatttcatgagtgttcctttcccgactcacttagagcctttgatagatgacataaaatctctggtgattatactacaaagagtaattatgtgaacgtttctcgtactgaagcaagtaaattggagccttattcaaaattctgccaaggaaattttaaattaaacacactagtctattctcaaaagaaaacagaagaatgtcttttcaggagggagtagggggcacaaaggtagttcttcttcagtttaccatgagacagtggggaccaggggctgcatctgacacaattaaaggtcctcagttgaatggtgtcagtgagaaccccacacatggtggcccgcagactccagcctcgatggaagtgtctgccatcgaaaaccattgtgttttgtggtttgtttttttttaaagattaagatttcagggtcctgaaacaattggtggccgtgggatgctaagtgtaagacatttcatgaggaacccctggcaaatcagcccaaaccctttgcctcacaacaccctttctgataccagggtagggcttgggtcctagtgtcggcatttccccattctactgactggctgctctcaagcaaacggaaacatacgtgggcatgatgaaggaacagggttctggaaataagtcaaagacattctcttactcatttaaaattctgtatgggttttctttctttcctttctcctcttcatctaggttgtgggtgacttaggtttcaaaaattgtcagaactgaatgttcttggtgctatgccctccaacaaaaacctaaccatatggtgataattttgaagcaaggaaggaagtgaaggcccctacatccaatcactgtgagaccgagactctctcctatcccttgtcaccatgactaccataactagcacacactggggcttgaagaagctgcctctacatgtcacaaagtcatctgacttacagccaataggaccacaatgaagagtgtgatctgaggcacttgagagcagagacatatttgaattttttatttttctgctctgatttcatccttcctacagagccttctgctccaggcttgtttgcacagcacatagacactgactgtcaaggtcatgcaaaggctgatgctctgacttaaaacggagccaagaggacatacattcctcataggggtccgagctagtgtgggcttagcttagcatacagtcacaaactgcacccttccaggatggttccagagcacagtttcttctccaaaggtgtacattttgaagaatgtaagactttgaaaacacccagcttcaaaatgcaaaactcaacctttcttgtttttaaatcctggttaaaaaaaaaaaaaaacaataccaagaaaataattttagaagtaaatttcaacctgcttctagaaaaaagggtttggaaaggctaaaagttcaagaagaaaatcatttttcctttaataccactgaattaattgcagaagggctggagagtgaatctggtatactgtgggattgtgggtaaactgtgctaacaaatgctgacagttcttatgcttaatgattgaaaaatatgatagaaaatagaaaatactgatgagaatgttttatacggctgcaatttggttgtagctgatatattgatacatagctcaataattacaataaaatagaaatgttcagtcacagagaaagtggatgttttttcagaggggaaaatgtctgcatttgaacaaaagtaagtatttagaaaacaaataaaatttaacttttgctttttaaaaaatctggtacgggtagtgttaaatgttttacagagagaatgtccacaatttaaagtgtcaaatgaagttgaagcaaaatttaaaggagacctgtcttttaggttcttaaacacttccttcagtacttttcttttaaaaatgtttaatactgtattctgtttttcttctttgtatacacaaaataaatgtttatcacattggtcacctgaaatgagccattcttcaataaaggtctcacacactgagcctcaaaagcaatttattgacatttttattaattataattccacccctgtcccagaagtcacaaaacaaagctgcttggatcagactagcaatcattaaacgaaaaagaactaaataataagttaaaaatagagaatgtgttcaaaggaagcaagaaagtgttgctcataatctctctgtcctcttcaaaatagacacctttccaagcctcacctcccattcaaactgaaaactccactacttttgaaacaaataattccacatcaagtccatttcaaaagaagcccctggctcctcccacaagcccctttacctcgctgaagttaagaaaaagtcagagcccggtggcatttttctccccagcacccactctgcagctccttcaatgtgagcatctactcgtcttaattaccgtgggcttaaaggaaactgacacattttagcccccatgcctccaaactgaaagattgaaaagattttgtccaatttcaggggaaacggaggtgcgtgggctcaccctgtagttttcaacccctgcagtctctctagaaggttctccacaagtacggatgccacgtgggtatccagtgagtgggcggggagtggccctgcactttcgctcatctctggtcttctcacaggagtgtttatagataggttagctggggtacagcaaaatccgtgggtgaaatgttcccatacatccccaggagcttgtgtgtcaccaccataagtaacgaattcagcgtatgtttagagtgtggggtgaggcagggacgaataggtcgcgcgtgaaaaaatcccgcgtgtgaatatacacacagaactcttttctcaaggagcaaaaaggtacaatttcgtcttcccgggtggagactggcttaggaattcccgggcggccctcgccaccagcaatcgcgatactgggacggatctctgggaccagaagaactggaccgcaaactaaagaaaccagccttttctggagcaaacggcgggtctccatgtcaaagtaaaaatatatatatataaatataaataagtgtgtagggagggggaaaccattggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaatcagacaggaagacgggaagtttgggtctttaactttttttttttttttaatccaagggggagatgcgaggtgggtgagccgcctgcaggccctggcttctgaatccattcccagcttatcctctgccacgagggctctacctgggtccgcaccgacacccacccgagggtcgctacgatgcacaacctgggagattgggttcacaggtctgctgtcgggtggctcctgagtatgctttttgcactttaggccgcttggtcccggtgtgggagcctccagcctgggctcttcatttctcaactctgccccaccccctcccctttcttgcagtttaaaccgggttttcatgtcttcccccactaatctttctgagccttttcttccttaagcaaccatcgggtctgggaggtttgattgcctgaccacccatttgtccatgaagtaacacgaacagtgctctattcttccggggagccagggaagaggcgatgacccccagttcctggacggagatgtccctgctccgaggtgacgggatccgaaccagcagcacgccgggttggagcgtcctcagggtcacctggctggctggtatccgccaggtgagcttgttagaatgtgtgcctaggtggcaggttcctgcagaaatatgcctataaacacccaacacccggctgcaccttacacctacaggctttgtacactttccaaccgaaactgctaggcgcaagagggagggagacgggagggggcacgtcctggagggatggaagttcgggaaaactcgtatttggctgaagtttatcactctacctgggtcctacccagtaaaggatctttccaccttcgggggtttaaaaaaaaaagtagtggtggggagaaagagctcttattaatcctggcgccacccccgcagcagagcacactcgtgcttctgcacacccgagtccacacgcaaggaaataagtacacttgcccctaaggcataccggcttttcccatgtgctagctggcgcactttttatttaaaaaaagaagaaagaaaagaaagggaaaaaaagaaatgaagatttttcaacacgtggtcagagtggcaaccgacagagaaaacacagtcccagtcccaacctctccagggacgtgctgccaacctccgcaccctctcacgccgcaccccacgtgcggactcgcagcgacgttcaccttcgggaaccctcattagtaggagggggaggaggatgggggaagctgacgcagagggcctctcctgcaggacgcgctttaactttcccatctccagacagaggggcctccgtccagcgaccctcttcccccctcctccgcagccctcccagcctcaggccacctctcccacccccaagatcccctccccgctggaatttcactgcaaagccaagagtgggggatggaagaggcgaggggccctccgctggctctgggagaacctgccacccagactttatcctccgggtgggctagccccgacgacgaccacccgcctcttttccgcccccgagctccggatgctgtcttcactggagatgcggaggagactagccttcgagtgggtgtgggggaataaaaggatgccgccccccctacccccccccccgccgcccagcttctctgttgaggtagatgaatacctcagtacagctctgacgccccgtactttgtgcccctctgcaggagcagtgtcagatctgctccttggaggtggccctggggaaattttgagtaattgctttatggggtcataaagcataaattcatatatctgtgcaggataacaccgagacctctattcgggaaacccatcttgattaaaccccacaggtgatggacagagtgcactagacaagcgtcaccttgggcgcaggacggttccgtcttaagttcgcaacttgagtttttcaatgagttctcccccacccacctccgaaagctaatggcttccattgcaattacacattttcctcgcccgccccttccctcccctttctttacatgcagtagattggatactaattcccgctgccattgatagggtccgaggagcccaggcccctgtgcgggcctagcccgcccgggtccccgctctccctccgcccttcccgggcttccttttgatgtagcggagaaggcttcctactttaaaaaaaaaaagtaatctgcccggtaacaatcagcgcgcagtagcaggagccccagagctattggctatgcaaatagagggaggggagacggcgccccaaactcatactcacccttttaaagtgatatcccctccccccgcccaccccttccgccccaccctcgtttaaaggggctggcccagggctggagttaatcgcttgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcggggattgaggggtgcaggactcaggagcccccggggaaaggaagggtggccttgctggcgcagggagagccaaacctaaaccctccctctccccctccctggcccctcccgagccatttcctagaaagctgtatcaatgtggccacgctccgcgcagacacctagggcggcttgtcagcagatgcaggggcgaggaagcgggtttttcctgcgtggccgaggcccgcggaggaaccgctgctagccctgcccccggtctggggccgctctgagaggctggccgcgttgcccaatggcgcccccaagaacagaaaggtttctgcaggagggtcatattctactaggcttaagaagcacccctttctccaacatccaccccttcctcctcttcctctccacgcacgtggctcggggcggacaacagcttgaaagttatcaggagtctaagcttgaggggcataacctttatccctggtttggcgaggttgcaattttctcaaataagcctttccttgttcctcatttaggggtctacttctaagttatctgaactcatccacatggtaaatctatctacctgaatcttgaataatgggctgtttttctgatcacattgcaagcctccgaagttagagagcacacacgtacacaccctttatgcccccatggtatgcctacagaatgtcagaaaggataatcaataggaatccatggggtttgtgggttcccctatccgaggcccctagcatgcggggctggatggggagagggcctcggagaagtagggagaggggttgggggtggggagcggggatcgtgtttgaagtttggtcaggccagctgctgtgctccttaataacaagagggaaggggggggggagagggagggaaagattgaaaggaggggagggacgctagaggaggggaggaaagggggaggaggaacatgagagggggaggagatctaactgcccttccagcttgcgtcactgcatgagcgagagaggagagcgagctgaggagagccgggcagttcggagggaaggaccggtgcgagtcaggcggcccttgaggctccgctcgcccaccttccactcttctctctctctctccctctctctctttgccatttctttcctctcccaaatctcccattcagccaaaggaaggaggtaagggaagcactccccgacccccccgcacctccaaaaaataataataataaaaaaaatttacagtcgggaccgagtggtggccggctggctatggagctgctgtgctgcgaggtggacccggtccgcagggccgtgccggaccgcaacctgctggaagaccgcgttctgcagaacctgttgaccatcgaggagcgctacctcccgcagtgttcctatttcaagtgcgtgcagaaggacatccaaccgtacatgcgcaggatggtggccacctggatgctagaggtaggtgtgcgggcgacgctctcagggagaggcaagcccagccgctccatccctacctccaacacgcagagatcctaaaaactgcgggagaactacccctgcgctggcctcccccgctcgtgcgcgaggtagccccgcacccttgggcgagacgctaattctgtcccttgctagattaactagtggaggaaaacttgggtgagtgaggatgtcctcccccccccggggggttggcatcccgcgcgtgtgcctgcatgtggcttcctcgtcttcccatctccatttctgacctgtggtgtggaagcaaccccggctgccttcagtgaggccccagagggtgttgcgacctaacaatccataccaacatataaagagcccccccccccgcccccgactctcagggttggggcaaaccgtctgagccttaggactccgcgttggcactttggcaggaggtgggggtgggggagaaacagggaattcaggagagccccggaagtcatactgaaaaaaacgtgcgtttagggcaatctgaaagaaccgctgctttagccttgcttgcaatctttgccgagagagcagggtgcccacgtatgcacagctctggacctgccgtggtttcgccatgttgctttgcaaactccatttacaaggactggcaacattcgccggcgcccccaccccctctcagcaccccatgatcctgggcaccctctttctgatcgtgccctcttccccagccctcggttcaccaaggttacttacagtttggctgcttcttgagcgcgcagatttgggtggggtaggaagcgggggaggaggtgtgtagagcaggctagggggcacccccaaatgagaggtcagagtcccgcatgcctcctggaggggggttccctggtttcgtctcacccaacccccagcaggcacagccttcctagctactgcccttgtgggccgcagccgaacactccgcaagtttcccccactgagatctagagcccctggggtggagataccgaccttacggacacccgaaacctcttttccagggagcctgggacctctctggggttttcaggcccacagagcgtttctaggattttccctcgatttttaataattttttgaaactgctcccccctgctccgactccaactgcggcggccggccgaggcgcgcttcctcctcctccctccccctctctcctccacccacccaccgaacagcggcccctggaccgccgagaccaccctggacatttttttcaattgtcgggaatggtagaataggatctgaggatccgaacgagaccaagaagtagactttcggagcttccagaatatttttattgattttttgaaaagatgacgaaatccaaaaaagagtgagttggtgtgctgagaagtgagccagagggaacggcaggcggcggcggctctgggctttgcctcggggtttgtggaggttttagttcatcacctttttcagctttgcgggaatacccgaaccccaggagcccttcggatttaccccaccgttctcatctctattcttactatcctttctactctcctccccctccccacacacacataaaaaattctttttgttatctcagattatgcttttatttttcttttccctctgtttctgatactaatttttccctatccccctcggaccctaccccactcttgattgtaggtctgtgaggaacaaaagtgtgaagaagaggtctttcctctggccatgaattacctggaccgtttcttggctggagtcccgactcctaagacccatcttcagctcctgggtgcagtgtgcatgttcctagcttccaagctgaaagagaccatcccgctgactgcggaaaagctgtgcatttacaccgacaactctgtgaagccccaggagctgctggtaatgccgccctccctgctcctgactctgcccttccccatcacactaaggccgccacactaaccaagactgtaagaaaaaaaaaaaaaagatgtcctttagtaggagagagctagtcttcccacatcaggtagtgagcaaagctatcagtgcctcatggaaattcatgagggtgaaattctgttgtgtgtgtgggtgggggggggggcataaatagaatattctagttaatgatgttataattaaggtccagatttccactgaaccctgagaacacggtctgatttctcacattctagtttgtgttgtttcccaagaccctggaggtgtaacaggtaatgtcttaaagaccaataaagtctcatggacaaacatagtagctgatcactaagtaccaacaaagcactaagtatgaacatattaacttggatgcaaaatcaacatctgcctttctattggtggatctgaagcatgagagttcagctccaaaaggcacagtgacctggatacagtccccagggggtcctgtcttggttttctcccaaccatctacctttttttttctcatgcacttccccctacccccatgttaatgccacacactgaaggttctgcagctctcttttacagtggtttgcacaccttgcactggtgaaagaagaccaccccctctatcgactccctcccccttgctgccattgcctgggcctgcttaatctcctgggcaaagactggcttcttgaactgagccctttgtgaggagccgtcctttctgggtctgtgctgccacctagtggcagacatgtgcaaggctgggggaggaattgcctagaacgcaaagaggggcctgaatgacttcacctttgaaacactgccagatttcagctgcttctggtttggtgtaagaggcccctaaaggtgctttcttctggaagatctgcttctttcaataatggtgccagaggacgagtttgtgctcacattgccctggaagaaggaagggtttgggattcaagccatttctgatttttacgtagttaaggaattttttttttttttatcctaacttcctgcaaaaaacccaggcagacttgaaagcttgtggggaggaaaaaaaaataagattagaattggaggccagcttgtctattcaaaaagaaaaaaacaaaacaaaacaaaacatgaaaaagaatcttctatgtgtctggtgtgctggaggactggaggtatttttcaagacaccctaatttttccaggaccggcaaagctaactcaattctccaaataaagtgtgccagcttcccatctcctcccatccataagttatgcaccctagaagaaccttcctattttacacgtgaggggagcttgctccaggaaacaccatagctggtccagctgacaggggctttatagccggtccccaagtttagcagatggagccaggtgaactgaagagtcagtcactgcccggcagtagtagcatcctgcgcttttgaatcctactgattgaccaggatcatttccttttgtttgcacccccccccccaacgaaaccaaaacaaacaaaaattgggacctttgcataatttcaagctagcctcaaacttctagccttaaagaggtagaatcccagacatgcacttccaggtgtgcatctctttggggtattattatatttagtccagttcatttgaacattattccccatgtttattttacaaaaggagaggcacaaagtagcctactagtggggtgcagtggagccccctaaaagagaccgttacagcccagtacatgggctgaccctgtttaagcacctccacattgccccaaatcatagtgtgcaaaatggagtcacaagtgaccacctcaggccctttagccatgaagacaaaggccagtgaagatttaggtgaaagggtgagtgtcatatcccaagacttcttcatggtgtgtcaaaggggaaggtgttggcagcagagagggaaaatgatactcttcccccacaaggaaaggccagcgaactggctgccaaggagttgggccaaggaggcttctgctattctgcatctgtaagcatcatttttttccatgaggagtaaagagacttagccaacaaattctcaccgcagcaccacagtggccttagctagatcttactataggcccacctttctgagtgggcaggcaagaacattttgtggagtcaggggtaggggtgaggtaggaagaaaactagagtaaaggctggtcttggcagtagttacctggcctctcattattttcagtggagcctgacttttttttagcccaagaagagccaggagcaacttcaaagcatgaggggcacagtgacagatgaggctgcagtggagccttaaggagcatcttcagagctggccgggaacccagcccccaacccgggcctggagtcagtctatggattcttagagctctgccctcttcctcccaccctttgcaggagtgggaactggtagtgttgggtaagctgaagtggaacctggccgcagtcacccctcacgacttcattgagcacatccttcgcaagctgccccagcaaaaggagaagctgtccctgatccgcaagcatgcgcagaccttcatcgctctgtgcgctaccggtgagagggggctcacggggcttccacggggccatgggaggtggggttgggtgtctaggcaagtctgagtaagccagcctggagcctcgctcgtgctttctcggaactagaacattttctctctctgcttcactcgtaagttctttatgagggcaagtatggtaaggggaagggagtcggtgcctgctaaaatattgtttatggtgtctaaagtgccctttgaagattatagatactgctctctggttgtgtttaaatctttaatcttttgaggaaaaggacggcttggagataagccctaaagggaatttaaggaaggtgggggcaaatataggttaaaggaccaacgacaagataaacatggtgcccgccctgataagggggaaggaattccttcaccgtggagctggtttattgccttcttgctgtttcctgttgacaagggagtgaacctttaagcaaagatccgtttattctgagctctggagaggatttttgatacatagctttattggcttcacacctgggtagaagaccctagcacaacatttctcaacctgtgggtcgatacatcccacagggcttacgtatcagatatcctgcatatcagatatcctgcatatcatatatctacataagaaatcacaaatagcaaaattacagttacaaagtagcaacggaatggttttatggttgggggtcaccacggtatgaggaactgtattaacgggtcacagcgttaggaaggttgaggttgagaagcgctgccctagaaccttgggaattcgggggccaagtgtcaaaagttcatctcctcagggttagcaggtaaagaaagaattgatcatgagtggggtgcagctcaattcatccagggttgttgaaatgtgttgatgtgatagggggtggggggaggtggagtgtaacattttaattccttgtaacatttaattatgtgtttgtatagctgatgctataatgaacaatagggcctgtgctttgttggaagttcagaggtcaggcagacttcgttacttagcactgagtgacctcgctcaggctgtttgacctctctgaagttcatctgggatctgcaaaacaggcctttggatgtatccttccctagccttggtggagtgggcagggaaactgacccacagaaaagcaagcctggagcttcctgcgaaagttcactgatgttgagaatggctccagttaaggtggatgcggaaatggatacagcctctcactggcgtgccggattccatctccctgttttagaggggtgtgtgtgtgtgtgtgtgtgtgtgtgtgtgtgtgtgtgtgtgtgtcacgcacacgcgagtgcgtgcacgcactcagtttgcgttggtccagcagccctcggggccctgcatcaggccttgtagcacacttgtggtgtcccagctccttcgtggagtcccctgctgttcctacagtcagggaagaggatgacaataagaagccccagcctttgctacgctttggacagcactttcagctccctgctcttctcttgctgactggcctgggctctagaggtcagtcccacactgacctgcagttttgtttcctaggaactgtctctttcctcttgcagtgattcagggtgggggaagggtcagtcagccttttctctctggccctaggacacctaaccccccggactcataaattcccacatcacccagctgccagtggccagagtcctgctttgaccttatcttttgaccaacaggtcttggggggtggggggaggctttcacttcttcctccctgatcttgcactggggtgggggtagggcgataggtggaattactcgggcttggatggattcctccaattctgtatagaccacaggtccgttctgtgttcttggggatcccatcccccattcttggccatcttgtccaaatccttggggcagctgccaactttggggcccaaatatggagcctgggattcagtgactaggggcagaggcccagtgggaggtaggggcagtcagaaagatgggcctgttgggggccttgacctagctttagccaaagagtgggaaggggtcagaaccatgtgccaagtactgctccagaggcatggactgatgagaaagtggcggaggtgctcaggcctcctggggctggaatgggtgggcctgaccacaaagcccccatgtctcttctggtctgcatttggggtcctgcatgtgaataagctttggagccctgccggtatgtgggtgtggaagggtggtggaggggagtgttggggccagcagacaggcagtaggctggacagcctaaacccagaggcctgctgctcttgaggacgttgagcttctggggccaagatctagcgaacccaagttcactagcacccttgaataatagtaggctcagagcaactcaaggaccaaagatgggagggtgctcttgtgtgccccatcacctcacaccctcagtctcttaactccagtcctgaatattccaccctgaacctgaggatggcccagggttttgagggttcacaaaggcgtgggaagggggcagtccctgaagaggtggtaggtagccagccctggggagacgttgctagtttaagggaaaagccaattgtgaaagagctggcagtccctccgagggggcgtgctgagcgtatgtgtgtgtgaaaggggaagagagcgtgggcagtccgggggcccagggagggaagagtgtggccgaccagcagtcttcctttatggggttctggggtaaggttggtggcagggcaaagaggtgtgtcctcctttccgatccagcctacagtggtttctgagagagaggtggtctgggattgcctggagctgctctccccgctggcctttgtggtggaggaattttaggtggggtgagagtgtaactgcagctccagcccagaacgtgtggctctggagaaggcagaagtggacttctctctcctggagggctccaggtcagcaaacagggcaaaaagcaccccctcccccctgggggtaaccaggaggctaccatcaaccttaccatactgagcacatgatttcagtggtattgagtttaaacttggtacagataccccacacctgcctctttttgcattgggagtattgctgtggctgctggacccaactccctgtgtaaccctaaggtagggtaggaatcctagggtacagccagtcttctcttaaaggtgttcatttgatttccagacagtggtggccctgaaaagtctggggacttgactcttgttctagaatgtaagccaagcctctctggtggccaggaaggaagaatgagacccacatttccacagtgcctctgagctgcccctagagggcagtcatagggctgggcgggggggggggggggaagagtagcttgtcgagctgaagtttctgtaactgatatcgnnnnnnnnnnnnnnnnnnnnnnnnnnnnnnnnnnnnnnnnnnnnnnnnnnnnnnnnnnnnnnntcgccattaatagttattgccttaaaccataaaggataggttgtgctgaacccttctggggggtgtcagatgtatggatgctaagtgacatcatgggtgtcctttgctgtccaaagagcaccccgggtctgtctggttcttgaaacctgcacctcaccacaggttgaaggagaggaagaagccgagacatcagacttgttggttgggtttcctccatcacaaaccgatctccctccccctagtggacaacaagagtaaagcagcctccgggagccttttgttagcactactcctggctcctgcttttactccatattaataagctcattgggcaggaccacagcatcccacttttaaatcccatcagtgtagaacagtttggccagtgaaatctcatggtttttttttaaagtgcagattccaagttggtggttatagagtgcttctcctgattcgggagccaccccagacacccagctgcttctgtggagtcctggatatttggtaccacgaggaggtggcagatgaatctagggcccatgtggttggcttctgggcaggagcccttttatgtttcctttcgtggcatgtaggagaaaacgttgagggttactctaagcacagactggattggggtctctttaatcagaggtccagcacccctagtgagtgagcagtggcactgagcagtcgtctgacaccccaagattcccatcctctgtactgggtcctttgcctgctcccaccaggagggagaaggtcaggcctgaggctcctcataggagcttccaggctctgggtgaaccacaccagagtcaatgtggactggtggcaagcagggtgagggttgggagcgtgggtgaccgatgtctggcatctaaggtttaccctgagccaggttctatgcgtgagttaatagcatcggctcttgtaactaatcctcaggatagcacggtgggaaaaaaaaaggtaaattagtacttttgatgttgtttttcaagatagggtttctctgtatagccctggctgtcctggaactcactctgtagaccaggctggtcttgaactctgagatcttcctgcttctgccccctgagtgccactaccacccagcaaatttgtaggtcagaaaaattcctttcaaagatacccatagagtgtaaatgaagccaagtatgacacaccaaactgggttgtactgctgggtagtaaactggctacccagccataagaaactgctacttcttgggagcacctgtttttccactggggaaggagtagatgtgcgtactggagcatggaataaagagccagtcagactctgcccaagaaggacttctttcagtacttaataagggaagaggtaaataccccctccccggcctgacacctgcaccccaggtcaagccgcacaccccttctggctccacatgctaaccctgagttggttttgttagcagtgtgacttcaaagttctgcaggaatgttgggtgaactccctatctgatgccccagcacgagggagggaactcttgagagcacttcagtgccctgtcactgacaggtgctctcacccagggcctctgtgggcccagggccatgggctggctacctcatctacactatgaatgccacacacagcagctaacaagtttattagatagagaatgtctcctgtaacccatatcggggagacttacaacacatcaagagccagggagggaggttggcttcatcacatcagccaggatagagaagacataggcaggggtcagcagccagaaggagttgggtgaaatcccatagtatatggccctcaaagtgaaagtgatgagcggtggaaggaacaaagccaaggagacagacagatggccaggcctacctggctcctgggattgagcccaggtgagcaggggagtgtgtgtggttcgctgatttgtggggtgtctaagaacagtcgaatcacgatgctgaggtacaatgctgaggtactggctctctctccattgtaaaagcctctctgtgatgctctgctgcaagagggcattgcccgaagagaggggaagagtccaggttgctctgagcgtgccgtgttcagcccaggattctcactctgagctgatgtgtgactcatgtgtccctctgtgctctgccttcagtctccactggacttactggtgtcttggtacaactagagatcattcactggaaagtggaccccatttcacagctgccactcgatggtgacactgtcaactccttaatctgtgagccccaaggcaggggcaaagacaagatcaacttgacagttcccaggtttcattccatccacaacgtcaccctccatggtggctttgtgtgttaaacagatatcacacgcaatgcatgcatgttagcagttggcaggattctcctctgcattgaaaccagcagttcatggatcacagttccatggatccccttagagaatcactcagcggtgaatgagtttaaggtcccaggttgcccctactatttaaggtgaatcccctgtcttaactcttagaaaaatacaagtgtggttagaatttgttagtctttagtgtttgagaaaagccctgtcctcggccctaacgttctgaagatccttaaaatagggttaaaagttgagactcaagagaattaagccaactcaccttattctgcttctacatttagcttacatgcacacacatgcaaaatgcacgtatgtatgcataccatatgcctgatgactgtggagaccggaagaaggtatcagatgccttgagatcggagttgtagacagttcatgtgaatgctgaaaatcaaacctgggtcctctgaggatggaataagtactctagccactgagtcaactcctcagccatggaagataacatgttttaatcatctcactaaaaggttccaggcatgtgttgacttcttgagtagttgtctgggcacagagtgtctgggactcagagccccggatgactagctgtgtactcagataggcaccctttctctcctgcctctgtgtctttgagaatatctacagttgacaagtcaataagggcttcctgtggaaggagggagtcaagggagacagtggctgtggatccaggggttctaggggcagcaggtctgcgccttccagcttctgcgcatcagctgtctggcgagcactgggccccgttttccttctgggcctgactttaagtttctggttctttgcagacttcaagtttgccatgtacccgccatcgatgattgcaactggaagcgtgggagcagccatctgtgggcttcagcaggatgatgaagtgaacacactcacgtgtgatgccctgactgagctgctggccaagatcacccacactgatgtggtaggtaccagctcttttggctgagtccccttggctgaaacccgatgtctctcctcaagttccaggaaggatggttggtttatgatggtggctcagagtctttttgtttgcgttactgttttcttggtatcttgtctttaaaggtcaaactccagcagattgatgccttccctcgaggtgtgtgtgtgtgtgtgtgtgtgtgtgttactaggggttgggttctcggtatcccaggcaaccactgtaccattgagttacatcatcagcccttaagggtttgttttgttttgtttttagatttatttatcttatgtctgtgcgtacactgtcactatcttcagatgcaccagaagagggcatctgttcccatcacagatggtggtgagccaccatgtggttgctgggatttgaactcaggacctcagggagtgctcttaatcagtgcttttaatctctagccctccttctctaaattttattgagagacaatctcacaaagatgccttgaattcatgatcctcctgcctccgcttccctatagctgggattacaggtgtgcacaaagactgcctgcttcctcttatgggtttgaaagcgtgcatgtaccttaaaatacagacagaatctcagcaagctgatggggggggtgggcagtcaactgattttcctctgcagtgtagggttcatgtccatttatgttcacgttgtcaggcctctgctctgccatggagagagtccaggtctactcactccccaatgaggtgggaatgcacaaagaggggacagctaaagctgtgacagagggagcagatttgagaggtggccttgtgagtgatatctctgccagtcagccttcttgccatcctgtctcgggctttcttttaactcaaagtttttggtggatggcaaagcacacaaggatcgagtgcagtagaaattcgagaactattattagctttagtctttttccattctgtgtggatggccccgaggctgctgctggctgccagaattcagagatcttaaacacagaggttttgagatggaccaggatcgcacaaggtcctgatttcactggctaggatgtaacagttgaagagggttctatctgggataactctcagagctcagttacctgcatccctcctccccgcagcccccccctccccccccaggcagcagagaaaggatgcagcagagaggcaggacaggtaacagcagagccagtacccaagcctctgagctctgtctccagcctggaaactttgctcatctctgtggctcttgggagctttgtattttgcaaaaggcattcagtggaaaggctaagcagagaggggagtattgttggctcttaggttctggtgtttcaccatggagaggcttggcttgggaatgcaggggagattcacaagataccctctggatatgcaggggcattcagactgccccatgagggagtttactgggttcaagggtcacgccgtgtaatgcacaggcctggggctggtgcctcgcagaagtctgcaaagcacaggctgtttaaactcaggaagctcacagccatccagcaactcacctgtatttggccttgacactacctcagagaggtgaaggccttaaaggccttgatagagctaaaccatgggtctttctttctctgaaccgggttttaaacagagtatttgaagtgttggtgccaaaaagcatgctttttagccaggactctaggacatggattgtgaggctccccacctccacccgcagcacagcatggagaatgtgtttctgactctccaacgtgtgtgtgtgtgtgtgtgtgtgtgtgtgtgtgtgtgtaggggctcaacccaggccctaatcttcacttttcctaatgtgtcctgctaaggattacttcatagataggatgttagccagtaacaaacttttcttcaacttctgaacatgcacacgcacacatagacacacatgatgctgtgaaggttctgtgccccagtataggggattgccagggccaggaagcgggagtgggtgtgttggtgagcaggggaggggagaagggatgtggggttttcagaggggaaactaggaaaggggataacatttgaaatgtaaataaagaaaatatctgggctggtgagatggctcagcaggtaagagtactgactgctcttccaaaggtcctgagttcaaatcccagcgaccacatggtggctcacaaccacccttaatgagatctgatgccctcttctggtgcatctgaagacagctacagtgtacttatgtataataataaataaatcttaaaaaaagaaatgaaaatatctaataaaaacacaaaaagacacatgtagaaacacacgtacacacatatatacacatacatacaaacatatatacacacagacacacacaatgcccacgaagacagtaagggctggagatagttcagtgattaaaagctccgactgctcttctagcacctgggtatgattcccagaacctacgtggcagctcccagtgatctgtacctcacacatgtggtgcacgcatacgtgcagacaaagcaccaatacacataaaaacagattaattaaaattcaataaggaaaagaaaagtgtgcaggggcgggggtcctcacaaatgctagcgtgaggcactttaagagaggcagggcatgtctgcaaatgaacttaggatgcctaatgcaaaatttgagcagagtaaaaaaattgcaaaatatgtctttgggctaagagaaacaaaatgtggtatggccacatgatgggatgtcagaaagccttccaaaagaaatgtcatcctatagacactaagtgcacggttaagcttgaagacattgtgctaagtgaaataagccagacgcaaaagagaagtcatagatgaagcagctagagaggtcaaattcatagaaacaaaaaacggaaggaaagttggtcaaaaggttggaaggaaggcaggaaggaagaaaggaaggaaggaaggaaaacaggtaggtagggaagtggaacatcctagccataacatacagtatgaatgtacattgcaccaaaatgcaccaaaaatgatcaattttatgccatagtatctttttttttaatttatttatatgtacagtgttctgcctacatgcatgcctacaggccagaagaaggcaccagatcctgttccagatagttatgagccaccacgtggttgctgggaattgaactcacgcctcctggaagagcaaccagtgctcttaacttctaaagcatctctccagcccctatgccatgatattttattcatataaatataccacactcatacagatcatccctgtgaaatgccagttagtgtgttgctctgtcatgtggagaagttaaaccaatccaaatagaagccaggagccactgatagctgactgccattcctgagtgcccacccccccgccccgagttctactctcacggctggcccgaggtcaaggttgaaagttggtcccctggactccccagccatagctagacagcatctcccagctcactggcagctgatagctggggctgcagggacccacgcggctctgagaaacgggctttgttttccatatggttgccaaaatcaattgactagctccattccgaagagaagtctgagcgagaagcctgacagtcttacagggacagaggggagtctcagaggacagtgtattttaggtccttttcccttccagccacaagttaagagttactaaaatcagacactagccagggaggcctgcttggctctcagggaacttctacatacccagacttctgttgccaagagggagtttgagagcagggcttgaccatcccaggcccccacagaatcctgttccctttccatcccctccacagtgtaatcttgctgtggttcagagtttacctcactgttcacttgactgtagggcctcttgtataagacctaccttgaacttggctttttatcccaagcctccagcagtcattagaaactaaggcttggagcaagggagggaaggatggaaggacgaaaggcagacagggctttcaaatgtgcctctcattcattcaggaccttaggaaagatttatcatctgtctgtatctacctgtctatctacatgtacaaacttaaacagaagatttatcttggagcaacctcttaatttcactgtcagtcacacacttaagtcaatatagagtagagctggtatgaggctcagtggtagaatatttgcctaacgcgtgcaaggttcaatccccaatagttcaagacagggaaaaaaaaagttgaactgaggcgtccatgctataaagatttgaggaagtttctagaagatatataatagaacaaacagaggctctagtaatactgtcagttctgcctcggttataacaggaccccttgccgtgttctccagaactgcctagaatagattctagaatattcttcccttagggtcatcttggcattttatgatacaacttctcagcgagtaattacaaaacaaataacttaagtaagcattgctcactttggacccaaacttttctggggagagggggtccccatcatctcttatgtcccccgccccccttggcttgaaacttgtattctcaaagtgcctctgactaataccaccttcagtgtgcttaaggggggcttcggggaggtaggaattctggaaagcatgcctgggggtggggaggcgggtagagctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggctccaagaggggctcctgcaaagctggggcggttgtaactgttgggattgattgatggatgattgatcggtggatgattgattgattgattgattgatgattgatggatgttggaggaataccatgtaggtctctccaccctcaggaaggaatatgttctacacttcctgcagatagaggatttctacctggccgagccaggactgagggacccttgttgaaggtagagctaataactgaccacttatgaggaagtggaagctgatagacagcagttaagcagacctgatgggtttagcagtctcccaggtgaatggcagatgactctgtagccatgtttcgtaggctaactgcatcagtccttgttcctctctccaaatgagagggagcaaagatcagggatcatccagtcagtaatgatttgaatttcagttaacactgggaagggagagcatagagtttacatgaaacctttggatcttcctccagtgcttagactacttggtgagcatacccttggctggaccattacatcatgcttgcatcatcttgagctcttggctctgaacgtgcagtagaaatgactgccagatgtcttgtcttccctgtaggggtttctcccaactatccctttaaaatcttgggcagctagaagggaaggcttactgtaggaagagtagggacactgcagatcctaacgccaagttcttaagctttctgcaggctgatttatgaagaccatctggcatcattaatacaatagagatgtacaagggtcgtgatgacggggtagatgtgccaacccagatgatcttttccgggaatcagaagatagcggactagtttaaaaaaaaaaaaaaaagggttgtatggacttggccaagaggcacaaaacttcctactgtagagcagagtctcccgtgtacattacatcagaaaatattcaccaagtaaccccacacacacacacacacaccgtaaagattcctcatcatttatagaaggtctcactctgcagcccaggctgtcttcagaggcataatcctccagccttctcctcagccagcttcctttcaaatggagtggttccgagttctcctctcaagccccaccacatagacccagcctcacgaaggatccctcatcagctacaaatcctactgttgtaaaataccagaagcttccaggcctcaggtaggatttgatttctgaggccaggtacatgattggaggcatggatgtggttgctgtctctggtattggggtgttcccactcattctctctgccttccaggaaaaagctatttacacatcaccaaatgctgccagattggcctagcaggaaacatggcaaacaaatgagaagctgtcaggacctgagtttttaattgctaatgagggtggcaggtcccaaggatcaggatgagagatgttagagcctgggcacatgagtcctttacttggtcctgttaaaattagcctggtgacccggtgacccccgcccccaatgctggaccacactatctctaggattaaccttcgacacatccttgtcttaagtagttggtgatctatacctttgttcacagaaatataggatgggcgtgtttgtgtacttaaagtttcaactactcagccagcctgagaaacatgagtctcaaaatccaaaggattctttcagattcctggacagatggagccactaaaacacacacacacacacacacacaccaatcatttattgatttgctacttagctcttcatttttatacttggagaaaccggggtttgcaaatggagctgtgccctgccagcaccgagtgagcaccagacatccccatcctgcttcccgcccttcccaggttcaggagaacgtttcagccaatgaccttcgctcttgatctgctgccatgcctcatcttcaagctacagtttgaactggggggcagatgagagatgggaaagaataaaaatggaggtgtcatgtggggggggggatgaggagcagtagggtgggcgggggtagaggatgcaaacttttgctccttagtagttattgccaactttattttcaggtctctggaaaataaagataatgcctttatgtttgtggaaaaaaaatatcaattcctaggtggtgaggtctaagcagaaaaataaacagagggaagtttatggtgaactgtgagcagataccaggagattcgagttagcaccgtttctatacgcacaggatgcttcctagtgcagggaggtgggacggagaaactagggtgaaaatccctggtaggggcccccctccccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatgcagtttggaataggaaacacttaaggcgtccgctgatgcgctggttctgaccagcttgatctgggataggctgctagctagttcccagatggtgctgatgctgcctgctgtggccccccactttgtatactgagtagtttccatggcatttgagaacatttctattcttacctcacaggaaaatcaggatgtgagttggatcgcgcgtctgcctttgagaggcgttctatgcatttgcatgtgctaatagccccggtctggacctctctcctctaggattgtctcaaagcctgccaggagcaaatcgaagctctgctgctgaacagcctgcagcagttccgtcaagagcagcataacgccggatccaagtctgtggaagatccggaccaagccaccacccctacagacgtgcgggatgttgacctgtgaggaagccattcgggcggcaagagagaggcgtgttcgtcatctgctagccccttctctctctagttatgtcttgttctttgtgtttttaggatgaaacttcaaaaaagaaaaaaaaaaaacaaaaaacaaaaacaaaatctgcccccacctagatcctatttaaaggtcttttagaagtgagaggaaaaggccgtatagttgtaacgcatgtggtgcctgttcaaagtcctgcataaggggatccctgtacactcgaaccgttattatttgatgatgtaaaagtcatagtgagatgcttacaggagaacccgcagactagctagagagtgtgcgtacctgcaacatgggaacgaattagaggagactgtcttttgtgcttgtgacctagtgcatatgccccctttagtagaattgcaaggaaccgtgggtgccaggaccgcatgagtagtttgcaaagcagtgaacccaaggaggaatcagaaacgagaagggacatgccggggaggttgcgcaaaaccacccaaccacatgactgaaccattttggatgtaagaagcgccttgatgcctcaccacgtgttcccaagactgagcgtccgggtctctccgtcgcatactcttgctgactaaagtagctgctacctaagggatatgtcttttgccagttggacacaggtgaacggctcctaagtctcatgtttggtgaatttgggcttctacttccaaacatggttcattgtagatgtattttactgttatctgatggagggaattcgctatgggccatgaccaaaacgcatctaaatgggggcagatggagaccatagacggaatctaaaacaaagctgccttgtgtaagggaagagggtgaggtgatctttaattcccttgttaagaaaaagaaaaaagaaaccacccctaacttttggtgctgattagcatgtctggtccactgtttaactttgttataaaccattccattagaaaagcactttgaaaattttgggggagggtggggtgggatatggggatggtttatgcaaatcatgttgaatacgccttcctcctttgcccctccccttcctgaccctcgtccagttactgttcatttctggagtctgatgttctggtacccagctctggtgtccctgccagggctgagaaagccctctgctgatatcctcatcccagcattcttcggaaaacctgtcaacagaggtctaaagcattgtgatggcttagaaggattgaatccccgtctatgtttttctcctttggacatggaaagaaaggttacttctgatgcacaggctgaacatcagggtgtggcattttggtcccttttccgttttttgtttgtttgtttgtttgtaattttagtgcaaagttgtattcattgtacttgaagacccccctctcccacttcttggagacagtcagtaaacagaagtgggagccacagttggtttggttttgttttgttttttttgtttttttttttttttgcacaattataattgacaggttatgaagctatttgttaaaatatctgctttgtttttttttttttttgagaaaagatcagaacagggctgctttgaagagttatacacaggttctgccttgtttcacagtgtgagggttgaagatggagaaacatctaagggtctcttatctttcattttttcttttgttctgtttattattattatttttcgctgctaagaagctaagatcgttcacccccattcacattaacagtacctagctgtaatgtttcacggtgtgctgctattttagaaacattgttataatatattattttactgcttaaatttcaagtcccgaggtagatggtcgagagacgagttctctgtactggaaaagccttttcctctgtccctgtccttctggtagcatcgatgggctgcgttgcgtttggttccgtttggttccttttcttccgtgcctcttcattaccaggttttctttcctcctctgaccacattcttcaaagagagtattctttacctcaggtttactggacaaaaacaaaacaaaacaaaaccaatagtgataacaatgtacttcttttcgttttcctaatacctcacagctataccggatctgtttggaaggccgctggcacgaggcacagggcaggcagaagacaggaactggacatcctccttgatagaaagcaggagaaacctgaccccagagtctcaggccaggggtcttctctgtcttgaagattgccaggctcccctttgacgcaggctcccttcttatgatagaagacagtgacgaagggctcctctacccaaggcagatactcatcaaacacagacagtggactaggtcagcctgatttgcatgcgtgcaccagggtctgcaatgaagaattctggcagacagttaggagaccctccctccatcttgtagcccattcagacacaggactttcctcttcatggggtcccttcatcatgaacattgaccagtttccttcttggcatctataccccaacttcggatggcctccgaagtcttcctaggactgagtctggttggtgctgagtctacagcacacgtggatgatattcctttctccttctcttgtcctctgcagtctacagtgacaggcaagtgctgtgcgtggccaggttgtctgtgtgtagcattgaatggcttcagggtttggatcccgttgagtggggcaaggtaggaggcccaagttgaatgagtctggaatgcaagttgaaagaagggagaggctgtttctgtggtctcgggtgtatttaggaaggattgggacttggtgagttagcgagaccctaaattctaggggctttgtggtaggacggtgggtgatggtttgggaagtttgagagagaaaacgggagcagcctgcagctagccagtgtttatccagagctcacgcactgcacagcacactcttctggtccttaagggaccccacagaacttgacagacacactcccttgagttcttgggcaacttgggtacctgatgagtggcctttgagcttaactgaaacattgaatgaaggaagctgacacacaaggggagaggcaggttactatctgcccctccatccctcttacctggaacctaagacactcttcctgtttgccttccttggagcctagtggaacgagtcctgtagagtggccattctgcctgctcctcacttacacaaaggaagggagcctggattccttggtgaccaataccttctgcttagatgtgggtctccttggtagtatttctgtctcagaggggtataaacgaccccaaggatttcagcttgctctccccaagccccttcgtatcctacagaaggggttgcagattctggtctttttctgccttgctaatgatctcttctttgtttctaatttgtcannnnnnnnnnnnnnnnnnnntgggggctaagtcgttcccccagcctgccaaattttgatccttcccctgttttgaccaaaatcctaaggggaaagaaaaccttagtatgccaaaaataatatgctaagcataaggagattcataatggttcctaagaaccaggcagcctgtgagtggtgagctgcttctagatgggacagcttgtagaggctgctttggtttgaactgtccccaggacaccacgggaaagcagagcccgtcatataggttgctagctttaaggtgcatgcctactgacacgggactcctctctagcagccaggctgggggtacatgtagcacccctggatcccatcttgttgctagcagggtaagtgacccctcagagggagcttaagagctttcctatagtctagctctttggggacccaccagactgtgccttgggaattataggagcaacaggctaagacagggtggctttcacaaagaaggcagaggagctttgtctccatgaggacagggctgggaggaccacacttgtccctgtgtcctggacagtggtgtgggaactggaggtagcaatcagaagtctaagtaagccagctgacctctaagcccaaaggactcccccttgcttaccttagacagtccaaccttgggaatagctttaaaaaggggaattaatactgagacagtgaagtccccttaagccgacaagccctccataggtgcacaccgcacacataggcttctctcagtgcagactccaggtggtggtcaacagctgcggcatgcttatctatttgtacgaaatagtgtagggaagccccaggaggtgttatagcttccgtataccatgtggcttttgatgcttctggattctcaacagcacaaaagagtcctcgagccggaacatgcgctactccgcttttaaacgtggctgggctgtgagacccgttcttggctctggttttacgaagccatcaatacatacacacccttgatggagctgcagatccgttccttttcctgcagcccacttgtgggggaaaagtgccttactgacttacagtagccactcagtttcaacaggtgcctatctttgacaaaaaaaaaaccacaaaaaacaaaaaaaaacaaaaaaaaaaacagaaaagaaaaaaaacgttaaaatgtctcttaattttcattggctgttattcttatattgatcatcttgtatgttcccagcaagtcaccgggccatcgaattatctccatgttgttgttcattatccttctgccatgtacctcagatctatcagttatggtctctcttgtcttggattattttgttccttttttttttttttaatttgctttaagagtgcgatgccatatcaaatcaatgttgttctctcacggtgtactctctaacaggtgtgggtggggtttatggttgggatacgaggagagtctaaagtagcagattagtgtgaataaaaaagaaaaggtttttaggaaatccgggggaagtacattgtattgactacaatgctgatgtgatgtagccgttaagtcttcagtgatcttaaaaacaaaaaaacaaaaaaaaaatcaaccctaatttgttcttctgactgactagtttgaagttggatttgaagatgatgttgaaaaaggttttgaatgcaattaggttatgctatttggacaataaactcaccttgacctacaatgtctggctgtcactaacttctttctagactgctagccctcagaggagaacatacccgtcccccagttttagaccatgaatatagccagatgtgagtggggatatctgcaagtgtcttcattaggtggctgaggcaacagtgtcatgcctgggctttcaggatagcccccccacccatcccccgtcttttgccaaatactcactctcttgactgtgagtaagtgtctcctggtatggttgccagaaacccactgtgctatctccccacccttagccaggggagcaacatgagccaagtgttcggaaaggttcccataaaatgcctctccccccccccccgcaccctttccttgtatctctcgtgtgaggtgtcctagaatgcataagggtccccctggaactggaatcacagatgcctgtgagccaccatgcagatgctgggtgtactggctagttttgtgtcaacttgacacagctggagttatcacagagaaaggagcttcagttgaggaaatgcctccatgagatccagctgtaaggcattttctcaattagtgatcaagagggaaaggccccttgtgggtgggaccatctctgggctggtagtcttggttctataagagagcagactgagcaagccagtaaagaacatccctccatggcttctgcaccagctcctgcttgagttccagtcctgacttcctttggtgatgaacaacagtatggaagtgtaagccgaataaaccctttccttcccaacttgcttcttttttttttttttttttttttttggtttttcgagacagggtttctctgtatagccctggctgtcctggaactcactttgtagaccaggctggcctggtctcaaaaactcagaaatccgcctgcctctgcctcccaagtgctggattaaaggcgtgcgccaccatgcctggccccaacttgctcatgatgtttgtgcaggaatagaaaccctgactaagacactgggcatcaaaccagagaagccagaggtcttaactgctgagccatctcttcagacccatacttttgcatttcttgtatttctcttttttgttcttgtttgcgctctctctctctctctctttctctctctctctctctctctctctctctctctctctctctctgtgtgtgtgtgtgtgtggtgtgttttgagttagagtgtctcatgacttagctccgactgtcctgaaactcctgtctctgcctccccaatactgggattaaagttctgtgctgccacaaagggcttgcttttgtatttcaaacaaatttcctgagactcaaacatccatgatagcaacaaaatcagaccttctgttggcttatcagggacgttcctaacatccctctgtgaaccaagcgtccagaagctgccagatagtgttcggccttgggctggggaggaggaaagtggcagaaatgcccttgagagaggtggagagatggctcagcagctaagagtgtttgctgctcttgcacccaaatcagggggctcacaactgtgactctagttcctggggatccagcgccctcttttgcctcttacggcttctgaaggcactgcacacatgacacacatacatacgtgaggcacggatgtatacataaataaagataagagatgtatctacatataatgcttttgacagtgaacatgagggttcgtggcaccaacgtgatgtgaggatccagggcctacatctggtcttcaggaaacacaatggaagcaccacagctctgtggctgaagaacttctctgtgaggaaaccaagcacacaggcttgtgtgcaaacgcatggaggtggatcagcaactggggttgaatgtggcaagagccggtgttgagagaggagcagggcttgtgctgtggagaatggagaggtttgctccggcacatgaactgcagaaaacacttgttaggatgtccatgttctttggaaacagtaaaagtggaccttgactttttccaaagataaagagatgaaaagtgttttttcagggaaggggtgagtactcagataggcagcctgcaaagcacacacagcacaacagactttaaactccacaaatacatgtaggaagtgggctaaactcggccacagacactgacccagggcggccacctacctgatttcttgggaagcctgaaggtaaggctggaaattacctggtgactggtgacttgtatgttctgggttttgagggcctttctggaggtggtaactggtcaggtgcctctagttctgttcacagacttgagcagccagaattgactgccagagaaaaaaagagtccggcaatcctgcttacctttcgtcctcctctacctctctattgtcacctcatcagccttccaaagctttgcttactaaaaacactgcttcccatttaattggaaacggcaagtttctgcagctcctgactccaaacagtccagggatagccttaagtatgaggcccttcctttgatgcccacaaggggatgctggtgtcataggtggaaccaatctgcaaagccactagcatgggtctatctagagaccaggctttcagcatttgacctaggggagtagggagcagcctgcagagacccatgtcaggcctgtcccacacatgaacaatgacacttcctcacctgggcccctcatgggcccacagtctctccttttggattagctgggaccctgatttattgccttgtttcgtgttcttcagtgtctaggccagaagcagcaaccttgaaaggtgccagactgaccggatccagcctgcacagagtgagaaggactcctacagtcactaaaatagcataagagatctcttgtataaaagtcaagatcttaccaattcattgggaatctaggtcgtggagaccccagggcttcaaggcagggtgggctgcagtagagagtcttctcagccccttctccctgctccctgcctctacccactcccctgccctacccactaccaccccctgacatttctctgtagtctaggttctgttctttcctctggctgtgcagtggcattgctccaagggctgtggaagctatctgaaacctcagagcacagttctagtacgtcccactttgaggaccagctcttctcccagaagacaagagacccctgaatgaagcttttgtctgttgccctagggttttagtcaggtgatctagggtgatacaatccaatgtgcattaagcatgagcttctcccatttttatttgggggggggtgttgttattttatgtgtatgagtgttttgccttcatgtatgtatgtatgtgcgctacatgtatgcatggtgtctgatgaggcaagaggacattggatcccctgggactggagttacatgtagagagctttgggggctgcttggctggaatctgacattgggccaggacaaggaagtaagctcggaatctaacttagaacaggaaagtaagttcaggcaggaatctaattttaaactagaacaaagaagtaggcttcaggtaagaatatgatttggggcttggacagggaagtgggctcattgtgataagccctgagaaacagtgatggtgggagtgatcatggaactttgtgtattgcttcgcttgttccttgactgtgtttaatgccgtgtttgttcctcaacatagaactggccttatcgcttgcatgtaattaaaatggtataaaagcagactgggaagaaataaatctgcctcagcctcagaactggctggggtcatgctatagtgtctaattgtctttttctttttaacccttgctcctgccctggagaacctgttgactgactggcttggtcagtttaagatggttgtgagccatgaagtgggtgttgggaacttaactctggtcctctgcaagagcaacaaatgctctccaactctgagccacctctccagacttcagaggggcattttcttttacttgtaagatttttagttttggagggtttttgtttttgttgttttttgctttgttttgtttaactgcaaatctgctgggcatggtggcttatggagcaggtagatccctgtgagttcgaggttagcctggtccacatagggagctgcaggccatccaggactgaatagcagctggaaggggtgacggagggggtttgcaaaagctgtttggttggagagacattgctcaaggtcaaaagtatgactatcccaaactcttttacagagatgattgcagggaccgcccgttcactgctcggatgagctccagaccaaggagttgaatgagaatcctttcatcaacaaatgtgtctttgatggctactttgccactgaccaggtcctgtaaactttgatcttggtgactagcggcagagccagacgagaagtcacaggcccaagtgtattggtggaggatgcagaaactctagtatgaagcctgctctggaatccctgccagtcctccgctgggttcagttgcctcgtgattcacaggactcacagtaaactcagctcagttcctttatctgtgaagcaaagctcaagaacaaccatctatccctccaagagtgttatcagaatgaagtgagtcgattcattgaaaaacatagagccaggttgacacccagcatttgacctgcatttgctatcatcttgggctaaagcannnnnnnnnnnnnnnnnnnnttgggatgtaaagaaatatttgcaagctgaaggggtagctcagtggtagagcatctacctgctgtacacagtctctgggttccagccccaccacttaaaggttgggcatggtggcaccttaaatctcaggactgcaaaggtagaggcaggaggatctctgtgagttccaggccagctagggctacatagagaaaccctgtctccagaaacaaagaaagaaggagttttcctgttcacaaccctcagtctcttctggtgggtgtgactcca

SEQ ID NO: 1254 - DNA, 1255 bp, Mus musculus
ggcgagctgaggagagccgggcagttcggagggaaggaccggtgcgagtcaggcggcccttgaggctccgctcgcccaccttccactcttctctctctctctccctctctctctttgccatttctttcctctcccaaatctcccattcagccaaaggaaggaggtaagggaagcactccccgactctctctctctctccagctcagtcctccaaaaaataataataataaaaaaaatttacagtcgggaccgagtggtggccggctggctatggagctgctgtgctgcgaggtggacccggtccgcagggccgtgccggaccgcaacctgctggaagaccgcgttctgcagaacctgttgaccatcgaggagcgctacctcccgcagtgttcctatttcaagtgcgtgcagaaggacatccaaccgtacatgcgcaggatggtggccacctggatgctagaggtctgtgaggaacaaaagtgtgaagaagaggtctttcctctggccatgaattacctggaccgtttcttggctggagtcccgactcctaagacccatcttcagctcctgggtgcagtgtgcatgttcctagcttccaagctgaaagagaccatcccgctgactgcggaaaagctgtgcatttacaccgacaactctgtgaagccccaggagctgctggagtgggaactggtagtgttgggtaagctgaagtggaacctggccgcagtcacccctcacgacttcattgagcacatccttcgcaagctgccccagcaaaaggagaagctgtccctgatccgcaagcatgcgcagaccttcatcgctctgtgcgctaccgacttcaagtttgccatgtacccgccatcgatgattgcaactggaagcgtgggagcagccatctgtgggcttcagcaggatgatgaagtgaacacactcacgtgtgatgccctgactgagctgctggccaagatcacccacactgatgtggattgtctcaaagcctgccaggagcaaatcgaagctctgctgctgaacagcctgcagcagttccgtcaagagcagcataacgccggatccaagtctgtggaagatccggaccaagccaccacccctacagacgtgcgggatgttgacctgtgaggaagccattcgggcggcaagagagaggcgtgttcgtcatctgctagccccttctctctctagttatgtcttgttctttgtgtttttaggatgaaacttcaaaaaaaaaaaaaaa

SEQ ID NO: 1255 - DNA, 870 bp, Mus musculus
atggagctgctgtgctgcgaggtggacccggtccgcagggccgtgccggaccgcaacctgctggaagaccgcgttctgcagaacctgttgaccatcgaggagcgctacctcccgcagtgttcctatttcaagtgcgtgcagaaggacatccaaccgtacatgcgcaggatggtggccacctggatgctagaggtctgtgaggaacaaaagtgtgaagaagaggtctttcctctggccatgaattacctggaccgtttcttggctggagtcccgactcctaagacccatcttcagctcctgggtgcagtgtgcatgttcctagcttccaagctgaaagagaccatcccgctgactgcggaaaagctgtgcatttacaccgacaactctgtgaagccccaggagctgctggagtgggaactggtagtgttgggtaagctgaagtggaacctggccgcagtcacccctcacgacttcattgagcacatccttcgcaagctgccccagcaaaaggagaagctgtccctgatccgcaagcatgcgcagaccttcatcgctctgtgcgctaccgacttcaagtttgccatgtacccgccatcgatgattgcaactggaagcgtgggagcagccatctgtgggcttcagcaggatgatgaagtgaacacactcacgtgtgatgccctgactgagctgctggccaagatcacccacactgatgtggattgtctcaaagcctgccaggagcaaatcgaagctctgctgctgaacagcctgcagcagttccgtcaagagcagcataacgccggatccaagtctgtggaagatccggaccaagccaccacccctacagacgtgcgggatgttgacctgtga

SEQ ID NO: 1256 - DNA, 52302 bp, Homo sapiens
  misc_feature (11301)..(11320): "n" at positions 11301 thru 11320 can be any base
  misc_feature (29267)..(29286): "n" at positions 29267 thru 29286 can be any base
ctccgcaaaatttgcttaattcccttttcactaaaggagcaagctgatgctccatggttctgggtagctcagaacgagctttgtttaaagaggctcaccaggtccatggactgtcacctaaagaaggatctgcaagttagggtccattccaaaccgtgtctatatgcgctctgatgggggctctgtttgagttgtaggaataagctttaggttagtttaagctttaggttaaactaacctgctaagatttccttaagcaccctggagcagtgttatagtccatatattcttatgctctctatatttttgaagaccgctattctattaacttaggcagttctgttccttaggacaaggaaaacagcatttttcctcagctgacatgtaccaagtgcccatctatatgaggaactaaatgttaaaagttccaactcttgatagattaattctcccagatacctgggaagtgagagcatacctaaacccacaatttaagaatccttgtttaaaacataaagtatataataaattgattccgattttgatgatgataataaagtcactggaattttatagattttgagctgaaagggaacttaacgatcatttactacagccagttaattttgtagctgaggaaactcaatcttggaaacacataatctatccccaaggtcacagtgctggttagtgcagagtagaagcaagaaagagggtacagtcggccctctctatgcatgggttccgtatccacagatacacccaaccacggatcaaaaatattcagagaaaaaaacacagtaaaaaaataacaaatgcaacaatgagaagtaatacaaataaaaacacagcataaccgcttccaaagcatttactttatattaggtactgtaagtaatctagcgataatttaaagtgtatgggagaagtgtataggctatatgcaaatattacaccattttatatcggatttttacatcctggattttggtggtggggtgggagtctttgaaccaatatccccacagacactgagggatggctgtattctgacttctaggctagagctgtttcaccaacatgatgctaataaaaaggacaggattttctgcatcaattctaggagacagtcaagctaataatcagaggtctatattctgctcttaatgtctgggtgtcccaggacaagaaaatgagctattgtgacctcaaattccctagccaaaggagtgaaacactaatcaatgccctgtcagatacagggagggctcgttcagacgagaaacagatgctgtgggaaatacagctactcaaagaaaggaacgctctcagtatgatggaccaaggaaacggctctatctttggctactttaaagggactgagtcccatatatgtgatatgtgaatcagacatccaaccaactcgttcccatagaatataaacaaattaagaacataatttaggaacataattcttaaaatcactatgcaatccaagtaacagttacttgactagactgagttttaaagaaaagataaatttccacctccctggtttaaggtatgttgtggaaggtggataaaatagcatatcttcctatgccttttgttctatgattttattattttttaagaacatgtacttatccggggtattatttcctatgcttcatcactagacaatgtgcttcccagggacgcggactgtgtgattcaactctccttcctgtctaccttccaaaacattgtctatgtccacgatatccccaatgcctagcatagtgtttggtatgtggtaaggactcaattttaatcaaataaatgaatggataaattgcaaaacccaaaggcattctccaaagcacaaaaatctcagcatatttaactcttccattaaaaccacttaaattctaccttacagattggaatcatacccctgacatgttctgatgtatctctgcacagacctgtgatgttatcagtttaacacatatgtgatctctcagcatgaataaccttaatgaatactatatagagtttcagtcgcaaacttccagacacagaaggcgtattctgtgactggccaaaatggcatgaggtcctgcagtccattcccctggctccaagcaagactgcatctaatctatggttgagaatgatgctttcctgaatgggaaaggtttccactaaatgaaacatacagtctgccttggtaaagtcttaagtgtctgaatggaaggtcagactttgatttcttgaggtaagtatggttttcatcccaagtgtagcaaatttcactggcgttccattaccgacttacttaaatcatttgctagatgacataaaattgctggtaattacactacaaagagtgattatatgaagttttcttgtacaaaagcaagtaaatttgagccttattcaatattttgttagggaaattttaaattaaatatgccattttatttaaaaagagaaacattagaagaatatatattcagaagaaagtaggggggtagaaaaggttgcaagtcactagtttactggaactacacaatggggatgatgtgctgctacttgatacaactaaatttcctgagtttaaatgatttcagtgagacccccacacaaaacggcctgcacagccctaatccatgatctaggctcgcctctctcaaaatatttttttaaaataatggttcacgatcctgaaataattggtggccatgggatgccagatgtgagacatttcatctgaaaccttatgtaaactaacccaaaccatttgcttcagaatatcttccttgacaccaggaaagagtttgggtcctgggtttgcatttgcctgatggactgactggctgctctcaaaaatggaaacatatgtgggcacgatgaaggaaaggctttggaaattatgcaaagaaattttcttttcctttttaatcctgtctttttttttttgcttcccctaggcaataggtatattaaatgttggtgactttttattttcaaaagcacaaaattaaatgttttttgtgttatttctcagaacaataacctaactttggcatccatactttttttttttacaatttgatgacaatgtttaaagaaataaagtgaacatccccccacacacactcatcaaaagaataaggaagataatttttattattatcatcatcataattactattattaccaatgaagcttgaaggaactcacctttatacatcacaaagaaataattatttggtttacaactgatgagaccacaacgaaagtatgatttgagatagctaagagcagaaataaatttggattttttttgctctaattgcaccttccacataaaccccctttgctctggatttgtgctttttgagttgtttgcatcatgcataggtgcagactttgtttcaagttcttgtaagagcagatgcccttatttaaggctgagtaaagaggaaatgcattccttataggcatctacatccaactggcttggattgtctagcacacttacacgaactacctattttcaggtcaattctaaaatagaacatatctctccagaggtacacattttgaagattataaaactttacagtcaacctgtttcacatttcagaactcattccttttaatgccaacaaaagaacaacaagaaaatgattttagaaaaattttaaatctgcctcctgaaatttgccacaaggaaaacaaaccaaaaaaagcctcaagaagagaactatttctctgttttttttattaatttgtttttttaagtttggtaaatatgaatttagcatgttatggaattatgttataaactgtactaatagatgctagtaattcttaagtttaaagattgaaaattaaaatatgaaatatttattagaaatactttatattgcttcaattggctgcaactgatacacagctgaataaaaccatgaaatcgaaagaatatttaatcacattgggaaagtggacatttttaaggggaatgaatgtttgaatttggacaaaattaaagtgcttagaaaacaaataaaattgactattgttcaaaaaaaaattctggtgaggatagtcttgacattttacaaagaatttacatctctaaagtgcttaacttaacctccactacttaactgtctgaaatgaaggtgaagctaaatttaaaggacattttgcttttttagttttttaaacacttcctttggctccttccttttcttttaataatttatcctattttttctacctttatgcagacaaaccaagtgtccatcaaatcaggcaccaaaaagcaagcactcttaaatacagttcactcaggctaatcatgacagtaattactgacatttttattaattatagctcattttttcccccagaagaaacaaaaccaagtctcttgggtcagaccagcaatcataaaacgaaaaagaaataaataataagttaaaaatagagggaatgtgttaaaaagaaggaaaaagtactgttcataaccaaactgtgtcaccttaaaaaagaaacatttccacacttaatatctgattcagacagaaagcttctctcctacttttgaaacaaataattccacttcaaatccacattttcagacacccctagctttctgcatctgattcctacaacagcccctttacctcaaagaggtaaaagtcagttcacagtatttctctcccaaacatccccactgaagctccttgtaaatttcagcataaactcagaactgtcaccgtgggtttagaaaataatgacacatttcagctataaccccccagattgaaagattaaaaggactttgcccaaatttaggggaaatgaaggtgcgtgggctcactctgcagctgcagttttcagcccttgcagtttagaagattctgcatgagcacggatgccacgagggtatccagcgagtgggaagggagtcgccctacatgttttcacatcgatttgtaaaactgttttgaaagggtatttctagatccatttgttccaaatgcagcaaaattcatccgatatcgctcacaatgcatgcacgggttatcttacatgtaatagccatcgtattaaccaacccagctgatactgagatggtgaatggggcgggggagcagggaggaatatgtcgcgcatgaaaaactccgggtgtaaaagtcaatgcagaactcactccccgaggaaccgaaaaagacattcacgactctcaagtggagagaggatagaaagtcaagtggcgggggtcgcgaccagtgatcgggatttcagtctgatctcagtacccagcggaacaggaccataacctaaagaaatgagctttttccggagcaaagagcggccccgatttcaaagtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgcggccccctcccccgccgcttcctcttgctctcccagccccttcccccacgtgtggatgacgtcaaaattccgcgaaaaagccgcgtggtggctccccgagcggaggcgcgattccgccgcccagcggccccctgcccgggggcgcctggagggggagaagggcggaggcggccggttccttctcctcccgggaggcaggaccccccgacgccgaccgccggacgccccccgccccaaagcttattggaaaattcacttttgtaaagcaaatgtatttccagagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctccactctttgggggagccgaggggaaggcagtggctcccatttctgagcctgaactcagtcactacccgctccccacctggcctaggcgcccctgcgcggagaaggcgggactcgaactcgcgctgctcccgggccttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatcaccagtcctacatgggatatatatatatgtatttttttttccgtgaagggtgaaaaggagataaggaagaaccaacaatctaccccctcccgccgctccccacccccgcgccacggtgatcagtttggacttcaaagccagagcacaggctcttgcgctttttcttgaaaccgaagtctacactgaaagaaagtgtgcacttttgcctagaaggcaacatgcgttttcccgcgtgctaggtggagtgcattttaacaagacattagggttttaacacatggctggagtggcgaccaaaagggaaaactcagtttccagtccaagcctcctagagacattcctgccaacctccgcaccctctcacgccccaccccacgtgtgagagtctgcaaaaccaccggggattggattcgatggcgagcttcacgctcgggaacagtcagtaatcggaaggggaagtggacaggggaacttcaagaggcgagcctgccacgcgggaagcgcccgaacttgcgggtctccatgaatgcagagggcgccgggaagggggggcatccggccgcgaccctctctgcccctcccattcgctgcccccctccccgctggaatttctctgtaaagcaagacggagtagggggagggggagagggaaggggcgagagggccctcggctcactcccgagacgtgaggactcgccacccaggcattctcctcggggtgggctgggccccgggacgaccacccgcttcttcctcgcccccgctgcccccacttcgggagacccagagctctggatgcctttccccggagaagggggggtgtgcggagtcggggtggaagagaccttgctcgcagagctatatcaagtgatgtccagaggctgggagccccggcggcctctgtcccttgcctgtcgggttagatttatactttaaaaatacctcccgccctccctccttctctcgcctctccccgctgcaactttctttgatccgctcaaaggtggcttaggtgaaattggagtaattcccttatgggggtcttaaaatgtaagtgaatgtccttatccggggtgactcaaaagcttaagtcgggaagcccaacgtgactaaaaccaataggtgattgttcggggccgactgtgtgcgggtgtacacggtattcggcccgggtgtcatccgcggcgctggactgtttcattttgagtttgcaacttgggtttttcagcgagctttttttcttcctgaaagctaatggcttccacagcaattagacattttcctcgcccgccccttccctcccctttctttacatataggagatgggatactcattcccgctgctattgataaggtcggaggcggccgggcctctccccagctttcgcccgccccagcgcccgctctccctccgccctcccttggcttccttttgatgtagtggggaacgcgtcctactaaaaaaaaaaaaaaaaaaaaaaaaaaaaaaaagtaatctgcccggtaacaatcagcgcgcagtagcaggagccccagagctattggctatgcaaatagagggaggggagacggcgccccaaactcttcctcacccttttaaagcgatatcccctcctttcccccccaccaccccttccgccccaccctcgtttaaagaggctggctccggggcctgagttaatcgcttgcacctctagtttattcgctcccctcctccgccttgcagggaacctagtgtacggctcacccagcccgcgccccaccccgccttgctggctctccgcgcccctgcccgggccccctctctcggtgagggaggcactcagtcggcctcggtgtgcccagagagctcgagccacgccatgcccgctgcacgtgccagcttggccagcacatcagggcgctggtctctccccttcctcctggagtgaaatacaccaaagggcgcggtgggggtggggggtgacgggaggaaggaggtgaagaaacgccaccagatcgtatcacctgtaaagacagccttgactcaagcatgcgttagagcacgtgtcagggccgaccgtgctggcggcgacttcaccgcagtcggctcccagggagaaagcctggcgagtgaggcgcgaaaccggaggggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaacacagacttcagggacatgacctttatctctgggtatgcgaggttgctattttctaaaatcaccccctcccttatttttcacttaagggacctatttctaaattgtctgaggtcaccccatcttcagataatctaccctacattcctggatcttaaatacaagggcaggaggattaggatccgttttgaagaagccaaagttggagggtcgtattttggcgtgctacacctacagaatgagtgaaattagagggcagaaataggagtcggtagttttttgtgggttgccctgtccggggcccctggcatgcagggctggatggagggagaggggtggggggtggcgggggaccgcgtttgaagttgggtcgggccagctgctgttctccttaataacgagaggggaaaaggagggagggagggagagattgaaaggaggaggggaggaccgggaggggaggaaaggggaggaggaaccagagcggtgagcgcggggagaggatggagagctaactgcccagccagcttgcgtcaacgcttcagagcggagaagagcgagcaggggagagcgagaccagttttaaggggaggaccggtgcgagtgaggcagccccgaggctctgctcgcccaccacccaatcatcgcctcccttctgctccaccttctctctctgccctcacctctcccccgaaaaccccctatttagccaaaggaaggaggtcaggggaacgctctcccctccccttccaaaaaacaaaaacagaaaaacctttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtaggtcggggggtggcgctcgccaggagccaggacccctccggatgctcgggtccccggccggagccctaaacctgggagagggcaatccccgcgccggcctcccggctcctgtgcgggagtttaccgcgcgccttctggcgagacgcgtggctttatttctgttcctctccagataaactggggaggcagaggggggaggaaaatctgggagaagcgaggctgtcctgggcgggggtaggggagcatcccgcgcgcgtgttcctgcatgtggctgcctcttcttcccacccccctcgcgacctgtcttttgcgaagccgccgcggctgcttgcgctgcggccaggaagagagtcggggcctgaaatcgggaccccgagtagaaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctcactccaagtctttgcccagcgagccgtgtgcccacgtatgcacagctctggacctgccgtggtttcgccatgttgctttgcaaactccctttggaaaggctgggaaacgtcgcccgcttaccctcgcaccccattatcccggccaccccacttctaatcgtgccctctcccccaccccccacctcacgaagattacttacagtttggttttccagcttcctcggtgcggagatttgggtggggtaggaagnnnnnnnnnnnnnnnnnnnnattcgttttttcttggcggacaccccgggcaaaccggagggcaccgaacggaacggggcacggaacgacggcgaacgaggaggcaaagagagcgccgcccgacccacgcccaagcgacgcaaagaaacgccgccgacccaaacccccgcaccacaacggcccccacgaccaccggaaccgcgccgcacaccccccagcccgagcagaacgcagcaaccccacccgccaaccccagcaaaccgacgccaaaagcaaaacaaagaaacgacgcccagccgccaccccggcgcagcacccccggccgcgccaccccccaccccacgccggaaggcccggagacgcaaaacgacgggaagcgcgccgcgcaccccgcggcaaagacaaacgggcagccccccccccagcctcccggcccgcacacccgggcgagacaaacaccgccccagcgggtatgcgacgaaagtattccgggtcacccctgaaggacaggtgggagccccccgtgcctctttccagggctctctgctcccgtctttcccctcgctcgtcaccgcgttccctagtttctgtccttgtgggccgcagccggacactcccgccgcggcgctcaccccttcaagtttcctcccgggatccaaagccccaggggtcggaatacagacctttctggcacccgaaacctctgtttcgggaagcctggctcttctttggggttttcacgccaaaagggcttttctaggatatttcctcgatttttaattattttttgaaaccatccccccctgctccgactccagctgccgaggctgcggcgctcttcctcctctcctccctccccctctcttccccacctctcctcacccgccccctcaaaagcggcccctgggccgcagggatccccccagacattttttccaattgtcgggaatgatagaggaggatctggggatccggatgagaccaagaagtggacccccggagcctccagaatatttttattgattttttgaaaagatgacgaaatccaaaaaagagtgagtgagttagagtgcgcgaaggagtagccaaagggagcgtcgcggagctgccgcggctgctgcgcacttctccgactccccgttttggagctgtagttcacccccttttataggatccctgggaataccaaagcactgatgggctattctgattcactccagtttcctcatctttgttctttattcttatcacgcattctggtcccctccccctcccacaaaaaaaaattaattttttttgtttcgatagattacgcttttttattctttttctcttttgctgatgctatgctctccacccccgccccccaaccctttcccactcccattataggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggtaatgaccggccccttcctcccttcctttctgcgattcccgctttcccctggccaacaatatgccttctatcaccactgccagagcaaattcttgggatccagaatgaccccaccaatagaatttacccacttatgggcgatagctcatttaataggaaaccactgtttattttttgtgtgttcctactatgtgcccaggctccgtgcccagcactgaggctacatctgtgaataagatcctcatggagatttgggttggtgagactcatttgcaattgtgtatgcatgtgtgtaggggacgcatggaatattttaattaacagtgataatattttaattaaattccaaatttccaaaaatagtctgagaacgtgttcacatgataggtatgtggctgtggtgtctcctaaaaacttggagttcaaaggtaatgccctctatatctacaaagtctcaagataccaacacataatagctgttcactaaatatcagttcattgacttttgagcaaagtcaaaatgtggcctttcactgaaggagtccgaggcctgggttcctacctccagtgggactgtgacctctgtacaaccccagggatcctgtcttatctctgcttttctaccagggaacctttttcccacctgatctaactccttttccctgcagcttgacatgtaagacgaccatattgcagctgtaccgcatggaatagcggctccaaggcccaccttcggtggtttgcacacccctctttgcactgttcagaaaagcaccccctccttcccgcccctccccctcctcactggtagggcccgcacaaagtccacagggctgaggctggcttcttgaactgagctctttgtgaggagccttcctttctggggctctgctgccatctagtggaagacatgcacaaggttgggggaggaattgccgagaatgtggagaggggcctgaatgacttcacctttgaaccgctgccaggttttagctgcttctggtttggtccgagaggcctagaaaggtgctttcttctgggagatctgcttcctttaataacggtgcaagaccagtggttcgtactcgcattaccctgtgaagaggaagggctggcatttcaagccatctttgaagatgatggtggtttagtagtttattggggtgctttaccccggctgtccacagaaagccaaggcagattttaaagcttatgaagaaaacattgttagaattgggaaccaatttgtttttctcatgagagagcaggaaaaatcatcttcatatggttcatttgtttcgagaggatggtgaattgagatgttcttcaggacacccaaatctttccaggactagccaagcaatatattgctacaaacaaacttggctttttcctattccctttatcccagaagttgggatttggaagagtcctattttacaaatgagaaggctgaggcctgggagggaaagggaatcacccccagccccacagctgtgggactggtgctctggttgctggtttagcaaatgaaagagattccaggttctccaggtgaatgggagagagggtgcattggcaaacaggccctgcctctcattcttctgatgacagctcagtggataggcatattttctggtagcacatacgatatttttaatgttttattttggaccgtttccctttgagcacagtttcccgtaagtatctcagtgaaagagggaaacaaggttctttttcaggtgggttgctggtgagagacccaagagacagggttgtgtggtccccacacttgcactgagggatgctgtgacactgagcaggcaccctcaccttgccccagatcacctccatctgcaaaatgaggttgctaatgaccatgtggtcctttagtcatgatgacaatggcctgtgaaacatttaggggaaagggctgagtgtcacatccccagaatttctgcctgatatgtaaaaggggagtttgagcagcagagagataaaggcactttttggcactaagtaaaagcaagctaattggttgccaaggagttgggccaaggaaccttattttgagctttatctgtgtgcatcatttttccatgaagattaaaaagactattaattcggtgatagagacatatacaataaattaccatgaaagggccacaatgaccttggccgtatctcattgtaggttcagctttctgggtgggcgggaagcagtattgcctgcaagtcagggttgggagggggtaaggggagctggagtggaaacgaagtagaagaaaatagaatcttggcaacagctacctgggctctcattattttcagtggagcctgacatttgaagcataagaagagctgtcaacaacttcaaagcttcaggggcacattgacaaatgggcccgccttacaatctagcagccacgtcctaatgagcggccttaaaactggtctggagcccaacccccagccccctacaccaggtcagcctgtggaatttagattctcctcttctcttcctgccttcccctccaggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccggtaagatgaggcttgagccggggagggagatgggggagctcttttgggagatgtccggggagaggcaaaaggccgtaggaactttcattttagttcaggagtttggaggaggggtggtcttgagtagtctaaagtctgaagtttcattcctgggttgctttttctttatctgagctttatatattcgctttctctgctaaactcataaatggtttatgaggacaggtgtggttaaggcaaaaaaaattagtgcctgttaaaatattctttatgatggctaaagtgctctttgaagattacatatactgctcactggttgtgttcaaatctttaatcttttaaggaaaaggatggcttggagataagcccaagaggaaatctcgagggggatgggggcaaatacaggttaaaggaacaacgtcaagataaatatgctgcctgccttgattagtggtaagggagaccaaagaaattcttttttttttttttttactgtagggcatttatggccttctagctgtttgcttctctagctgtttgccccactgggcgcgggagggaacctggttggctttcggtgaggctttactttctgagcgctgggttctgatgccctcagttcatgtggaggtgttttgattttggccgcagcctttaacgttgcaattccgcctaccacgtggatcccacaattgatacatcattcctactggcccatttgttttgtagtttcctaataaaccaaaggcagtggtttgctgttgtcttattaaacagccttggccagtgtctactggttttttgtttttttttttcttggtagtggccatggcagagaccctggaaccttactcatccaagggagagatgtcaggagttcatgttttgacaatcagaaaccttaggtaaaaagctgatcacttgggaagacctttcggtgtgcttcacctcaaatttgccaagagtagttaaatcgctaggtggactcacgtggtaacttttttcaggatgttgttacatgttactggtgagttctacggaacggatgattatataacgtacgatgtagtgcatatgccctgtgctcacagtcaaaaagtcaggctttgctgcatatcagtgagtgacctttaattggctgcttaacctctctgaacccgagcttcttcatctccaaaacaagcctattgatacatcatcctacagccttttcagagcagctaggaaaattaaaatcagaaagaggtgatgcacgtggacgtgctttgtaaaccgaagtgtaggttggaccttcactaattgtgaaaatgctaccatctccgattttcaccctgattttaactgttccgactaaagtggatatgatggctttccttttctggctgcccttacgtgtttctagcaggacctgtgtgttctgcacttgcaggcttgagtgtggagtcctcccggccccctgcctgttcatctagggcacaggtttccccttgctggttttctgtagtcctgttctcctggatgcaggccaggcctcatggcgtgcacatgcgccctgtgccccttggtgggagagtccgttatccttcctgcagccctgggggcggttcttaggacccctgtggacccctgctgccttttggatagtggtcactctggcttccttcccttctgctgtctggcccgggcccgagaggtcagtcctccagtgacctgtcattttgtctcccaggctcggctgtctccttcctctctcatcatgattcactgtgggggaggggtcagccagttctttctctctggcccaaggacagctgacccccgaccctaaactcccccactgcccagctgttgatagccagagctctgctcaacactgtctcttgactaacagatcttttggggtctaactgccccttcctcctctctgatctctgattggggtaggggtgctgggtggagttaccggggtgtgggcagatccccagattccgtctagacccattctcgaaaaccggggatcccatcccccacccgtggccttcttgcccagatctttgggctggctgccagctccggggccagagtagggagcctgggattcagagactgaggacagaggcccagagggatacagaggcagttataaagactgtgttttgggggccttgaactagctttggtcagggactaggaaaggacacccccaaaccacatgaaaatggtgtgctaggcactaagcctcaggcgtggacagggcagagcacaggtaggtcctcggcagtttccagggtctggaaaggaggggcctgtatcgaaagaagttgctttccctcatctgcacttgggtttgtgcaactgactgagtcacatagaatcctggctgcgtggagttttacaacagtcggcctcacagtacaaacaccgaaggccgcttttcttgaaggaaacaccttccatggagaggcgattgtgcattgtggggccagggtgtgatgaatgggcaaggacccaggactctggccagtagcgggcacagagtgactgagaggcagaggtaggagatgcagattccccaacccgagctgttgccctcacctgctcctcaaatcgcacacttccctccttttctcgcagtcctggatgttccgtcctggagctgatgaaacacctgcggccagggtctcggaggtccacagtgggtggagggtgggggtcccgagagatggccgccaaccctcaggccgtgcagctatttgatgggaaaagctggttgtgaaagagctggcagtggttctgcagtgtgtggggagcgtatttgtgtgtgaaaggggaagggagagcaggagaacatagaggggccgcgtaagtgtggcgaagtggcggtcttgctttatggggctctggattaagatggtggcaaggcggagaggagccctccttccttccctgctcagcctaaaatggcttctggaagagcaagggccgcaagctgctggtatccctctgcagcaggtcctgggcagtgcaggcatgggtgggttgggcgggggatcttcctgactacagctcctagcattcctgttcctggagtttccaaaactggggaagcagaactgagccatagcttccctggttgccgctctgctgatagaacacccaggtctgcaagcgaggaaagaaggccattggagatgacctgggttcgcactctggcactgggagattgttgagatgtgataccatgctcggtggatgattccagttagtctagcagagccaatggcattgagtttacacctggcaccgggtagggggaggtgctcaccctccctctccaggcacccacatcccctctttcttcactagaagcccaccctaagatgctgcaccttggtatttgtgccacacacggtagccacccccaggcctccccacgccaaggccagagccccattgttgactagaacccattgtgctgtcctagccccttccctggctttacctacaggtgttccctcagattccatcgccaagtgagagggagacagtggtggcccagagaagttcgatgacttggcccttgatctagagtgggagatttcgccttgatgggtgctgggaaggaagaatggaaacccgtctttccatctgcaagtctctgagctacccctgaagccgcgaggtcatgggactgagggggagtcgttagcatgccctgtggggacaagcagccaggcagtgtggtgcttgccatcgctcttccctctggctgtaagatgaatgggtagcaggctgctcatcgccctccaaccagccccctccccagctcctcccagcaggccttgcagttgcatgggcattcccttgccatggcagccctgccccacaaggacagggtatgctggtcctcttatgggggtggcagatgaggtgcgtgcccagtgacgtccctggcctgtgaacactctggttctggccctttgaacttccacctgactgcaggttggagaagagagatggggaaagcctgacctggccttccctttcttcttcagcgtcagagtgcgtatctctctccccctattggtgaacagaagcaaagccatcacccctgcaccccaagacctcggccaccatagccaaaatgatgggtgctaaatgtactgggcaggaccatgtattccgtggttttaaacttacttagctctgaactctttatttggtaaaatcctaccaagaagtgcagataccaagttgatgaaatggagcacttctcagggcccatgcccaggtgagggagcccagcgggacccccagaggctcccagggcatccttgggaggataagccttttgtgcttgctggtgccggggctgcggctgggacccaattcctttgattcctgagccagagcgccacctttggggctcttctcccacttccgacgtgaaaggctgccctgtcctcctgagtggtatatgggaggtgactttgaggagctggtcagcttccagtaagttacgaagagctctgcatccagagtctcaaagtctcatccggatcccaggcccaacactcacagtgagtgacatcagccagatcacttcatctcccaagacttcattgattcacctgtaaaaggagatgtttgaaacagatgaatttcaagctcctttttattaatacctcaccatcatcaccgccgtcataagcaagcatgcagcccacagcagagctgcccctggcgcctgtgggtccagctgggattcccctaaggtgtgtcctttgcctccaccattttgccaggagggaggcgggaatgtcgggtgttcctggttatctgggcatcgttccttggctcgggtgaactgcatctcaatgaattgtggaatgtgctgggttagagttgccaacttctctcttccattcgctgagtgttcatggggttcttttcattcccctgtggggctgcactttctcccagttctgcaaagcagcaggaggctttggggactcgatgatgtcatttctgggacacatacacaactggatagtgacagattctccaggaagcacagagccctcattcttcctggcctgcttggcctgctccctgcatctgcctgcaatccagggatgctgggcgcctttctcctcatccctccagacgctggagagcatctccagtcggaactccccaccacagtcctgcaggaagtactaggagtgagagcagaggaggggcaggttggggaggatgctggctgacattcattgcttaccttgaaccaggcactgtgcttttacaaggattattttaagtgaatcctcagaacagcactacaacgtgggtattgctgttgtcattatttgcagatcagaaaatgaagactcagagaggtcaggtaacttgctcatcttcacacacttggtaggtggtgggatggagattccacctccttctgattccagagctaatactctgaaccagtgagctgtgttctccagaggtctgctttggttggaggggagctggagccctaggccctgggacggcctctgttgcccatggcaaggcgtgtggctgctcctgctctcttcagatctccagatgcagcaacctggagaaaggccctcctgggtctggtggggactggggcaggagtggaggctgcccaagctccgtgcactccacgttccagcttggagctttttgagtctactctccaaatccttcccatctccctgaagagtcttctgagaagtgtctcaaatgctcctcttcactcaagagcctcctttctttttttttttcttttctttttcttttttttttttgagacagtcttgctctgtcacccaggctggagtgcatggcacaatctctgctcactgcaacctccaactcccgggttcaagtgattctcttgcctaagcctccagaatagctgggattacaggcgcgtgccaccatgcctggctaatttttgtatttttagtacagacagggtttcaccgtgttggccagactggtctcgaacttcggacctcaggtcatctgcccacctcggcctcccaaagtgctaggattacactgtgagccactgcgcccagccttcaagagccccctttctttgagaagtttcttcagaagttatccatatagtagtacagacctagccattatagcacaccatcctctactatctaatgcattgatgcccagccttaagaagtctgaatattgtacgttttggggggagtcctccatgctgcctggaacagggaggagcacattgtcatgagtcgatcagaatggatcgctgatcggttcattgcctctctctctgctgcaggaggaaggatctcaggaagtcaccagcatctcacctctccaggtgggcaattaacgatggcgagggcacaccctcacccctgagcgtgccttctgcaccagcatattgcttgttggcatttttgatcaagagacttaacagactgctgagaaatttgtacctggtttttatttgttaaaataatattacgtacaaattttacaaactcatctgtgtttctcccacctaacagaacagcttttattttccgtgcatccttccagttcatccataggcatatatgtatgtatttacccatggttgtaatcttcatcgtcgcatgcatgcatgcaatttggttttccgcttccttcttctgagtggatattgtgaccatttctccatcctgtcatagcgacaaagctgatggtttccaggaatggctgcattgggtaggtggagctttccacagttgagggtgggggttggctaattacagctaggaagctagtgcacagatgaaatgatgtttgatttttttgtttttctctctgttcagtatcccctaccagtagagagggggatgtccttgagagtggtcctggggcagccctggtgccacggggaagtagcgccgctctgtggagagggctgctttgtgaatttgccggctggtagacaccgtgatccattctattgtctcctcattgttcttctccttgggagtcattcccattccagatcctcaagtaagagcaaagtagacctgtaaggcacctgggaggttatcctgcttactatctttaaactcttgacctaagccatgtaggaagaaacacattttataacacaactcaggatacttgtacaagtatatcaaactgatacaaaagtttctccgaacaatatttactcttaacgacatacggtgagcctgatactttctatcctactctatttggttaaaggagaacaacaacagaaagtgctggtcacgacccacaaatgcatttcatgacccattaatgagttgcagctagaagttagaaaaacacttatctcacccaacccgttattagacaaatgggaaaccaagcccttggaaagaggaagtgacttgcccacagtcccacgtctggacctagctggagggctgatgttgcctcagtatttgactaacctggaggagaggtggggcatgctcagggatcccgaggaagatgctcgtcttctgtgtagcgggcaacagagggcagcacggccgccgtcctcgtctccagcggcgtctctcctctggctgtgggaacacactgctcctttggtgccactctgagctgctgagaggcagtcaagttcatgcacatagtgctccccaattctgtgggattggacagtgtccccaagaggactcccctgaaaatcttcttagtaaaacaaaaagggaggtagagtctccctgtgcaaccggtgcacctgttccccctatgcctgctggcttccagaagttcattcgtatgccaataataagagttggttttgctagcagtgggacagcagagatgggcatgtgtgaggtgtgcttcccggtctgaggcctatggcagagggaagggagggccggggatacttgcctgcctcttccctggcagatgctcccacccgggcctttgtgggcccagggccatgggccggctgccccgcttgtgttatgaatgtcacaggggggagctaacgaggttattgggcagagaaacactctcctgtgacccatgtggaagagacctacagcagagcaagaggcagggaggctggctttgtcacactgttcatggcgacagagaaggcgtaggaggggcgggtggacagcaggcgtgggcgcagcaccattatatacgtccctcaagaggtggagatggtgagagggcaatggagaaaaagccaaggagacaggcagatggccaggtttgctctgcgttcatgatgggaggggagggctgtgcttggctcagggatccacggtgtctaacaatgctgctaacttgatgctggggcaatgggctgaccattaaaagagctgctgtagaaagtgtgtttgtaatagagtgtgtacaggaggaaggggaaataggagaggggctggtttttgtagatttaacctgattgtttttgctgtaagttgaagggtgacccacggttccctgtatgctgtgtctcctgcccccacgtgccccttccatgtctacacacagtaagctcactagagcaatgctaaaacgagaaagagtacgctttggaagacttgctgcactccaggaccgtcactagcgtgatggctgcaactatacccaccctaatatctgtcaacacgagcaggggcaacttaaactctcaaaagtctcagggttctcacccataccattagggtgacgctcgtgtgcatcttctgtggctgatgggtaaattaaacaggacgtaatgtgtagcgtactgcatgtggtggtcattggtagctgtcagcagctgtaacaggagaagttggctgtctttatttcccctcgatggaccaagcagctgctggatcatggccacccagcccctctgaaggagtgctcggaggaacacaagggggctggtcttccaagaggagccctctagcatggcagtggacggggttcaagcccctctgatttattatcctcattctgcacttccctgtagcaagtcacatttttttctcttagcaataaaatggggccttcagtctcatgagtcataacatcgaaaccgagtcacccatctgattcggatgcaatgattaatcttcagtgcttagttagagccctatgttagggttagaatcctctgccctaatgttctgagggttcttgctgttgggccagaggttgggaactgggtggaactcagcccccactcgcccactccctgcattgctgcttctctcatttccttttttagatcaaaccttttttttttttttgggtgggggtcatattaatcctcaatgcctgtccagagactataacaagatcccatctgaattagcattatgcatagattttgcccgtttctcccatctccttgtactttccctccttctcacatctggagcccctggtctgtcctgcttgcatggcccatggggtaccttgtctgcactggtctcaggcattctctgctctgttcccaccatcacctctagaggagactatgactcgctcaccttgctccccccaccagggtcaagaatgttaactcagacatgcttaatatgactgggatctggggattggggaccttgaatcctctgtgcattcattgtgtgcgcttagataagctgtcttccttccctgcctcagtctccttcgtttaatctggaacagccatggtgatggcaaataaacacaggctccttgtgaaagaactcgagggaggacatgcctgtagggcacggggtcactcgcgccgctgacctgctgccgtcctgtttctgagtctctgcagtctcgggagctccaggatccaaattcgttctgtgccctgaccttctgcctctcattccttgcagactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggtaggtggccaccaccttcttggctaagtccagatgtctcttctcagctcagggaaggagacgacggatttgattatgttgtgtcagaggtatttttctggtttgtttcctaagatcgacatccaagggagtgcaaagttcagcaggtgacaccccctcttaaggttctgaaaagctgtgcacgggaaaatacggaagaaaactcagcaagcagatgaagggggtgggggtgggagggctgtttaccgatgttcctttatggcgtgggcttctcagtgggtctgaattgttgcttcattgccatatttgtacacgctgccaggctgcctctgcccggcagcgaagagctgccgtgtctgctttcacacgctgaggctgtaaggcgcacagaggagaaaggagagccaggactcagctgcagtggatggagcagacacacaagaggtgccccactgtgagaacggtgtccgtccctggcaaacctctcgacccctccccgctctctcttcccttttgttcaatgcagtaatggattacaaagtgctttcaaaagacaaagtgccatacaaactcaagaaactattattagctacggagcttccccattctgtgtgccctgtggacggcccagaggctgttaacttcctgttgccagaatttggagctcctgagaagaaaggttttgagagagaccagggtcaagtgagcctctgaattcaatcagcaggaagctgcagtcctagcccgtccgagacaggatggtgccaagaggtcagagaggccattccttcgttttccacgggcaggacagggactgaagtaaccagccaggagcggggtgggcagtggctgagctggggctagaacccccaggctccggctgccccctggaaacttcccactccacccttgttgccgctcctgggatcttttggtttgaaaaaaaaccctggggtttaaagtcaacctgagagaggggtgttggccctgagccctcatgcatcaccatggagaggctgaagaatgctgggcacttcacgatgacaccctctggatggtccggggggattcagatgccctctgcgggcttttattgagttaagggatcatgtggtttataggcctatggctgaggcctgcacgagggatacgggacaggttaaacctcagagagcccacggctgcagctcgccggcctcctcgcccgcccacctggattttccctggcatttgttcccagctcagagaaatggcgcagggagatgctgacggagcaaatccggggtcctcctctgagatagttcgtagatatggttttaaaatgcgggctccaaacatacgctttttaaacgaggactccagaacacagactgaaaacctccctccagtgcagcatgaagaatgcttttctaatcctccagaggaaaatcgtggacgggacttaacgtttatagaaatggtacgctttcctccttttctgaatgtctccaattaaggctgccttacaaataggactctcagccagtttaagacaagcccttcctcaatgcctggagacaaaaatgtcagtgacaggagttggagcggccacccccctcctcctgcccccaggcattgtaaccttttcccccgatgttgatagacctgctctgatgggctgaccaccctaccggctccagccttttcccacctccctttgtcccccgttactgatctcacatggacagtggtggaaatttccctcctgggagttgctgctacgtctcttggcttttcgagaccgcaggcaagtcagtccgtcatctcatctggggaaactgtttgcctttttctgatactacgtagccagtccatttaagtcagctggccaactctgttaaatggatatgaagtgggtacgaagctggtttaggggtgtcctcctataaatcctaactgttggtcaagttgatatctcatttctataatgggcacacgccgtgtttcctaactggggctgcctgtgtgtgcctcattcacaccggtggacctgggttgaacatgttcatatttaaaaaccaagagtgaacgcggtgaaatgtacaattcataacactttttcaaagaaaaatctgagccctcaggaagttccaggcttacctctggcaccccggaggctggttcgctctccctgaaaatgtttttagtggaaaggttcaagcagctctgggctaggctgtgtgtgtgtgtgtgtgtgtgtgtgtgtgtgtgtgtgtgtttatgcacctttccaagtgctaaatctcctcccatccatcagcctgtgttctctgaaaagctgacgctcagagggaagaaaaataaaaggactagaatttagaacacattagtgtttggagggaggtgagttgtgcttcctgagctctgtttaccatttcacgagtcaagaagtggtgtatttccttcattcgtttctggaagtctttactgaaggcccagttgttgctagaagttggggtggatggtggcatctgggaaatagaggatgagattcctgccttcaaggaacttagcagttgtatgatgaagcaagagtaaagcgtgcaaaaccctagcaaattaagaacgtaaacaaaggtgtgctacgtaacgtgttacgaaccctaaatgcagtaggaaatcaacccaaaagaaggagctcatcaggcctaacgtagaatgccggcctcccagcagagaaaacttggtgatagaaactgttcttagagtagagaaacaaaatgtatgggcacgcaatggaatattattcaaccttaaaaagaaatgaaattccgatccatgttataacatgggcgaaccttgaaaatactatgttaagtgaaacgagccagacacaaaaagacaaatactatatgattccacttataccaggtacctggaatagtcaaattcgtagagacagaaagtagaatagaggttcccaggagtctggggagaggagaggatggggagttagtgtttaatgcgtacggagtttcagtttgggatgatgaaaacaattctgtagatggagagttctgatggccacacagcagtgtgaatgtacttaatgccactgtacatttaaaagtggctgaaaagggaaatttgacattatgtgtatttatgatagtaaaatgtgtgtgtgtatatatgtatatacacacacatacataaatggatatatatatatgtatgtatgtatgtctgaaacattctcgggccacgctatgaaatgcccataggttgatgttgagctcttccctggaaaagtgaaatacacaggaccacattttgccccctggccctagtgcattgacaaacgggaatcaggaagagctgacagtttcccccagagcccctgaagttatatgtcagctcctacacaccttggtggacatgatcccttcaagctggcatagctctttgcttctttgtaggttaggtcgtgggctgacagcgatcgagctgtgaaaagaggacacccctgattcttgagagatggccagactagtctctgtaggtcattggccagaagcagacttgcttgatatgaggaacgcatactgctctnnnnnnnnnnnnnnnnnnnnagctgacagtttcccccagagcccctgaagttatatgtcagctcctacacaccttgctgtttctgatttcttcaagcttgcaatgctctctgttactttgggggttaggtcgtgggttgtcggggatcgagctgtggaaagagggtccccctgattcttgtgagatggccaggcgagtctctgtggttcattggccaggagcagatagctttgatatgagggacgcatgcggctctgagaaagtcggcctttgttgctccgtctggttgccaaaataaaccagaacgcttcattccaaagagaaagctgagtgaggggcctgacagttttatagggaataaacgtctcagagagtggtatattttaaatactttttccttccaatcgtaagagttgctaaaaacagccagagaggcagtttggctgtaggggggacgtctattgggggtgtccagtgcctgggtaggtttgagaggggagggtgccactggcctgggtccccggtgaccatggccctgcttccttgggctgaatcggggtcctcttccatcccctctgcacactagtcgggctgcgtgccagcattgatctcactgcttccttgtctatagaacctcttgaataaggcccagcttttcctcagctctttatccagagcccctggcagagtcattgggagtgatgcttaagagaggaagggaagaggaaggaaggagcaaaggacaaaggcaggcagatgggtttccagtgggtttccgattcactggtctgtccatgtcctttgaaaagctgtgtcttttctttaacttcaattctgtgtcagggccttccgagccttctgagttttccccaaccttatcttagagtaggttaaatgaagtggcttcattttcatatgacacagttgcacaaattcactaactaaaaaatggaatggaggctcacaggccataaaggtgttgtgaagttattgcaagatacttaacagaagaaagactctagtcatctgttccttatatttatccttttttgtctaagtcacatcaaaactctttgtcacattctttaaaaacaaaaagcaaaaaacaaaactttagattcaggggatccatgtgcggtttgttacgtggatatatcgtgtgatgctgaggtttgggcttcagtcgaacccgtcacccagacagtgtacgcagtacccaatagggagtgtttcaactctcgtccctgtccctagacacattcttaaatattgcccagagaagattccaggatatcccttccttagggtcatcctggcattttacggtcctggttatcagtgagctattaaaaagcagggaggtggaggcgccgtggaagaagtctcagtttcgaccacatgtgtgtgattcatggggtttagcattgtgtgtttctgctccgtagctggaagtgccgccaccctcgccccacatgtcattttcaagcctccactgttacagattctgtcttctgtggactcttcagggcctgtggtcaggaaccttgtgaagtgttgctggaagctgggggtggggaggtggaatagaatcgggggctgatgcctccctctcctgcctcatttttctgtgggcctcatttggtatgcaaggaaataagccaaacagcctgtgaagaaaggaagaatgagatagtttcctaagttgtctctgcctgagttggccgcgggtctggggctcattcagccctttgtccccctgttgagtgcagtgcgtgtgtggtgacaatgaggtggtgcagttacactgagggctaatggtaggagttccgtcagcccattcatggaggcagaggagggtgcagggcgcggagctcgagccagcaagcagaggaagtcagaggcccttgtaacgagctgaagatcacaaacactgctgtgagggctccaggcttgggggcgggggcagccaggagggaagggggcaagggagggggcctatcatcatagaagttggaggtctgcccgacccccagcgcggtagggtaccacctgtccaggctgacagacgagcattatggcttcccttttaatcagcttaatttggggcatcttaacacaatggctggtgctttggaggctgcaggaaagctgatgtcctagagccgccacacttgacatgcgtgtaacaccttttgattagaggcgctttcgtgtttttccagccacttgggctctgtctctttttcttggagattctctggtctgtatgtctttacttagagcttagaagtcgaggtatataggaaaaaggagttctgaaattggaggcttgccctttctaaagccagtctgagctttcagccagatgtcactgggacaagccacgtcaactctccacgctccattccctagctgggaaacgagggcatttggctatttgatttccagaggccctttggacctccaaattctccaagtctgtgattatttgtgtatgtcttcttataatccagcccctttggaagcactaactccactcttctctcagcttgatcctctaatagaagcaacctggttggatttaaggtggaggtcttcctctctccaggtggctgccctcatctctacccccaccccaatcccatgcattctcctgccctcctgctttgggcaagacccaggcgatgtggagttggcatgtccagttgcaggtatcagcaccactgcaccatctcctctgccttcacttcccaccagcacacagaatttatatgcccttcccaagtccaaaaagggcccctgccatgctaaacaaaggtattcatatgcaaggcatgagctctgtctcatggaagggagaggccaagttctctttccaccatcagagagtagcgttcaacatcatttatacaagacaggcttttgcccttttagtcttgctgaactagaatgagggatttgtgtagtcgaaagtcaagctgatcattgtcaagtttcgtggaagtggaacctgaaggaaggttaggtggagactgcagagagggttagcgtcctgccttaccacaaggtaagtctagaagagggtggggaagggagttcagaattcttcattcatggagtgtacctgccttggtcatccttttatcttccagtcagaggggtcatcagtcaagagctggccaggctgggtgtggtggctcatgtctgtaatcctagcactttgggaggccaaggcgggtggatcatctgaggtcaggagttcgagaccagcctgaccaatctggtgaaaccctgtctctattaaaaatacaaaaatcagctgggggtgatggcgtgcacctgtaatcccagctacttgggatgctgagacaggagaattgcttgaacccaggaggtggaggttgcagtgagccgagatcgcaccattgcactccagcctgagtgacagtgagactccgtctcaaaaaacaaaacaaaagctggccgtagtcaagtcagtgatgatttggattgaaattaaaatgtgactaaagagagagtatgcagttttgtctatctatgaaaccttcctctgttttatgtgggacacctgggcacccactcttggctggaacttacataaaacactactgtgcacgcacatgtcacctcaagtcccgtggctctgaaagtccagtagaagtgacagccagacatcccagtcctccctgtagggttttctcagaactgttcctttaaggtctcaggctgctggaagggagggctgatagcagaaaaagtggggacactgggaactccaaagggaagacgcgcatggcctgaaaccgagttctttcgctttctggagcctggtctccctatgtggagggtcatgctggcatggctggcaatggttaattcaccgatggccatggagtcccaagttggccatattattgcggtaaaagatacattaacccagatgaccttgccgggggccagaatagagcccgtgaggaaggagagcaaggcaggatcggccgggaggcgagagggattttgttgaggagcaaggtcttccacaggaactgcgacttggaaagtattcaccaagggctgtgccatgcgaaaccctctttaaaggaaccgcatcgctacgcctaacgggcatttcttttttaatgtaatggttcagagctattgtctaccacgcctcgcgtgcacacgcacacacacgcaagttccctcagtcagccgagaatcctgccatctcttttagataacaaaagctcttaggccttatgctttgggtaggatttgtcttccatggacaggtattcagttggaaacaagtatatagtcactgcctctatggtatggagatactccgatttagtccctctgcctcttggggaaaaaaaaaaaaaattgtaaacatccccttcagcagcttctcaagtccctgtacagtggaggaacattacacgtgaacttcctggattcaatggattcttctttgcaagaaaaaaaacaaaacaaaaaaacagagaaagaagaaaatatcaatttagattgttaggtccaacgtttcactcagtgagtgagcacagggggtgacggaggatggctggaatgtggggttgaagctgctgttctgggtctcagctcctgcccatgtaccgtggagtgagcatctcacaccacgatgattctggcatttaagtgaactccttcacacggtgctcaagtggagaaagggctgtccatgtctatcccagcttagaagaaaaactgatggtatgagacttgccattcctctctgatgtagaacctgcctaagggacattccacagcagttctgaccgttgtcactttgtgccttaacccccacattcattttgattctatatttagtattaaattttttagattattaggatttaaggttttcaaacatctactgaaatgcaagtgcccctagaaacattatactttcaggccgggctcagtggcttatgcctgtaatcccagtacttcgggaggccaaggcgggcagatacctgaggtcaggagttcaagaccagcctggccaatctggtgaaatcccatctcaactataaatacaaaaatcagctgggcgtggtggcacgtgcctataatcccagctgctcgggaggctgaggaaggagaattgcttgaacccgagaggtggaggttgcagtgagccaagattgtgccattgcactccagcctgggcgacagagcaacactctgtctcaaaaaaaaaaaaaaaaaaaaaaaaaaccagaaaagaaaagaaacattataccttaacttttcgcacctagtgagtgataacctatgaggataatgctgccacatggtccttgagggaagaacttggggaagagccgaacagggatgaggcaggtgagccccatgtgatttatcgtcattcattcagctcaacaggtcggacagggtaagggtaagggatgtaaccaggagatgccacaggaacgtctgagaggtgttagcaagtcccagaggccagcgcccgactccatttcagcctcgttcagggtggcacggagactcctgctgctgcgtcacgtctgtcatgttcagcactcttcccagacacacagtcttgactaaagattgtcaggatcttgacacacgcttcattagtcttgactaaatgcgaatctatacctcatttcaaagaaatctgaattctttaggttccaggaccagtttattgttatacataatcacgatcatttattgagctccacttagcactgcacatatatcagtatcatctcagttgccctttactctgattattttgtggggaaactgagatcagaaaagttaaataacttaggtgccacctgcaagtatagtgggtgggcagcagataccacccttcctcatttcattgttccaggtgatatttcgtctctgcctttggcctttagtctgtggttgttcctaatcttagttttcattgaaagctgtagtttgaaatgtgggatagatgagagataggaaaggaaaatttaggggtatggaaattttgttccttagtggttagttccagctttattttgtttatttatatgtttgtttttaaagatcgggagcttgctgtgttgtccaggctggtatcgaactcctggtttcagcttcccgcctcagcctcccagagtgctgggattacaggcatgagccaatatgcctggccagctgtgttttagatctttgggaaataaagagaatgcttttgggcttggcaaaatagaaacctctgggtggggagaattgcacagtaaaagaaacaaaagggaagtttatattaaactatgaaaagacacagggaggttcaatttaacatatttgccttatgtatgtgcttcttaagagagtgcacaaaggcacctttgcagaggagagaggctagaaaatgcccgttagaagcaagtctacggtttgcaccctcttactagcaccagcaacggtccctgtctagtgatacccatgacttgtcattgcattgcatgtcatctgcctaagagaagctcctgcctggggcagacacactgtcaattacccctacaatatagactgatactaaagcaaggctgcatattcttgcttattcccaaattggatggctcaaggttccagaatgttgtagacattctgcattatatctttatgagagttaaggaaatggtaaagaagcagaaaaagttggggatttttttttttaagtatttacagtgaggcgcggtggctcatgcctgtaatcccagcactttgggaggccgatgcgggcggatcacaaggtcaggagttcgaggccagcctggccaatatggtgaaaccctgtctgtactaaaaatacaaaaattagccaggcgcggtggcgggtgcctgtagtcccagctacttgggaggctgaggcaggagaatcgcttgaacccggaaggtggaggttgcagtgagccgagattgtgccagtgcactccagcctgggggacagagtgagaaaaagtatttacagtttatgtgagggtcagtacgttggttcattggcttccttcttatctagttctcgggctgagtttgctaatgtcatagcacttctagtagccttccccttttctctgccacttcccagcttccccaggcagaaagcatctggtcggccccttgattaccaggcatccataagtgaccatcatttaggccagtgcttctcagaatgccaatcacctgggctccactaaaaggcaggttctgaatagctcggcctgggttgactgagattctgcggttccaacaagctcgcaggtgatgctgatgctgccagcccatggaccccacctggagtagtgaggttccttggcactttaagaacatccctcctttacttcacatttatttctactggaaactagcacagacttatgcaagctaaattacgcatgttttctccgtaggatgctctatgtcctgttcctcttactaacaactctggtctggaccattgttctaggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccttcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaattatctggccgtttttgacttatttataaaccagcagtcctcagaatggaatacacttgtctcatgtcagaactgtttcatgccgctgcaacatttggcagtggcataaaagacacattctaacctggaatggaatctacatgtgcctctgtgttatggcggtacaagtcattgttgacattgctaggggacgaggggtgcccatgcagccagcttataagctagaagcctcagtccaccttcagaaggtgggtacatcacagacactatgactggtcctcagaggatcgtccctgattgttgccagctactcattctgggctgtgaggaagcatctcctggcatgagaggtaccagaagcctgcggtgccatctccagagtctagggagtctctgggaaccctgcccctgcagctttcctggctcctgcctgctgttcttcgtggctcccacctgatttctgatccttcctgcacccctcttctgagacacaggccacaactacctttgctggagtctggagaagcagagcctgggaatgggatgtgacagtctccgtactgctgaaatgaattgccaggccctaggcccagctgctcttggaccttagctcagaccagcttctttcccgagagtgatgggtgtgcagaagacaagggcctaatgaacacttttttgtgtgttttgtttagaaacagggtcttgctgtgtcccccaggttggagtgcagtggcacaatcccagcttgctgcagcctcacactcctgggctcaagcaatcctcctgcctcagcctcccaagtagctgggattacaggcgcccaccaccacgcccagttaatttttttattttttgtacagattttttgtatagctttgttgcacaagctataacagacattttgatgttactgtaaaattaattttttccaaagttccttgtctggaagtcatcgaaggctgttttccattttaattctgacctgagttgtaaacaagatttaaaactggccgttggggaagtccagattaagatattccaggctgatctcaagtaacttcacttaataggacttttaagcttacaaggaccctagaaattcccctttgttcccattccccttgacatccgccattcttagcgacaaatgggggtaacttttttcttgggtttctgcctagtgaagtctgctggcctcctgggagtttcaagggcctctggttgccattcttaaccatccttggaattctctttggcatgacataatgtccaactgggttcctctccctccctttccctatctttttgctctgtaggatcaatgctatatctgtttatagcatgacaactccactccctctctcaaatgccacccagcaacactgctgggcttcccccattctgaacaatggatgttttaagggcgggaagagcagatgaagcacacagccgagcagtgagaaatctgactgtcccatctacgctctttcagacccagatcatcttataactggaaaatctcaaacttggaagtgcctttcctgaaagtggccattaaaaatgcagtgaagacctggaaatccccgatcttttgtgcgtgttcaagggagtgcttttgtatctctaatgactttctaagatttggagcttttatttagtatgcagaggtatccccaaaattcaccttcccagttggcttagcagtaatactgtcaaaatactgacacgaagcaagtactcaaaagctgaatattacaccagattacttccctgctctcctggcaattacagcaacagcaaaaatgctgtggacagagtagggagattcagagtatcaaggtaagcctagtactcacagccgatgtgttatgtggggcctgtactgagcctttaaggaaaagcacagaaaaaaacaggacacacaggcctatgaaatagcagagagaaacaacagcaaatgcaaatgagtctggggggaaatcgatgctaaggtgtgggagggggcccttgcagaggaacaggtttcctcaagcaagtgagttttaggaaaacacttttgttaggaagatcatgtgggtcagcatagtttggaaacggaaacagagtgtgaccttttccaaaaataaaagggatgggaagtaatttttttttaaatgaagggaaaatattccacacaatttaatagattttaaacaatataaacacagatgttaggcttgtgaaacaggataagcacagccacaaacattgatttgggattaccacccacctaatttctcatgaggcttaaagaaagaaggctggacgcttcaatatgactggtggctttccttgtctttgggctctgggggcctccccgtgctggaggggcggattccatccgctcggaccacaggctcagtcaaacagaactgggcggcctgagaaagcaagaccagcgcccctgcctctgtctcattgtccccctgaagctttgagtttatgcttcaagctttgagtttactcattattatggtttctttcatgctgattcgctcggaggaccctggcccttctgctgcgctcaccgccgccgctctggtaaatgactgtccgcatggtttcaacctgcagttcttcctgcgaagtccactaggtggtactaatgccacggacaggatcactcacaaggaaacccagagccagccgggtgtaggttgcctctgccctgcacggaagggaacacctccctccagcagacagcactggagcagcacccccgcctccgccatctccccagggcagcctggggaaggaacgtcaggcctttcccgtccacacctggcgcagttccctcacctgcttctctcactaccgccacatcgtgactccatctggggtggctggtgctggttcatcaccttccctgactcttcagtgactaatccagagatggcacactggcagcttacagaccaaatccagcctgcagacataattagcttgactcccacagtgattgaaactgtcttggatttacttgccaatacaagatgagagctttcacataaaagtcaggattgtaacgactcttgggagatttaagtcctggcaaccacaggcccgcgaggccgcgagggctgcagctgagtgtgactggcccctttctctaccccctgcccaccccacaaccgactgaacccgctgctctcttttacggcgcctgccagtcggcttagggcttacagctctgcagcctaacctgtgtctgttttacctccctggccaggaaggaggagccagtaagtcccaagtggagtcatcctcctccaaccctctccaccacaaacagacctggaatacttctttcagtttgtggaccataacctctccttctcagacgaagaaagaccgtactgcctcagtaagcattaagatctctttatgtctttatgagtttttagttatcagattacccccggggctgggccagatttttgaaattcctttgagatcccaacattcagccccacgcccaggtctgcaggtaggcccaaataaggtggggtggtaaagatctgctttttgttttttggttttcttttcttttgtttctggagatagggtcttcctttgtctctgaggctagagggcagtggcgtgatcacaactcactgcagcctcaacttcccaggctcaagtgatcctcccacctcagcctcccaagtagctgggacaacaggcatgcaccactacatctagattgttttaaaaaatgtgttatagaaacagtgtctcactatgttgccctggctgctctcaaactttgggcctcaaaagatccttcccacctcagcctcccaaagtgctgggttacaggtgtgagccactgtgtccagacagcttttcctgcttttgtttgtctggagagtcatttttagtgctcctggcaccatggagattccatgagaagacaaacctgtgagatttctatatttgttgaaaaagtgcaaatctctgtggctatgtttcggtcaacccattcactgaaaatcgctactcttcatcatccccttcccacacagggctcctgggcactgctcgtttattcaacaaatgagggctgggtacgtgcctggtgctccgtatgggacccctcattcaacaaatgtgtctcagtacttgcttttccagggatgagatctctgctctccttgatctcaaaggctaaagacagagacagataaaaagacaactgctacttggtggttggcccagaatacaagcgctctatgctctgctctggaatgcccccccggccacccactcgctttgtaaccttgggctcattacttagccacccagcaactcacagtaaactcagtgacttagttttttcatctgtgaaatggggttttgtagttttgaaagagctttccacaagcctctcctataatccttttataactctggtgaatttggtaccttgttttgtagctaagtgaatggagggtcacacggctcacttggcttatcacaaagagttaggctaggactggatcccagatgtgtctgaattcaaatatcatgcatcttctgctacactgggctactttattgatccatattttgcttactgagcattgagctgaaagagtgagacttttagcccagtgtgggcaggaaggttgcagggggtggggggggttggatgatgacatcacttagtgaaatcatcaggggatagttttttaatgaagacaaagtcaatgaagaaagtaaagggccttgtcatctaaggaggagtttgtcagtgaatgtacaccaaggaagtagccttttctttccagcgtctttgccttgccccttggctgttcttcatgctcattccattcaggttataaatgcgttgctcataaactcctgggaaggagccatgggttctgctttcctcccaaatccccaaacctatgtcaattaaaacaagaatcacagccaggcgcggtggctcacacctgtaatcccagcactctgggaggccgaggtgggtggatcatgaggtcaggagaacaagaccatcctggctaacatggtgaaaccccatctctactaaaaatacaaaaaattagctgggcgtggtggcatgtgcctgtagttccagctactcgggaggctgaagcaggagaatcacccgaacccaggaggcggaggttgcattgagccgagattgcgccactgccctccagcccgggtgacacagcaagattccatctaaaaaacaaacaaacaaacaaacaaacaaacaaaatcacatatctagtttgtccctattcttcagggacccacgaatatctgtgttattattatttctcccccaacgctccctccttcccccaccaagcccagagaatctcagtccagaggcagggaagccttgcttgtatcatcagcctcccaagcctttgctatttaaagattccttttgttatcctataggaagagatattctttttcttggtttttcgtggccaccttccttgccccgaaaaaagggacacaggaggaagggcccaaaaacgtagaggaaaaatactgtaggaaaaaatgctgattaatatttccaaaaatattattttaccatggatgcaatggcctgaggccctgcaagggtgaatgccacactgagggtcacccagcaatgtacaaatgaacaatgaaggacaactgctggcctctgcaggcttccattcattgctcagctctgtgagcctctggacatcttggtgaataccctcagaaaatcttgaagcaccacaggttttaaaagcagtcactcacttatgtttttcatatgtcactgtaagctcatcatgaagggactatggaagatttgcttccatatggcactgcctaggtattagggccaggacacctaggattttagggcctagcggtcttctcttttccttagcattctgtcagggctctggcaagaacaagaggattggcctttctagccaatgtcccccccagtgcttgctacttgcctggaatattatggactgtatcatacatttctgtattacatacaatcattgtgacagagtcaggatgctgtggtggaaaaaggcttaggtaataagatgatctgactttgaatcccagggctgccacttagctttacaagctctgagtctctgctattcttttataaaatctctctggattattagaaggattaaatgaggtagtctatgtaaagtgcctaatacatagaaagctttaacaagaatcagctagtctgaacatatgcaaacacaccaaggaccgtgttcattgcttttgaaggcattgtagatgcaatgttattttcccaaaaagtcaggggtggaggtggatatgggttttctgtggatcctgatgagactactatcaagagcacagcagtgaaacaaaagcatttacaactctcataatatccccttggtgctgccgcccttcttccagacagcaatgaacttgggcttggggagcgttctcttccccactaagtaacaggctaacaggcaaggcatgaaaagggattagaggatgcatgtattcaaataaaggggagttccccagaagcacggcaggctgagaaggcatctttcgactgtccatcagtaggaaagctgtttgactggcagatataatttttttggaaccagcaataatggggagctattggtgacagatgtcagatgttggcagagcagctgccaaaacaagtctccctccaccttcagacatcaagctgatggggactgggagtcccttcgcacttgggtcattggtcacattattatttctcagttgctggacaaagcagatggtttaccatgtatttgtgattttctgttggcctagaaattctgttcttccatcagggtacagcatgtaatcaattatgacagtgggtggtgcaagaaaatccctgccagtaaaagcccaagactttctcttttattaagtctgcataaaccactacaatttccaacttcaaagcaatagaagaaaaaagcaaagtagtggtgttataaataacttgggtaatcacaaaaaccacagttctcagttggtcccaaacactctcagtctgtactatctgatgtcagttttgtctgtccatttttattctgaaacttaaaatcctcttgtctctattctagtaagtcttaataatatacgtatatttttagacagagtcttgctctgtcacccagtctggagtgcagtggcacgatcttggctcactgtaacctccaccttccaggttcaaacaattctcctgcctcggcctccgaagtagctgggactatcatgcacagctaattttgtatttttagtagagacaggggttcgccatgttggccaggttggtcttaaactcctgacctcaagtgatctgcccgccttggcctcccaaagtgtgccgggattacaggcatgagccactgcaccctgcctctattctggtaagtcttaaagagctttatcttagaatcataaagtgacctaattaaaaataaacagaacaaataccaggaacatactacccctcaactaaggtttttttaaaaaaaaaaattctcagctgtattctattacatagtaaaaatagtaagttgccttgctttagtatgtgtgagtagccacatagaacagtttatatgttctccatcacccaccctctggataattttctttgtgaaagacaccttgcttatttgtatgcatgtgtctcaggaaataaattctttagtaatagagcagaacaagcatttttaacatgataactaccaactagagaaactcttgacataaattacacattttttcttgtcttttaaaaatatgtatgtattttttcttaaaaatcaggctcataaacgaatggctttctactcttttttcatgtaatctcctatcaggggaatgttatcataccattaaatattctgtaagaacatgatttctagggctggacacggtggctcacatctgtaatcccagcgttttgggaggcccaggcaggaggatcaccttaggtcaggagtttgagaccagcctggccaacatggtgaaacccgatctctactaaaaatacaaaaatcagctgggcgtggtggcacatgcctgtaatcccagctatgtgggagctgaggcaggagagttgcttgaaccctggaggcggaggttgcagtaagctgagatggcgccactgcaccccagcctgggtgacagagaagactccgtctcaaaaaaaaaaaaaaaaaaaaaaaaggaaacaaaccaaaaaaaaaaaaagaaaaaaaaccatagattctaatgaattgtttgggctcctacaatatatctagtactacttgaggtgctgaagacacagaagggaacaagccagtccccacggtcaaggaatatatatcctgctgaagaaagacaagcaatgaacctacaaaaatgttcataaatgatataatttcagaataaaatcggatgatggatagtgactgggcagcctactttgcttgagggaagacctcttgagagtgggacttctgagttgatacctgaaggctgagaaggaggcagccatgcaaatatcttgggaaagagctctgtgagcagaaggaacagagaatgcaaagatccggaggtaggaatgagcatgacgtggtctacgaacagagagaagccctgacggctggagctggatgaggaggggcagcgaagagagaattgtaactggagggccaagaggggccatgccacataggccttgcaggagttgggacttcattctaactgcaatgagaattcaatagagaattctccagcaagggagtgacacaatagggacatctcttcaatggctgagtaccagagtagaggcagcagagctatgccaacaggctatcacagtaatccagacgagaggtgatgaaggctcagcctgggacacagtgagactccagaagtggtggattcaggacataatttggtgatagaccccataaactttttttaaaggttttggatagatagcttttatcatttatttattattgaagatatgtacgacacaataaataagcttgcttcagacgtatatatagaactctgtatccaataatgagtgaatccacattcttcacaaggacacacgaaacatttctgtgaaatgcctgtggactagtccacaaagcaagtctctgtaaatttcaaaaatgtatacccttgaaaatctctgaagtcctggagatttaagtctgcaactatcttagtcttactaccaagaatagcccctaaggaaaaaaaaaaaccctttcaataaaaaaaagataaacaagaataatataaatttcacagactccagctaaccagcttttggtcacaatgtaattaatttcattcttaatgcattgctgaaaatatttaaatgcctggggaactggctccaacccacaatctcctcccctaccctacattccaaatagatcaggcattttacacttggctcatcttcagtgaagacagtaattaatctttatttgaaaacaagatttgggaggcagacgcaggcagatcacctgaggtcaggcgtttgagaccagcctggccaacatggtgaaaccccatttctactaaaaatatagaaaaattagctgggcgtggtggcgggtacctgtaatcccagctactcaggagcctggggcagaagaatcgcttgaacctgggaggtggaggtttcagtgagctgagatcacgccactgcactccagcctgggtgacggagcaagactctgtcttaaaaaaaaaaaaaaaaaaaaaaaaaaaggcaggaaaacgagtaaaatccagcactcactgcattattgagcctacagaaatctatgatgaatttgacagggaatattaggataggtaaagaatcaagggtttcatgagcagtcaagtggagggtgttaccatttac

SEQ ID NO: 1257 - DNA, 6478 bp, Homo sapiens
agagcgagcaggggagagcgagaccagttttaaggggaggaccggtgcgagtaaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagactttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccatctgatggcacagaaggatcttaattcccatctctatacttctcctttggacatggaaagaaaagttattgctggtgcaaagatagatggctgaacatcagggtgtggcattttgttcccttttccgttttttttttttttattgttgttgttaattttattgcaaagttgtattcagcgtacttgaatttttcttcctctccacttcttagaggcattcagttagcaaagaggttggagcaacaactttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattcttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattttgaagttttggagagggaagtggagcagccagcaagtaagctagccagagttttctcaagagccagctttgctcagcacactctcctgggccccaaggagtcccacggaatggggaaagtgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggactttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacct

SEQ ID NO: 1258 - DNA, 870 bp, Homo sapiens
atggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtga

SEQ ID NO: 1259 - DNA, 55996 bp, Mus musculus
  misc_feature (29253)..(29272): "n" at positions 29253 thru 29272 can be any base
  misc_feature (31023)..(31239): "n" at positions 31023 thru 31239 can be any base
  misc_feature (42691)..(42710): "n" at positions 42691 thru 42710 can be any base
  misc_feature (46987)..(47006): "n" at positons 46987 thru 47006 can be any base
  misc_feature (48271)..(48290): "n" at positions 48271 thru 48290 can be any base
  misc_feature (50692)..(50711): "n" at positions 50692 thru 50711 can be any base
  misc_feature (53136)..(53155): "n" at positions 53136 thru 53155 can be any base
  misc_feature (55549)..(55568): "n" at positions 55549 thru 55568 can be any base
gtagagattaggacagctattttctgaagcttaaaagaggaatacaaaagtaaattaaaataatagcagaacagcaaaggcaatcatcttacgttcctgagctagagagggagatagcccagataaacacagtgcaccaatgttggtaactgtatgcaacctagaaaagatgtcggtgaagcacacagtcttgagaaagccatttgtgaaatgataatgaaaggtcagcgtacaaggaaaaccatcttggagctgagatggaaggaaggaccatccagagactgccccacccggggatccatcccataaacagccaccaaacgcagacactattgtacatgccaacaagattttgctgacaggaccctgaaatagctctctcttgtgaggctatgcaaatacagaagtggatgctcacagtcatctattggatggaacacagggcccccaatgaaggaactagagaaagttcccaaggagctgaaggggtctgcaaccctctaggaggaacaaaaatatgaactaaccagtacccctagagctcatgtctttagctgcatatgtagcagaagatggcctagttggccatcgttgggaggagaggcccttggtcttgcgaagattatatgcccccagtacaggggaatgccagggtcaggaagcaggagtgggtgggttggggagcagggcgggggaagggtataggggactttcgggatagcatttgaaatgtaaatgaagaaaatgcctaattagaaaaaaagaaaaaccataatcaaatcattagtatttaacaggcttccattcactgagggagaaaactgggactgagaaggttaaatactatgctcagctagtgaaataattgaattagaacacaagtccctttggtctgtcctcagaggaagaaaacattcccatgaacagggacacaggcagtctaacaaagggaaccttccagcttctttctccctgctcccggtgcaccacccagctatcccactctctctgtaagtgactaatgctcccttctacagaaaactgtctgtacacctgtctctgctttgactaaagtgccctacactctaacctaggcccgggctctgttgtcttctctcccaactccaactccatgatacctttttaactccacagatctcacttcagtcttcccttcttgccctccagtgtctccttctagcttcccctcagcatctgctgacagggaaaggctgtgcaggcagagggtacctatccccctctacgggaactgcatgggctgtcagagataaactccctcagtccccctcacccactcacacctcactgccccagcaatttctctcacatcacctctcatccagggccctagaccagctttggtagtcttagtttgtcatttggggatagtccacaggctaatgctgagagtatggactatgccttataccaacccttccagagggacagtgtctttctggtagggagtgatctggaaaacagttttagtggtatgcaggcaagtattttacttcatatttatttttgtaggtattttctattttttggtaaggaatgttgacttttccattttcgactatcacgtgatgtcttattttaagaataaaatgagtggggaaacaagtaagttgattgttaaaaatacattttactggaacatgtctttaatatatactgtggtcaattgtgcgatgtacacacatgtgtgggcaaaacactcgtgcacattaaataagtaaatctgaaaggaaagaagaagaaataagtgatgtgagcttcacattttgtcgtcaggtggccagttgtcctttttagccaggcctcctgatgattacagaaagatgatgcttctatcagttgggcatatggtatggatacttacccatatggatggcttatgctgagtaatttatagtcagcccgtcagccaatctttcccaacagaggcggcacaggacgatcatgtcttaagtagtgcctacctgagactaaaccccatcaacagcaggtgagcgctcatgaagacaatgcttctcattcctctgcatgccagtacatgcatggagtcctggaatgtctctgtgtttagtgcagtctcatatacagaaatggcaggggcaggatgctcacctgggtgttgaagtctggggctgcagaaaagctatttcccccacctgtctgctgcagccccttcccgccacctctctccctgctagctgcatctcagtttctgaatgttcttctcattatcatttccatgttattggatcacaaggatcttggtgtgctggttttcatggtaggagaatttggaagattgaatagcttctttcacatctcaggggctgggcattcagccctcatctgtcaggctctggggaacttttctttgggccgtgctgtcccttcaggacatgcttgtacacaaagaagctcaggaaaggacacagaatccagctaatttatcttcacatagtttgacttgtaaagccatggtgggactaacaatgtgtactttggatctggctttcagttatgctaaatacattgcaagcaaacatagtctcttcatcctgtgggaaatataatcttccaaaggtgaaaatgcctgtatgatcctcactgcagattacttgcaaagttaaagttcttccttttccctgtctatgaacataaatacatttttttttcacaactgagattttattgaggagcagtgtacacagacattttaatttttttttgtttgtttgttttcaagacagggcttctctgtatagccctggctgtcctggaactcactttgtagaccaggctggcctcgaactcagaaatccgcctgtctctgcctcccaagtgctgggatcaaagttgtgcaccaccactggctggctagacattccaattcttaacacacatacccaaactttgaagagatgtatatttattatgttcacgtaccctaactctgaagagtcacatcgtgttcatgtacacaaatgaagagccacgccacgtattgtttctcgttgaacttattccagttcctgcctcaaacttggcaagtttccttaagacctcacatgacacacacacaacatacacaaaatttctgtctttcacagcacattatcacaactgttagggaaatggactcccacgaccacagacattacagttctgacaggggaaggaacaaggagtggtttccttaggaaacagttctattagagacaggagaccagatattactgaaaatattccagacatgaatgcatgactgagactccaaattgccatttagtatgctttgtattgtaggatatgaaactagacccttctacagaatgttatagtgaccctggagacagtcatagcctctcctgattcaataccctgctattttctggttgtaccaaaaaaaaaaaaatttacacttttaaaatgggatgaggtgggattccctcaccttttaaaaatgtttctagagctactataaaattcgcgtttacaaaatcgttgataaaacgattcctcctgattgtacaagaagggaggggcgaggacgaatgacagatgtgatgaatgctagatcagtcttggcttctttctcttcgtctgaggctggactatggttttctgtctcttccttttctgcaggcagatctatagtttgctggtcactttgcctcttgctctcctcttcccttttgttgacatttttttttttggctgatttggcagcctttttaagcttcccgtccaccttggcaggggaaagcttggtctacagccacagagcagagcttgggcttggctcttcatcctcgctaaccttcctcttgagcatcgtggcggcgctgcgtggaagatgcgtgcaacggacagagctacactgcctagccaccaccacaggaactcctgtgacccccgaaatacattttttattggtcaatagaaaatctgatacgtcctttggtcagtgtaagcaatgatgccctctagtgacagaagatttattttgtagagactctctgtgtcttaaaggtaccatctaggcaattttccttatttaactctgaaaacaaaatagcaaacattaagcaattacttttggtaaaaagggacttcttacactaaccataagttttaatagcacacgaagaaacttagagttgtaagaatctagcttttacaaaaactgagaatttactggttaggcagtgtggggaggccaagtttcaatcctaaagataagtcattcaggggtcaggtggagccccaggccccacctctccatgtgacatcctctcagtgtgagtgagcttcaatctgtcaaaccacggggctttctccacaaccaactgtaccaacagtgcatctcatgagtatgtttatccaatgtcaaatccagagagaaagagtttgtgtctcagttgcttccagcaaatgatgccaaggttaattccaatggaatgtgatatgttgtttttcttggccaagcagagtccctggttctacatttggtgtcaactttgctgttatggttaatattatctgtcacattgtctagactgtggtgcccgaatatttagtcaatcacggttcatgtttctgtgatactctattttgtatgaaattcaaactaaatccacaggctttttgtaaaattatggcccttaacaatgtgactaggtgtcctccaagaaactcatgaaaaagcctgactatgattgagaaagggaggagtcctaccagcctttggatttgaactacaaccctttcatgagtctctatctggtcaatatgcactataggttctaggcacatcacactaggcaatcatgtgaaccaattccagaagatgtatcatctctgtatcacttctccagccatccatttatcctctattctagtgatcctgtttctcgtcccctggaaagcactgacttaaaagagccactcatgggggctagagagatggagcagcagttaagagcattgactgctcttccagaggtcctgagttcaattcccagcaaccacatggtggctcacaaccatctgtaatgggatccgacaccgtcttctggtgtgtctgaagacagctttagtgtattcacatacataaaataaataaataaataaataaataaataaataaataaataaatctttaaaaaaaaacaacactcttatcagatagtcaaggacagaggggttgagcagtttttctagacccatcctggaagtctcattactaggaaggaggagaaaagatgtagggttaaataaaagtcatggatgtcctctacagttggagactattaaatcaacttattgctatttagttaaagcagtttggctggcagcaatattttaaaatattagctccattaaggaaagaatagaaatattgtctgtagtgaaaagttaaaatgtttctacctattaagtttttacagtcacttatgtatgtgaatagtatgcaatctatccagaaagccgtgctatctgtgtacagtagaaggatactttaactcgcatggtttggtttgagtaagccaggatgactatccagagcactcctcacctccagtggcatgcctggagctatataaaagaacacatttctaagagctgaggagcaagctcagtgggaaagattgctcggtgtgcaagcatgactgctcgagttcagatccccagcaaccactgaaaaagccaggcatggcctcctcttgtaactccagatctgtctggggacagagataagaggatttctcagactttctgggccaccaaggcaggttaggtgacagaacatcaagctccaggttcaatgacagaacctgtctcaaaggaataaggcagacagtaatagaatgacactacatgacattcatggatgcacatttgcacacacatacaccatttgggtttggtttcgtttattgcacttgaaaggatgataacttttcaaaatgtattgttaggataaaaataacctatagaaatacttactgccttaatttgccttctgtcattgtgataaaacatttatccaaagcgatttagggaggaaagagtttatttcatcttatctataacaactcccaggtcaccatccatcactgagaaaagtcagggcaagaacccggagcagaagccaggaaaaaccactgctcacctccttgctctccttggcttgcttagcttactgtgttatacaactcacagccacttgcctaggggtggcaccgctcaccctcccatgccaatcagcaatccataaaatgcccacaggctatctgatggaagcaactcctcggccgagagtccctcttgccaggttactgtgtttgtgtcaagctgacaaaaactaaccagtgaaaatacccaaagtggcctcctcagagtgtcaacaaggtttactcactcaatagatattcctccaaaggttccatcagaaagaacttcagggtacggcatgtgtactcacctccgcttagatgatacagtatatgttagcatattacagactatgagaaatcacagattaggatactctaagcattttttttgttttatgattattgtgtgtgtatgtatagtgtgtggcatagttaaaagctgtggaggtcagaagacaccctttaagagttggctttcactttctggtgtaggtctggatgatgaattcaggctgtctgcatttcctgttaagtgcctttaaataatccctcaccctgccaagttaaaaggtactaagaatgaattttatgattcagtgaagttgctgactcaagtttatactcaagagctgttgattttacctagagcttatgctccacacacccccaactcccccctctttctcctccttccccctttctcttctcttctcttctcttctcttctcttctcttctcttcttttttcttcctttccttttgcatggaacttttcatttcaaattgttcttcctttcctttcaattttagaatagttgtattaggggcacagcctgaggcttcttcatggcagcaacaacctacaggaagatgaagcaaaggggggtgggggaggggtagggtgggggtggggtgggtataagtttagtgacagctgccaaacagaatgaacagaacgcctacaggaaggagaggaaggagggtgacaatctagattcagagcacttttaaaaacacctgcagaagacaatgctgcaggatgtccccccactctctctctctctctctctctctctctctctctctctctctctctctctccattctgtgtgtgtgtgtgtatttgtatattcttaattagatagatcctccagggaggaaaagaagtagaaacagaagctgagcgagcgatcagtggattttgcagaccttctgacccatagaggtggagtccagaaactgcttcatgaacaggaaactcttggtgctgaccttgaacaaacttacttaccttctcggtgaacaagcggtttttaacctacagggctggaccaccgtagagctcacatatcagataccctgcatagcagatattcacattacgattcacaacggcagcaaagttacagttgggatgtagcaacgagatagcatcatagttgagcgttgccatagcatgaactgtattagagggtccagcattagcgagggtgagtaccactgctctagaatgttcgcacgacactaaagtgctacctacttttccaaaacaaaagtgactttgagatgcattcattaactagcagtaaagaagtataagaattttttttaacgaaaattggtcaggaaataatccgtaacaaaaggaggaagtaataatgtctaacacagcaggtgagggttttcccttttactgaaaatagacttctctttttgatagatttatatcctgactatggtcccctaactcttttcaccccagctcttttctaccttccatcctatccagatattccctttctgtcttgctcaaaaacaaactggcttctaaggaataatacaaaaagaaacagaactaacacaccgcaattggatgaaacaaacagaagaaaaagaagcccaagagctggcacacaaaacagagacaagctcatgtgcacactcagggatcccttaaaaacactaaatttgaaggcataaatgcatatgcaaaggacctgttgcagacccatgcaggcctgcacatgctgccccagtctctgtgaggtcatgtgagctttgatcttgttgacttggaaggccttgttttcttggtcttgtccatcccctctgggtctcagactcttcctgcctcctcctcttggggttccctgagcactgaggggagggatttgatggagacatctcatttagggctgagtgttccagtatctttctctctctgaataatatttggctgtggatctccgtattaggagttattttattataatgtatgtgttgtttgtttgtttttataacatacatatttgtttttttccctaggtccctgggctatctagtctcaggttcttgggtagcgtcaggtttatgttctatcttgtggagtggggctaaagtcaaatccagtattgatgggttgctcccacaaactttgtgccactatatgcactagctcatctctctagcaggacaccatcatagatcaaaggctttggggtagaggtgaggtttacctttctcctttagtagcatgcagaatatcttccagtaccaaagatgttggcatgtagggatgaaggctctatgtaggcactttcttcttgctctcaacttctctatattcaatgagttgtgtgggtctcagtttgtggggagcaatctatagtcttggcaacaggctgcattgtttggggactcccatgcaactctttttggccaacgattcaattagatgcaaccccatccaggaaaggaaaacttcatttgatgacaagagatgttcacttgtggctctgtctccccccattatttggctatagatcaccttcatgtatgcttatactttaggaagactctgctaggtttccatacctctcaaatgccctttaattttagctgtctctccctgtattcccattcatcgtcttcctttcccctcccccacttgatcttcccatcataactacctattttattcctcttccttaataagatctttctgtcccctcccctagtcccttactctatatctaacccccgtggttctaaagattctggcttggtccctgagttaactgctgtgttatttgtcatagtcatttaccttcattctccatttgggaaacgaagccagggacattcccctcatcaggatcccaaagcctattatctctacctctgctgtggtgattgtcacttcatgtatcatatatgagctctgtggagggacctccctcatcagaatcctagggtgtgtacctcctctgtggtaattaccattcagaggccccagaagccccagcagacctgtcactgacaaaatattgaaagtgaaggcaaaatggtctttgtctccagcaatcagccaaagtccaattcaatacagagttcagaattccttccagggtgagcagcaggcagaaaaaaaaatctcacttgacctgagggtgtgactgtggaagcgcccaggatggggaatgcccatttatgcaatcaagccctgcttggggccccttctttcccccgccccccacccccaccccgctcaggccgcctgtgcagtggtgagtcagtgggtttccccgggagaccagcagaactttctcgcaacccttggggctttacgaagattgtgtttggtccctcaaaagaaaaaaagtgacatacacgtgttcaaagcgatttctgggaagacctgaataggagcgaagcggtttgtgcgtgccagggggcgggcctaggcaaagtacatacccagaggcagtctagagctggtgggtggggccgcaggctgcccacacaggccgcccgctgttttcccttgctgcagacatgctgtggatctgggctgtcctgcctctggtaagctttgggacgcctgggatgtgggacgctgcatactggggaccaccacatgagattccagatgtggctggcattgggtgccaccggtccagatgtttagaaacgcaggggagctgctttcgctcttggctaagtgctcagggctgaagcccaagtccagcgtttttctggaaaaagtttgggtcggggcggggggcgggggcgacggtcagagcttggtgctggccagctcttggatcgatcgctttagtatggctggagagggactctggcttatagacttgcccagacacttttctagtgccactttagggcactagaaaagttcgctccgaggctccctggcatttgacacttctgacagttcgctcaaccgggaagtgagttactctgggctgtatttacaagccaagcattagatcataaaatttctcaaagtaactttgtctgcgaagatttgtttactctcctgtaacaacacgggaaacaaaaaaaaccttcccttccgggaattgagctgtcaaattgtggatggctgaactggtggatatttttatattgtttgtactgtttcttctgttaccctctttctgctggcactctcacagcagatttgtcccagtaaccctagggctctgagtcccagctcctccttgtctgctgcaggcacagaagtaagaactctccagcattcggtctcttcagaaatgcctgttaataaatgccagtccgagggattcgaccctccgaggttcaatccagttctgaatttagaaagattgctttatcaggtccctaaaaatttgccgggcacaaggatctcaaatcggttttcacagcagtggtagaagggaggaagacaacctctccttacttttacaaggttaaaagaggttccgagagcttaagcatttaacagaggtcacacagctagcaaatgacagtgccgggcttcaattgagatctaactccaaggggcatgtacatacacacacacacacacacacacacacacacacacacacacacacacacactactgccccatggtatggttaagagaaaggtttttattgtggatataaaagagaaaatggccagaggcatctggaagagcccagaacatagagagaaagaagtaaactgaacatggccagcagactcgaccagggctatctgagagagagagagagagagagagagagagagagagagagagagagagagagagagagagagatggagcagaggctagagaatagagaaaaccgagcgagagaagcaggcgcagaggtgagagaacagagtgagaagagcagagagagcaggtttttaggttaaatgagtcgctagtggatgggaagcccaggagctggagggagcttgagtaggggtggcagtgagcaggactagcatgcactttgaaatgtgcaacaggcacttgtggtccaagtatgtgctttgatgtgctggttaataggcactacaggtagtctcctatgtcccatctgccagaggtaagggaaatgactttccaatggatcagaggaggcacatttagtcaaatccttaatacaagcaaaccagataatctgacaacatggtgcagagactgtttgcttggcagggcatgtacaaacatgtcatcttgaagggtttttttttcctagcgattcttttccacaacctgatttactgacctccatccctaccctagatccatattgttcttcccctagaagggacagcctgcaggtgaggaatattctgaatgggaagagcccatggttagagataggagcaagctctaagagcaaactgagagagagagagagagagagagagagagagagagagagagagagagcaggcagggagacatcctttagaagcacagtcatggggagtggaagaggcttagggaaacaccatcagagagaggaatctaatctcttagaggcccaggggtgcatacagaaatgcctgatgtacctgcaggtctcaaagagcaggttccagtgagacaccatgagggatagatacaagcaagcatctcctaggggaaggagaagagagacaagcagttagacagccttagagacacagtaagcttcaggagggagctacctgagagacagacctaaggaggcagctggaagcagagagaggaaatggacaagctagacagagcaagctccggggtggagctcagaacatgggagggagaacagggtgagagaggaaatcagcaagtctcttggtgacaagaatttcaattctggacatccgcaagtggtcagggtgtccccaagtgggccaagacacttgtcagagagaaatgtccaaaaatcacaaaggataggcatctctttcatgtaatggggtcccagtagggagagagaagctgtctgataaaccagcatgacttctgtagcaacagacagagaaggaggcttcaaggaggaaataggtagaagtaaaaagccgctgaagaagcggggctctaaaatttggagttggacctggtaagtgtcagaaaccagaagaaacaagtattctataccttagaagagtcaagtcagaagcttggtttgcttaggagaagctgagccccttgttgggcaccagctatataaactgtgacatgacttaaccactctacgtgtggtgaagggggaggtctttattgtggatatgagagaaagaagagccagaggcatccgaaagagtgaaaaccagagagaaagaaatagacttaacatggccaggagtctgggcctggtcataaatatttgctaaaaaggacaatagtgggggatggggacagagaaatcagtgagagaagcaggggtggggtggggctcagtgagaagagctgggttaggagccctatgagtgactgatggggagggaagcccatgagctgagggcagtttaggagaggggaggtggtgagaagggctaggatgctggctagcatgaactttgaaatgtgtaacaagtacttgtgataccagcatacactttgacatactgacccttctgccagagataagggcaatggactcctttggctggcttttatctaatttccagaaatcctataggccaggtagagctcatttctagacagttggacagctgaacggtcttttggagtttgggggggaattggagtttcttttgggcacagcagtttgctgatttgcatctgatatctagaatataccaagagtttggaatggtaaaggctcttatacttggtaccttatgaaggggtggaaaaaaattccttttggttctttaagaagcgattcataatatttgtccttcagaaatgtctttaggaaattttgagactctcctcagtgcaaagttcctagtccccactccttcactgtagtatgggtggcctggaaaagctctcagctcttagagtaacattaatgaagtaacaggaggcaaaaggcctggagctatgctcagcttaggggtagctgtgtctttaccacaggatgtgtgcctcaagcacccaggaaacagcctttctaaaagaagacacactcatacatgcatgcacatgtaaagtttacacacatactagtacataaatgttaaaattaagtataatttgttatatttatgatttatggcctaggaaattaaagtttactagacagtattataaagtcagacaagtaaaattgtaataatgatcctgtcacctccataatccttgcggcatgctatagtaccttgcatccctcccatgagacgcagacgtgttcttactcagaacgtggacttgcccaacaccatgcctccatttttctagcattgtgttacctcgagtctctcctaaaatatgactccacatgtagtatggcttcctcagttgtagcatgtgtgtgtatgtagtgtgtctctgtgtgtatgtgtgtagtgtgtgtgtgtgggtatctgagtgtgcagtgtatgtgtatatgtttctgtgtgtgtatgcctctgtgtgtgtattaccaagtggtcactagaaggtttaccctgcagtttttagggatggcacccgatcacacactagacagctgctttcctcatatttcttagagcagatgttaaaaatggctgaagaagatgagaggtgatttagaaagcaaggagtaaccctacagaagcatctcacaactgtgggtattttggttcattttgaaaggtgggcaaagacagctgttgattttacacttcaatcattttctttaaaacaactctggaaacatgaaatgtttttttgatttttgaaagggctttatttatcccagaagggacatgaaagttttatgaatacaataaggagattaaatataaattaaagcactaacaagtgtggaaaatccaagttttgtgggttctgacgcattggatttgttttctaactaagccatcttctcagcccaaaacccaagttttaaaatcatagcaagactgagaagcaagaaataagttgatgtctggaggccgtcagcatccctctccaaatactactgctgtttacaatagacagaattattgcctttagagccaatggagactttaatgtacgatttttctttttattctgacactgagattacaggaaggtcaaaggtgataaagaactgacaaccagagcctgatactacttcttagtaagctcttggagagcaaatagtctcggggtgagagctgccagtgtatcagaggccgggggctccaggatgctcaatggagaagccaatcgccacaatccggttgctggctggaaagaatcactgtttttcagagataattagaaacttgaagaaggaaatccccctgcaaaagccccttctaacttatgtgctgtgggtgaattctcttggttccaaaagtcccgtactaagcacatgttttatacgaggtgccagagaccacttactaaagagaaacaaacagcatgggatttaaagatgcaatgaaataatgcaataaaaattatcttggagccaggtttaagatagtgaatccatctcttcttctttttgagtaagtaaatatttaaaaattgcccaaacagtgtgaaattaaacataaattctggaaaataaagtcattttttaaaaaatcagccttatgggaacatctaaaaattttacttacagcttctgagccttatccacacaggtacataattgtatgtttaatcagtgtgatgtatgctctgttctctgacactcaatatatatggtaaccggcttatgtttcttaaggtaatgatcacctcatgacattttacttgatattttatagagaaggtatttattaaatgaccttgaattagcataatttcatttattaattttatattttataaggaaatgttttgggtgtaagaagtactttgatgatagtgtttacctagcatgtaccaggcctgaatttgatcccagcacaaacaagcaaataaacaaatcagtcaattccacaaagaagaaagcagtgaatagaagtgcttgctggcaagtcttccaaccagagctaggtccctggcccccacgtggtgtaaaagagagctgtcttgcagcttggacctccactaatgcagatacactcacagacacacatgcatgcatgcatgcatacaggcacacatgacacatgcacattcatgtaagtaccactgcctgtagtcttgttttatttttgctgtgggagcacataagtgtgtttgtataactcataaaagcagaaagaaaacccacttagttacctaccagtaccccactccccaaaatccttgctgtcaaataggagagggggcttgggagctggctccatctcaaaaactgccgctatgcaagtacggagttgatagttgtaatagcaagcaatctttcctttttaggaaggaaatgactggccatcttctctaaccactgctcctccatgtacacagctccatcaccccacagtcatgagaatttagaagcagcagccacaatttgttcaagcaattgtccaagccccactcagtgcagatgcttggaagaggcagtctctgtgaccatcagggctagcagagtatggtcaccaggaggtaagaaggcaattcagttcaacacagctaagtagccagtgtcaattcctactttgggagtctgaccctgagatgtttattttaggcacatggcaaaattgggtgaaaactttcctggtgataatttactcaggactgtgtacacaacaaagcttaagacatgactacacagaaagttccttatacaaaatatgtgacatcttccataatgatgggttctatactacatgtgatacctttcataaagattgggtttatagattgattagcttaccataagggtctgggggagaatccactgtggttccagccatgaggcataaagtacataaggcaatgcagatgtgtgtgtgtgtgtctgtgtgcaaaatttttgtcaaagaaataggctatacattgtttgaaactattttaacacacgtagtatgctatgtaaaatacatagatacgaatttatttatacactgatctttattgttagttggaaccatttaaatggtagatgttttttttatctatgttggaaaacagaatagggctagtgtagcacacagggctgttcccctacggcttagtccgatctggcccctggttccaggtgtggcagcccagctcaacaaagtccactcccacttagctatcctgactctctggatcactgctagagctcaagcatttttaccaaactgtaccatgtatgattctggtatttgttagagcttttgtgtattacccaataattctgacatctatcggggtttctgagagcagttttaggaagtttgcttttaaagtgtccataatgctgttttccatttgcagcatactttgaaaagttcaccttattatgtaagtgttcttgcagccataatttgcgagtgtagtaagataaaaaagaatgcttctagcttatttaaaatgcatgctgatggcatgatctggaagacagacaacccaatttgaaagggacacaatttaccctagaacctatgttttcacccctctatttgaacttttggagttaaaaatgtttactttcaagttgtagatttgaaagcaaactttctaaagtgtgagtgggggcaaaaaaagaatcttctccaatactttcccaggaggtaactaagaacattgcatcattagatttgtctttttcctcctatttattaaaacacacacacacacactcaaacaaaacaaagaaacaaacaaaaacctgattcacagaagacagtcaatccacacttctctccaggtgtaaaagcaaacatatttctttattcccagttctagagaagtactgagtgtcaactaagtcactttattttgctgtctcattgataaccggaaggacttgtcaggacatgggtaagaaggcacagcatatttttatagcaagtattgtgtagaaatgatgtccagagacacatcagaaagaccactcaccatgaactgcagtcacaagtttgtaaagtttgtagtgaataatgtgacagagctttctattcagtcaacagttctttcccgtataactttaaacggaccctgtactttttgtccagtttgcttaaagaagacagactttccatcacgatgaagcaaatctggtaggtccagagatggtagagctggactcagagcaccaggggaaatagatagctctgaccacacaaagtcaagcagagaagaacaactaaaaaggggttgtatttatgatccttaattcagcaagctgatagtactgccatcaaaaccaaatgacaaaacaaaacaaaaaacccaaaaatgttcatgaaagaccaagtggtactcactcaaacacaaactcttttcatctctgagacattaggtggttcctgtttcagatttactactgttatctcaaagctcctaatcttatccctgaacacaaaccagaaacctttgcagaacttcagacttcatacagtcttgcagcccccgaagttgcctcttttcatttgttgtacagtgaattcatactctgagcaaccagcatcattcacattttgatgaatttttttaaaaagaatttcttgtctttattttgttttgtctttgttttgttttctgttgtttctccctctcctctcttgagacagtatctctgcatgtaggaaccagtctagcatcaaactggcaatcctcctgcttcaaactccccaggatctgagatcataaacgtacactgctatggctgggtcagacatattctcctctcctcctttcctcctcctcctcctcctcttcttcctcctctttttctcctcctcatactcttcctcctcctcctccccttccttctcctccttctttccaaattcctcgacttctagaccaatagcatagccgtgttcttctgtagtaactgtgcactatcgtcttactgaagaagatgcccttgtggctttgactaggagtaagattttactgattacaatggagacaaggcttcactgtgtcactacagagacactgtgtcaccgcagtctgccttcagtctatgctggtgtcagaacagtgtggaagagtgtggctgagccaggcatctagcaactcattcttgccatttacagggctgacattttcactacccaaaaccttttttccctttccacttaaaaaaataaagtcttatcttgtttgttttgaacctgaaggggggggagtaggttctctctctctctctctctctctctctctctctctctctctctctctctctctctctctctcaaatctagtttagccctcaagatcctttgccctacttagccccaggcaccagccatatttacaggaggttcaggtcttcaagtaggtagcttatttcagtcacctgtgtgtcactgggctcgtcactggcttcttacttcttgagtgctgacatgaagatgtagtgagcttgtcctagagggtaccatggcacaggggccagtcctcctgggtgtgctcattcctctaccatgtcttctgtttgataacttgagtggctctgaaaagcacttctccactaggcttcaggccaagaaaatgcccactggtatctgtttctcataatctgttaacaggtacccacgattgtgggattccttgtgagaattccaggggagaaaatgtgaagactcaggcatctatgttccagatccacaactctaccagacacactgcaatgtagccatggctgttcataaaatgctgctccacctggagagaggatcctcaaactgaggttggcaggcaagcctcctatccctccacatcccagtcacatctctgactttcgtggctctcctacatttttccaccctagactaggttcttgagcccaacttctggacctgagagaaatcttctcaaaaatctccccttccgccaagcatgtttttgttttgaaggttcctcataaaactaacatgctgacatttgtccagaattgtggaaaaacagttactagtgtgcctaaatgaagcaaaagcaatgaaggaaatccttacaagcatgcatcagagcctagtgcaggcttggaacagaagtgctgaactagagtcctttgtgaagcactctcaaatctgggcttttgggaaagtcatttctcaaatgttgtgttcactttcaactatagctaagtcagcaatgattcctcgtgagtactttgctgtaactgaagaggtggtgcatgtgaatgaactgaaagggccaggcaagtgtcacaggcaagatgcaaataaggatggatactctcacatcacatgggcgcaagagattcagaaaaggagagagaaaaaacaaatcttctgatttgcaggagtgaagattagactacagattaaaatctgtaggtaatgaaagattcaaagagatactctttataatgatttatttatagttgtgtgtatgtgtgtgtacatgtatttgtgagtgtgggtgtccatggaggccagagagggttacagatctcctggtactgaagttacaaggggttgtgagctgcctggcttagctcctagaaaccacactctggtcctctgtgaaaatggtgcatgtactttaaatgtggacccctctccagcctgaaggagacccatttttaaaatctggcttgaagctgagcagatgtcacgattcctttctaaccctgatgttccaaggctattgtgagtgcagcacaggagatatagacgtcctctgtgactgtgagggccaaagcgctcattccctttgtgggttgggagccctagaaagctagtccccagcatgactctcatgcttctcccttatatagcataggctctgtaacttttttttatgctttgaagttgttttgttatttgtcttattttattaggtatttatttcatttacatttccaatgttatcccaaaagtcccccacatgctctcccacccactcccccacccacccactcccacttcttggccctggcattcccctgtactgaggcatataaagtttgcaagtccaatgggcctctctttcctagtaagccatcttctgctacatatgcagctagagacacgagctctgggggggggggggggagggtactgggtagttcatattgttgttccacctatagggttgcagatccccccagctccttgggcactttctcaagctcctccattgggggccctgtgatccatccaatagctgactatgagcatccacttctgtgtttgctaggacccggcatagcctagcacataggatgtgatgaagacatcccactaagagtcgagtgctccaaagtctctcacttcagacactgtccagttatgggactctgggttactgtacatctactgtaagatggggcttctagggtgaggttgagagatactccaagccatgggtatagcaacatgtcattgggtcatttgattgctatttttctatagcacaatattaataggttttcccctagctgagaccactttttcttagtgaaaaacccctcactcaaattccctatgcatcctagcttcctttacttatttgtaaagtatgatttcaccctgacaaacccattacctttcttcttttatttttatttaattaatttatttatttatatttctagagacaggcttcctttgtgtagctcagctgtcctggaactagctctatagaccaggttggcctccaactcagagatccgtctgcctctgcctccccagtgctgggattaaaggcctatgccaccattgcttggctacatttctttctttattaagcatttcctccctagagagggttcatattttatgtcaccctgcacacagagttttggtcagacactctgcaagtatcctgagatgaacaattaaattgatatgctgtgagtaaaaatgataatcctctatattatgtatagatgcaccccattcagtctgctgaatgtgttaataaacaaacactagcctgctcatttcttcagtaagaaagatttccatcctcagactgtcataggacttgagattttgatgcagattttctggttgatggtccataccatctgatctgagggctgacacagctaattcttaaaacaccctccacacacaaacacccgtctgcatgccatgcgtgaatgtgttaacacacacacacacacacacacacacacacacacacacacacacacacacacacacacacctgtgataaatttccatttccctggtgacaaatacactcacttatatatagacaatgctacaagagaaaatgtatctttccactgtttttccgaggcacttaccagaccacacctgacacacagtaggtactcaacagtacatttgcttgtttgatacttcgtttagtagactgtgcactcaagactttaaaatggtttacttgtcagacatttaactaactcttgtattcccctcttttccctcctatccttggtcatagtttatctactttcttgctatgaattcattttctgcttattctgcttctcaaacaaaacaaatcaacaaccacccactcagaacatttagctttgtgtgggtttcctgccctatcatagttgaaatgctcctgtttctgcctgaatggtttcagggaaatcactaaattctgcaaagatgactgaatgcaaaaaaaaatgtagtgaaataataataaaaattctttaaatacaaactgtgtggagcatggcttactttgcctctctttttggcacctgacacaattcattgatgtcgtgttaagtaaggaacattttcagaaggactctgaagtgtgtgtgagaccacatctgaaaggcagttgctgctggataaagccagctggctgtgtctcttcactcctcttgacctcagaattcatatttctcgactctggatgcattttagacaatgtttccctgtcctcagtgctggggaactaggaccccatgcacttttggcagtatgacacccttgagctcctttataaacaacaacaaaagcaatatttttattttgagatgtcccccctatgtcactaggctggcatggaacttgcgtagaagaccagcagacttgaacttgtggcctcagcctgagtaactagggctgtaacactgcacaaccaggcttccatgggtgaggtttgacttccagttcaggactttaaaattaaagcagaatgaagttgaggagagaggtatatttcttttagaaagcttcaaaagatagaatgtgtgcatactttttttttcatttttattagatattttctttatttacatttcaaattttatcctctttcctcatttcctcctccaaccccctccatcctaccgccccaccccctgccccacctccattcactaacctacccactccagcttccttgtcctggcattcccctacactggggcatcgagccttcacaaggccaagggcctcttctctcatgttccacaaggccatcctctgctacatatgcggctgaaaagcttgaattcctcctgtgtactctttgcttggtggcttagtccctggggatactggttggttcatattattgttcctcctatggggctgcaaaccccttcagctccttgggtcatttctctacctccttcattggggaccctgtgctcagtccaatggatggctgtgagcctccacgtctgtatttgtcaggcactggcaaagcctctcaggagacagctacattaggctcctgtaagaaagcacttgttggcatccacaataatgtctgggtttgggaactgcttatgggatagatccccaggtgggacagtcactggatggccgttccttcagtttctactccaaactttgtctctttatgtcctcccatagttatatagatccctcttctaagaaggaccggaagtatccatactgagaaagctactagtagcaacaacccatagatgtaaggtgtctttctgctctgttaacttgaatatttatgcacttgtgaatccctcagctgttgcttaagattttcataccaaagacaggctacaaatccacagggcacatacaattgggcaaaagcttcttagctttgtcattttttgccctagcctcaaccctataaatgccctctctttgaatttcaatgtgtcattttcttgtttctatggaaaaccagaattgacaggaaagagaagcaatttttgctgacaccagccttactccttacctcaaccaacgtggctgttgctaggaatcgttactcctcctccactcaatgggttagactcagttttgatcattgtcaccaaagaatattgatcgaatgctcctagcctttgaggtatttctctgacttgagatttctttttctctcttgctcaagtctccctaacctgcccacgtgtgtatttgtgtgtgcatgcctgtgtgtgtatatgtataagtgtgtgtgtgtatgtgtgtgtgtgtgtgtgtgtgtgtgtgtgtgtgtgtgtgtgtatgtgtggtgtgagtgtgtatctgtctgtctgtctgtgtatggagtttggaggtcaacattaggcatttacctcaatcattcttcaccttattttcttgaaagaagtttttcactgtgtctagaacttgctgagtcactaggttggcctgactgcactcccaggaatttccctgtctccctctttttccccagtgctggcacatggcttcttatgagggttctggaggatccaactcaggtcttaatgcttgcctcccaaacacttcaccaactgggccacctcccagatctagtttatttccatgtgttgccaatttctggaatgtcaaatggcttagttcatctctcattggccagcaggactttgacacagccatagagtacagagccataagaatttaaatagcttttgtgcaaaacctctcttatttgaacaattcatgttgggcatatttcccaataaattactattccctagtgccccccagttctgtcaccatagctgatggctatccaatctgaaagaagacccaacatccactggaccagtaccctatctattgctgctgagaaagcaagagacagaaactgccattctgaaaagagaagttgatgataataaatatagtttatttaagctgccctgttagagatgtcttaaaggaaggagtacagatttgagtgtgttttaaaagcaataggttgtgggtgtagcgtggtggctgataacttgctagattccatgaggtcctgagttcaattcccagcaccacaaaaggaaaactaaaaggacatgcaaatataaagtgtgaaacatccctgcacattatcttgttataaagcacacatttatgtgcaagtctgcctttgggaacttacctttttcccatcagtaattgattatatttatagttaccagaacgtggcttaacaaatgtctattgggttgagctgacaatactttaggcacggtgctggcattcttaggctcagttcttctcatctttgtagcacttcttcttgtcatttacacataattgctcaagtgcagaaagtcagtcttattttacattatgctcattcatctctgagtacagggaaaaaacactatactgagagctggaaaactttagagacattctagctgtccctttttctagtgagaaagtccagacaagtccaatgtttcctgaaattttagtctcacttttccctatttgaaacctggatgtcagagatgcatcctaaaatacatctatctcagaagaaaatgtggctaccacagaggatctaaaatgtacttagagaaatcctaacaaagggaccatgcagctgttacctctacatgctttagtattttttattttttttgcttattttcctaagcaaagataaattggaaataattttgtttgggattatgggtttatgtcttcaggagaaaagaattagacatagatttaaagatttgttctccataaagaaaagaaatattacacacacacaagggtaaagagatttctaaggatttagtgggaagtttattgtatctttgaaacagtgagacattgattctgtgactgggtagcaagaaggaagcacagacatactctgcctaagaatcaagtctgatctgagtgactccttatagcttcatgattaacctgtaaagacagaaaatactcatctcattaacaagtgaagaaatcaaggcacagaaaagtcagtcactcttggtagaaacaaggtttcaaactctgtttactttgatttgttttcccctctcttttgttgtggggacttaatgtcagtagtaacagtagaaataccactgctcacaggaaacatccttactaattaccatgcattgtgctcagagctttgaatgcatggttctatttaattatcactacagacctgtgagacagtgggtatttctactgttcagatgatgagtcggagcctgggaggcagtatggattctcagacctcccctccaccacccatgtatggaacaattatgtagagtcaacgctgtgtttctagtgtgggctagaaaaacctgcggttgaacctgccaagccacagggtactcatctcctggcaaccaccaacatgccttggtttagcctgtacacagatctagtcacttccaggtgtgtgacacgtatttcccacgttgcttggttcagaaatcactaacatccttattctgcttctcctttacaggtgcttgctggctcacagttaagagttcatactcaaggtactaatagcatctccgagagtttaaagctgaggaggcgggttcgtgaaactgataaaaactgctcagaaggattatatcaaggaggcccattttgctgtcaaccatgccaacctggtaggtcacatgaagcattcagagatgagcgtgagaagcagggtgagagattgaggtgcccgatatggaagaatgtgttggaccattatgcagctattggctgtgctatagggtagagcattacaaagaagggggagcaggactataaaattgttttccaagcacaattctttcatctttatcatatttgtctgggctgcttctaaaagaacatcatttacagatgatgtgcatagctgaagtgagaagacgcatttttagttctatttctcacaacctaaggaaaattcatttgtgaggattaaaaagcctaaggcatctcaaagctcaccatgctgtgcctgactaatttgggggctcccttaacaagagatttgtaacctcaggggtatgtgttagagctcctctcttcagtctgactctaacgttctctggcctggcactgaagcctgcaaaaactacatttccattttttcagctgaataaccagaagaaccagaagagcagtgaacagcagccaacagtttctcaaacatcagtgttttgaaatgcaaatcaatttcagtttggaactctctcacgcatcagaaaatgagaggctaaggggagcataattctgtaaacttagtttccaccttttgggttgaccacagtcatatagaattatctatcttggatgcactaggcggataagaagttggctcagtggcatataggtttgtttgataggtctcaggcaatagactttcaaaaagcttccgtaagtttcatcgttagcatctcaggcctgtggtactcaaagtgcaaagcaggttaaggtcacgcctatacaaagacaattttactaagcctagcaggaaagtttttcttataatacaacccacgtatacctaagctcctaaacacttactcttttccaaacaggaattggaaatcatcaactggcttttttttttcttttaagttgtcatagacaagcaatttatgagttaaaatctgtgtttatactttgaaagtttgatacaaactatactttacatgcttaaaatttaaaagaacaaactaaaacaaaggcaatgcgttttgcatattaaggtttctaaaacttttgtctgtgtgctttgttttactctaattttgtcttgtttgcatttaaaaggggaatcttatgcctggtgtttggatctgaggatgctctcgttccactgtggggtgtaaatggtgcaaacatttaagaaggaaaagggaacatgggtggagaacccagcaatgttttttttgctaatacagtaatggattaattgatctggaaatgccttaaagattacaagtattgtgtatatggcatttcagtttgatacccaacagtgtagggtttggcttgtaaattctggagtaatagaagcctgggatagtttgtattaagcagattctaagtgcctcagcctttgttttatttttctaacttagtccttagttgtacgatttcttttagcaattgcaacctggcattctggctgtgttaacagcttttctctgtctcttcactaatacatcccaactgccattccacacgcactcacagctctctccacctgccttctccctggttgaatttcacatttaccaagagttaagttagtttcaagtctgtttacagcattgatgatagtaacatagaatacttattactgatgataaaaacccagtgaatatcaaatattgggaaatgacaagttttatttttttttttaaagaaaactaggctgagcattttggagaccatcagaaattcagcccgttggagtgattcaactttcttttcatcaaaaagaagagaattgggagaagggggtggggtgggtaaagaagccaaacggaaattgcagggggtgatttgggtggatgcaactttaatgaagagactataactcatctctatgtcaaacgattgacatacttatggagagactctttaaaatgaaaacacaatatagacttttccagtgattccatctgtgaactggtgcttttgattgattaaaatacactgtatgcttacagcaatttttaaaattggaaatcgattcttcttctttacaatcatcccgaccacagtgtcctctccttccatgcttcctgtcttccctccccaccaccagctgcacctattcccttcagaaaagagcaggcctccaagagacaacaaccgattatgacaacccagcaggaggaaagcagagtaggcaagagagtcagagatacacccgctcccactgttaggaatcccataaaaactccaagatgacagccattacatatatgcagacctggggcagacccaggagggctctgtgcttgcttcctctgtctctgtgagctcatatgatccctgcttagttgactcagtaggccatgttcccctggtatcctactctgcctctgcctcctacagtcttcctcccttcccccttccatgaggttcccggagctctgaggggagcaacacaatggagacctccaatttagactctttctctgcatagtatatggctgtgagtctccatacccactcccatctgcagctggggagaagcctctctgatgacaactggacaaaggacccatctatgagtatagtagaatatcgttgggaatcattttattgatttttttctttctttttnnnnnnnnnnnnnnnnnnnncaggtaccagcttgacgtctctatgttcaaagcagctgggtggatgttgtcctcagcaatggtggcctccccaccaccaccaccccacacacacacccgtcagcttttggagagcaaccctctgttctagcatcagtctgggttgtttaggaattcgcacaggaccccctcaggcaacaattcaaccagatgcaacccagttccaccactggaagccttgcctggctagaaaagatggccagttctgactctgtatcctccattacttggagtcctcactaaaatcaccctcatagattccaggaagagtccatcacactaggtttccacatcgccccaaaatgtccaccaattccagctctctctccccaaactctctccctccatccctccccatctccaacctgatacctcgcactcccatccccacccatcccagtccacctgcaaaatatattttgtttcccctttgcagagagatccatgaatctcccccaagagtcctcctctttaactaatttctctgggtctgtgaattgtagcttgactatcatttaattaatagctaatattcaattataagtgaatacataattgtgttcgcacaaataccatatttgtctttctgggtcagggctacctcactcaggatgatgtttttctagttccatccatttgctcacaaatttcaagccagaaatttttaacatctgagtactactccattgtgtgcactaccacatctttcttttttcatttctctattgatagacatctaggttgtttactggttattacaaataaagctgcagtgaacatagtggagcaagtgtccttgtgatagcatggagctttgttggggtagagcaagagtggtataactggaccttgaggtagattgatttcctattttctgaagacctgccatattgatttctgtatggctgtacaagtttgcactccgccagcaatggaaaagtgttcttgctcctcatctcaccagcatgagctctcacttgtgttgttgatcttagccattctgacggatgtaagatggaatcgcaaagtagttttaatttgtattcccctgatggctaaggatggtaaacatttacttaagtgtttctcaaccatttgagattcctgtgttgataattttctgtttagatctgtgtcccatttgaaattggattacttgggatatatatatatatatggtttcttaacttctttatatgttttggatattagacttctatctgatgtggagttggtaaaaatattttcctattctgtaagttgctgctttgtctaattgacagtgtcctttgccttacagaaacttttctgtttcatgaggtcccatttatgatgtttctgattaagatgcactgtatacaaatacaaaactttaaaaaataaataaaaatttaatacttgaaaagcctttatcacattttgatatccagtaggatgaatccaacagtgcattttttatattatatacacacatatatacatacttatttgttgcttctatatgtgtatgtattgtgtatgtaagacatacacacttatctgttgcttctatacatgtatgtatatatacacacttatctgttacttctatatatgtatgtatgtatatacacacacacttatctggtgcttctaaacatgtattatgcatgtatatgtgtgtgtgtgtatatatatatatatatatatatatatgtatatatatatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatatatcaaggcagttgctatgtaggagcttttaacattttcctagcttttccaaattttctgcaataaatatgtgtgtgttactatcagaaaatgatacatctagaaaccttatgttcaaggaaataaccatttatttttttgtatttttgtaaatttagattgtgcactttagaggaaagaatctgaggctaattgtatccatataaagctaagcatgctctactacctagctcatgagatatttcagttcccttaaacagcagtgctgtgccacctgcaggaagcgcagtgcctcctctgttctgctccccctgcaaagcactactgtggggctgtctggctctgaggcgctattttaatttgctccagactctcttgctttactttttaaaagcagacttgcttctgtttactaaaaggttacaaaaggtcacccatattttcactttactcattgacttatcaagtaaataattgtgcttcgtcagcaggaatcctatgaggtaattcaccaagccgtgccctaggaaacacagcatagattccatttgctgctgtgtccatgtggagcagatttgactgcgtttgtcatttgtattcctggctagagttaattgttagttacactgttaatgcctagatttgctagttactgcatcttgctacatttccctgtacatttgctgcactgagcccattactcactgaccctagcttctggctgcaccggctgatgcttagcatctctgcctgagaaggtgaaggccctggaggctaatctcttgtcttacttctagtgggatttccttcagttcctagaacatccttagcacgaaacaggcatttagtaaacgcttgtgaaatatgtgacctttccaggaggcattgctctataatgcttaatcatagaaaaagaatgacttactttaataaatcaaagcaaaagatgaatgtgtatttcaaattgttcgtgataataacaaacaaatagtaaacaaaatttattagaggtttgtttttgtctacaaaagaagtcctgtgttcctggaaaagaaactgaaaggggagagaagaaaaactgtgaatatttattctgtggcctgggcatggctctgaccataaagacagagaagtcctcattatttgtgtgacaaaaacttgggcttacagacatgaagtgctctatcaaagatttcacaactacttcaattttgatcaatatttctagaaacttccagtgctctttttcttaaactgcattgtctatgagcaggttttgtggactttgaaagacaaaatgagaatcagaacacagtgagtttattcagtaatctcagtggccaaggacagccacctccatgatctggcctctccttcctttcacagaagtgcatctggtcacttgaattgaccctttactcatatgttcctgtggctaactatcctactatttttttttcttttgagacagggtttatttgggtagcactggctgtcctggaactggatctgtagaccaggctgacttgattaaaggcatgagccaccaccacccagcttaactatcttacttttataagaatattgtttggctttttattgaagacttcctggcttttttttttcttttaactttctattggttctttgtgaatttcctatcatgcatccccactcccctcccccttccttcatatctaccctccatccttccctctcccttcccccttccttcatatctaccctccacccttgtaacctccagggcctgagaggtaatcttcttgtggaagctgtagtgtcaatgtatcccacagtattccctcttgtccacatttctttctttgcaaaagttcgttccaatgacatattggtgtggcacgaggcctttggcttctcttactctgtcagtactgaaatctcactgtgactcctcagatatcctgttgttgccctgtatcatggagatactgtagtttggagtctgtaagattagccccttcatgtattctaacagttcatccgtgggatggatgtggaggtgggccaatgcaaaggccctgatctgggtccgagaggtatctgagctggtcagcctgacagctcccatgttctcacaccctcaggcctggctcagctatactctgctagccaggtgaggtgcgtggcctgctctcccaagagttgctgttagtgagggatatggccagttctgctctcacaatcctgggcgaggtctcatgtctgccttagatggtgatggacaagggaagggaagagggtgtctttccctcatccgtgccaccactcagcagacaggaggtagaactggctctcctccactcatgccctcagggccaggaggctcacctgcatcttccacacccagggccagctctcttgtgttgcccaggcaaggtgcagggctggctctcccaagggcggcagcagataaagggcagggacagatcttctcttgtgatcctgttggggtccagctcttcagcctgccaccagaggccgggcaaaagggaggtgaggggatctctcctttgttgaagccaccacacagcagacaagagacagaactgggtctcccacatgcacactctccctcacccgtaaccccaacatggtgggtcagctctactgtgctgcccaggagagatgcagtgagtgcactgctgagtgccacaggtggtgaggggcaagtgagtatctcttcctgctggctctggatgtgattctttccccaaatagctgtctgtcttttacattgcatttgcatataatcagcctaacacagcatctcctgatgttaagattctttattatcatccttacatactttgcctaatgttaacttggagactgccctgactccagaaattcaatttattccttccttccttcttcccttccttccttccttcttcccttccttccttccttccttccttccttccttccttccttccttccttccttccttccttccttcttccctccatctctccttcctctctttcttcctaatttcctctctttctttctttctttctttctttctctctttctttacttctttatttttttcatgacaggtaaaaaaaaagttgaggactgcaaaatgaatgggggtacaccaacctgcgccccatgcacagaagggaaggagtacatggacaagaaccattatgctgataaatgcagaagatgcacactctgcgatgaagagcatggtatgtatctacaatgcaatttagagaggccaatcctgagcctccatatagaaccatgcagtttgagattggcacttaccctggtccatgccagcatacaggaaggagcggaatgaggctagctgggtaatgtggagctatcttgtaaggtggtaatagattctaaaggccttcacagtgattcttccaaatggaagcaaaggactaaataactcgatgaaaacagatactccagccacaatccaagccacccatagaaatctttcccctctatttctattaaaacttgtctgtagttcttgttcatggcctaacaaagaaacccaaggtgtgggaatgatgtcccttcatctttggggatcccatctatcatcattctatttggggacctgactttttgtagctatttcaatctcttctcaaggccaggatggattttaagaaatgacagaagcagttgtacttaggtttgacatcaagaaaactctgggtatcaaattttaaagctctttttctctcttctctctctttttttttaaaggcatagggcttttacattagtctataaagaagcgatgcagaaccctggctatacattaaacctgcatcaggagctgttgaaatactaatgcttaggtctcagctcacaattaagtcagaatctccaagtgtggcttggacatttgtctgataaagcctagtttaggcttatcatgaagcagcatgatggtgataatgatgatgatgatggcggcaatggtttccaggccatgtatttaagttgcaaggctttctattaaaggcatggcgttgccatctaagcaatggtaggtagtatctggccttctggattatctactcaccaaaggctctttttcatgttggtatttccttttggttagtaaacattgttactaaaggtgtgatagtgtaatagctatatctaaacaaaaaccaaaaaactatgccatccctggccatttttcatcacttattgtttttattattattattatttttagatttatttactattatacataagtacactgcagctgtcttcagatgtgccagaagagggcatcagatctcattatgggcggttgtgagccaccatgtggttgctgggatttgaaatcaggaccttcggaagagcagtcaagtgcttctatccgctgagccatctcaccagccctcatcacttattgttaactagctactacaattaaaactttttaaactggctttccaggtttagaggtggaaacaaactgcaccctgacccagaataccaagtgcaagtgcaaaccagacttctactgcgattctcctggctgtgaacactgtgttcgctgcgcctcgtaagttttagcattcagtgcttaagtcactagctatgagatggaacatcctgccttctgagagtagaaccacactgaatgagagttcggggctgagttctgttcttgtctgtccttcttttgctcagttggcaccaaacgccactgagctcttttaccaaagccatccggttcaagggatgttgctagccacttacggttgtgatgggagacacgtgactgtcatcaaggttttggttctagggcaaagacatccaagttgggggggtgtgggtgggtgaagtaatcaatgcttattgcatgtcagctccttatggtgtctggcacacataagacatttttgctcggattggtgcaagttatgcaggaagtccttttgactgtctgaaaggtgagagtatggaagaggcaggaaaatgcaccagcagctacaagtgggtaggaagtgtgttcaggcagagaaccgcagctttaaaaaggcataagaaactcccatatctgctggagggtagaaaagccttggagcgagctggataaggactttgccttgatgcacaggggttcgcttttgactccaatctggaaagtctggatgtacagcccacttgctgattaattgagctagtttgagcagatcacttactctgtctggacttcagttttctcactcacgaaatgcaaagaatctttaatgaactccgcgcacctgccacatttctctggagacccacactaggtaatatattttgcaaacacagcttttgctaacgggtaggtacatggtaatggtagatcacttgtccggcatgctccaggagtctcgggttcgattcccagcactggaagaaaagtagcttttgttttgtaagaggctgacattgtacaaaatgtttataacggctatttccttggcattccttaaacctgtaactcaccttcagagccttctggctgttcatctaatactaaatctattaatgctagctgtattagagacatgctgctttatattttactattaggaaaagcatttgtgttgcctccctctcccgccccaagtgtctgagagtgatgagaggcaaggtatacattgtggggaagtagctaactgcgttcagcaataacacaatattagctccatatactttataatcacgatttaattttcttctcactggcactctttggggtagatagcataattatctctgtgctgttggtgagatttcagattcaggctcctgcaggtcaactgctttcccacccttgcctgtttaggtttcaggaaaaggtaggctgtgaacctgcagaggttagctagctgaagaaagtcccccaagtgcctcttcactgtcctgagcactgcctgctggggccctgggcagcatcttaggtggtggctaccagcaggcagttttaagggttttttaaacatttttttggaaattgttcttgataagttatttttttaaaatagcttatttttagctcttatatcttaagaactcaatgtgtcaccaatttagtttttaaatatggggcccagcgatatgcatgtgactgtggtgctgaggagggccagaagatgctgctggatgggacttacagaaggctgtgggctgttaggtgtgggttctgggagctacaccttcttcttcatgggcagccaacgccctaaccattgagccagttctctagcccctatgtcttaaactagatttaagattttcaaccactcagtcgcactccttagtttgtgtgaattttagatggcgatctagaaatatctgaaaagacacaaatggcgggaatgagaggacagataaaagtatccctaatctgtaatgtacattggaaaaatggagaaggaatctacgcaggccttctgagttcttctgccttctccccctaggtgtgaacatggaacccttgagccgtgcacagcaaccagcaatacaaactgcaggaaacaaagtaatcctttcccacttccttcctcacatgtcagaataaaaagatcattggcttattattgattgagagaacagagatctgccttgtctaaaaaattactcaatttcatacaaaatatccaatattcgcaggtcccagaaatcgcctatggttgttgaccatccttgttttgttaattccacttggtaagtcctaagtttgttcaaaatgtagattaaagtgacctgagaagtagccactgtgcccattgagaaatcccagaaagccaggctgcgtgttataatgacacccagtaaacctggccttctctgtgcctgtcctcactctacaacctgtttactttaagttattattttaaaaaatcactcctccttattttgtgtctttaatttaaaatgtatgacaacgtgtttccttcaaagattacttaataatatcagtagttaagggaaagctgggtatcatcggggttattctgaaaaaccatctcgctcgaagcacagcaatgataagatacaccaactttcagtgactcagaatcttctagtctctcctgtgttgctggaacaagaagctgtcttgtcaccccagttctcttagtgtgaggatttcctaagaatggcatttgagtctgacagaaatctcttcgatctttcagtatttatatatcgaaagtaccggaaaagaaagtgctggaaaaggagacaggatgaccctgaatctagaacctccagtcgtgtgagtatgcaaatgcatacaacaaccaattagcactttctttaaaacaaatgcaattagcactttctttaaaacaaattcaagtccctccatgcccattttagaagaacatttgaattaacacaccaaagctaatttattactaagttttgtggggtgctacacaaaaaagggtctgcctcctatagccatttgggtctagatggaactggatctgacctgtacacttctttctcaaatagaagaccatccccgctctctactgagctgcacaataaagcatggtattggaaaagatactggaacttgttaaagactcttaccagagtttaataagggaagcagttgttttctgacccctgctgacccagaagagcactcagagtcaccagcagatttaatcaaccagtattcatatgttgccgtcagcatttacaatgacttatttaccaaggagctgtcagcctaccggctgcttccagggaatgatgttagactgaattatcatagcacccatgcacacatgtgtcatcacgggtgggggacatgattaaggagcacagtttaagattaaagccgtgcattaaagtttatgattgtgcgtgaatcccaggtatagttgggttgtttgcattgttttctcaaaacaggggggtgggcttctgaaggcaagcttacaagagatacttactaaaatgaaataaatccttataaggttttacataaatactgtagggagaaatgaaggaacatgtgcctaccagtgtgagctgggtagggatgtgtaatgttccctgttttgtggaaatgcaattggctaaagcacgggactcagatttccaaacccccgcaaagattttgctcttaaaatccagcacgtgggagacagagacaggcggatttctgagttcaaggccagcctggtctatctaaaccaggagggtggaacctttcagaatcaaaactgaatgactgaaagagctcatcttaaccacaaaggctagtttcttttgtgtgtgtgtgtgtgtgtgtgtgtgtgtgtgtgtgtgtgtgtgtgtgtgtgtagtcataatctctggcaattgtatatatttccttctgaatttagaaaaagttaaatgacatgcatgtatgttttttctctctttgcctctgctttttttcttcccaggaaaccataccaatgaatgcctcaagtaagtctttctattattttatttcacagaagtagctttctttatgggaataggcataagtcggaacaggctctaagattttagagtgaaataatgtttgaattgcagtgacactttaggctttaccgttatgtgaactgtcagttctagccaaagcttaaattgatagcagtctcaatttaaaatatacgaagaagcgataaaacagaatattatgagaggttcaagaaaaacattttcataatcagttagctgtatcacgggaccctttggaatccgatcaaatggaaccatgaactctatacatgtcctcatctctgcaacaacatgtccaattctgtcctgtcctgtcccttgacctgtgactcagccataggggtgaactgacctttaaggtttgtgggtttgctcatcaagtctctagggggcattagaggtgatcttttttttaagcttctgatttcatttctttttttttttttttagaatgaacacattttttatttaattaaggaaagcctgttccaaacatcagaagtctctctataatcctctgtatataaaattaggtcatttaacgtgttctccacattgaaagtatatagatagttccacaattaagagcatttgctactcttgtaggggacctggatttgattcccaacatcctcatagtgtctcactgccatttgtaatttcagttctaagggatgtgactccttgttttgattctatgggcaccatgcacacatatggcacatgcatacattcagacaaaacacaagcatgcacacacatacacacacagtggggggggaagggagggagaaataaagaggtgatgaaaggaggggaggaaggagagagagggagagaactaaaataaaaatcctgttaacaattgcccaaattaatttaactgtgacgtaatagaagcaaaagaacaaggttccaatccatggtacaatgtgttagtctgttcatttctattttacaactcacttttattccttatttaaaatagaaaatacatgttcagtatacaaacttcaaaagatgcactagtataatgtgacatgaaatttcacttcttactataattagtgactgtgcacactgtcagtactaaactttaaacacatctgcatatatctgcttttgtagttatgtgtgcatgtatgcctggacctatgttatgcttgcatttgaattcagatttggggaaagtttagttttacatgaatttgtgtaaatttttttaaatgagatataatggaaactatttaaatgtgcaatataatggctttttaagtcatcaaagtaatttaaaatagttaaatgcctcttaaatatacatgataacttctgaaactaaaagtaatatgtactcaaccaattttcaaaatctatttggaacattaaacacgatagaaatagaaaaaaattcttatgaagtcctctatgaaaggaaactgtgacaagatcctaattatacagaaaccattccatctccaagggagaatatgcagtataactgtggtttcatagaatgaattgggtagtgttccttctgtttctattttgtggaatagtttgaagagtactggtattaggtcttctttgaagttctgatacaattctatactaaacccatctgtatttttttaaagttatttttaagtttgtgtggttatcttcttttgggtttgtttaaagaagattacttcttgctttttcttgggtacagtttccttccttgtgttgaagttttccatctactatcctttgtagggctggatttgtggaaagatattgtgtgaatttggttgtgtcatggaatatcttggtttctccatctatggtaattgtgagttttgctaggtatagtagcctgggctggcatttgtgttctcttagggtctatatgacatctgcccagcatcttctagctttcatactctctggtgagaaatctggtgtaattctgataggtctgcctttatatgttaatgaccatgtcaccttactgcttttaatattctttctttgttttatacatttggtgttttgactattatgtgatgggaggaatatcttttctggtccaatctaattggagttctgtaggtctcttgcatgtttatgtgcatccttttctttttttattagatattttctttatttacattcaaaatgctatcccaaaagtttcctataccctcccaccgccctgctcccctacccacccactcccatttcttggccctggcattcccctgtactggagcatataaagtttgcaagaccaaggggcctctcttcccaatgatggccaactaggccatcttctgctacatatgcagctagggacaagagctctgggggtactggttatttcatattgttgttgcacctatagggttgcagaccccttcagctccttgggtactctctctagctcctccattgggggccctgtgttgcatcctatagatgactgtgagcatccacttctgtatttgccaggcaccggcatagcatcactcaagatagctatctcagggtccttcagcaaaatcttgctggcaaatgcaatagtgtctgggtttggtggctgattatgggatggatccccaggtggggtagtctccggatggtccatccttttgtcttatcgccaaactttttctctgtaactccttccatgggtgttttgttccctcttctaaggaggagtgaagtatccacactttggtcttcattcttcttgcttttcttgtgttttgcaaattgtatcttgggtattctaagtttctgggctaatatccacttatcagtgagtgcatatcaagtgacttcttttgtgattgggttacctcactaaggatgtggaccttgtatcttaaacagattggttgccttcacacaggaattgnnnnnnnnnnnnnnnnnnnnaccataggtgtgtggattcatttctgggtcttcaattctattccattgatctacttgtctttcactataccagtaccatgcagtttttattccaattgctctgtagtacagcttgaggtcaggcatggtgattcgaccagaggttcttttattgctgagaatagttttgctatcctaggttttttattattccagatgaatttgcaaattgccctttctatcccagtgaagaattgagttggagttttgatggggattgcattgaatctgtatattgcttttggcaggatagccattttgactatattaattctgtcaatccatgagcatgggaaatctttccatcttctgagatcttcttagatttcttttttcagagacttgaagttcttatcatacatatctttcacttcctgagctagagtcacaccaaggtattttatattacttgtgactattgtgaagggtgttgtttccctaatttctttctcagcctgtttatcctttgtgtagagaaaggccattgatttgtttgagttaattttttttctttgaatattttttcttttttattttttttccattttattaggtatttagctcatttacttttccaatgctataccaaaaagtcccccatacccaccccccccccactcccctacccaccgactccccctttttggtcctggtgttcccctgtactgggacatataaagtttgcaagtccaatgggcctctctttcaagtgatggcctattaggccatcttttgataaatatgcagctagagacaagagctctggggtactggttagttcatattgttgttccacctatagggttgcagttccctttagttccttgggtgctttctctagctcctccattgggggccctgtgatccattcaatagctgactgtgatcatccacttctgtgtttgctaggccctggcatagtctcacaagagacagctctatctgggtcctttcagcaaaatcttgctagtgtatgcaatggtgtcagcgtttggaagctgatcatgggatggatctctggatatggcaatcactaaatggtccatcctttcgccacacttccaaattttgtccctgtaactccttccatgggtgttttgtttcctattctaagaaggggtaaagtttccacactttggtcttcgttctcttgagtttaatgtgtttagcaaattgtatcttatatcttgggtatgctaagtttctgggctaatatccacttatcagtgagtacatattggagttaattttatatgtgcatctctttcttaatgttagggaagttttcttctataaatttgttgacgatatttactggccctttaatctgggaatctttgctctcttctatacctgttttcattaggtttggtcttctaattgtgtcctggatttcctggattttgggggttactagctttttgttttttcattttcttttactgttgtgtcaatgttttctatggtatcttctgcagctgagattctctcttctatcttttgtattctgttggtgatgcttgcatctatgactcctattcttttcctaggtatttttatctccagggttatctcccatttggaatttctttattgcttctgtttccattgttagatcctgcatggttttattcaattccttcacctgtttggttctgttttcctgtagcactttaaaggatttttatgtttcctctttaagggcttctagctgtttttaaaggagttatttatgtccttctgaaagtcctctattatcctcatcatgagatgtgattttaaatcagagttttgcttttcttctgtgttgggatatccaggccttgctgtggtgggagaactggattcagaagatgccaagtaaccttggttttccttgcttatgttcttgctgtttgcctctctccatctggttatctctggtattagctggtcgtgctgtctctgactgtggcttgtctcttctgcaagcctgtgtgtcagtactccttggagaccaattctttttgggaggaatttgggtatggagagctgtggcacagggtcagttatggtgcacagacagaaaccaaaaggatccccagctattcctttattcctgtgtcctgatggctctgggtaggtccctcttgggccagggatttgagaagaaatggtggtcttacctgtgctcacaggtgtgtcagcactgagaaaccagatcttgatggtatttgggtatggatcactgtggcacaggatcagctcctggaacagaccaagcttccgatttcataaatgaaataagaagatataaagatgtcatgcatcatgtctggctcagagagtaaattataaaatactttagcaagtttgggaggacaactcaagcttaccctaggggtctcacctagcgcagatgtgaacccggcttctgtaagggggtttctcctagacagacattttcagaaactattttctgtttttcagatcttagcttgagtaaatacatcccgagaattgctgaagacatgacaatccaggaagctaaaaaatttgctcgagaaaataacatcaaggagggcaagatagatgagatcatgcatgacagcatccaagacacagctgagcagaaagtccagctgctcctgtgctggtaccaatctcatgggaagagtgatgcatatcaagatttaatcaagggtctcaaaaaagccgaatgtcgcagaaccttagataaatttcaggacatggtccagaaggaccttggaaaatcaaccccagacactggaaatgaaaatgaaggacaatgtctggagtgaaaactacctcagttccagccatgaagagaggagagagcctgccacccatgatggaaacaaaatgaatgccaactgtattgacattggcaactcctggtgtgttctctttgccagcaaatggtagttgatactcagtgagggtcaaatgactagcaggttccagggactgcttctgttattctctgcagttgctgagatgaaccattttctctgtctactgcaatttttacattcaaatgtccatgaaatttgtattaaatgtgaagtggaatctgcagtgtttgtgtttatattcatatactatgaactgaggagaattataaactgaaacaaatactcgcagttaattgaagaccttccattgatggacagttcttttcctctctatgtggaaatgtataatagaagaaataatttttaaattaaagtatctctttttgcatttctattgctctgttgtcttgcttgttattccatttttctttactctagatgacgacttaaatgctacctgtgcaatgaatgaatctttaaagcttgagttgacctcttaggaggaaattcctttccaaagccttttaataattaaatggttcattctatggctgttactgtcaagaatactttagcttggcagatgtctgatattcttgaggaatctgatgaccgtggtctcaaaagtgcatttaagcagaaagattgcacagcttgggggatttgcctatagttttctctgaggtatgacagttttctctgaggtatgtcctgtccagctttctagttggacagagcagaaggacaaacccagtagagttcagatatgaaactcccacgttttaaggtgagattaagcataagaacatcctgtgccttctttaatgagtttgaacttgaaccaagaactctgagtccctttgaaaaggctttgtattggaggatgtgagtctcttccccttggcttcacccagaggctccgggaatgaccactcccacatcaataaccatggctgtgttctggacttaaagtgaccttttgctccaaagttaccttgcttcagtgattgaatctttttttttgtggtacacatcatgagaaggaatacttatgtcacgtatgggctgcaggaaaaaggactatgtacaaaaggaggtcagggacccccatgggccttgcatacttaaacttctaagcattcttcattagtaaccacagagtcctctggtatttgaccaggccctatgcagtactacattgttagtttccatatagtgatctcgatatggcatacagcacaacattatttgcaattatttcccgtgctctcatctgaatggaagttttcctgcttggattttataccaggggctggaagataactcagtagtagaccaccttcttagcaccctaaggttcttgaatcaatccttactacccannnnnnnnnnnnnnnnnnnnctccttgggtactctctctagctcctccattgggggccctgtgttgcatcctatagatgactgtgagcatccacttctgtatttgccaggcaccggcatagcatcactcaagatagctatctcagggtccttcagcaaaatcttgctggcaaatgcaatagtgtctgggtttggtggctgattatgggatggatccccaggtggggtagtctcgggatggtccatccttttgtcttatcgccaaactttttctctgtaactccttccatgggtgttttgttccctattctaaggaggagtgaagtatccacactttggccttcattcttcttgattttcttgtgttttgcaaattgtatcttcggtattctaggtttctgggctaataaccacttatcagtgagtgcatatctaatgacttcttttgtgattgggttaccccactaaggatgatatcctccagatgcatccatttgcccaagaatttcataaattctttgtaatacgtgagtagtactccattgtgtaaatgtatcacattttctgtatccattcctctgttgaggtacatctgggttctttccagcttctagctattataaataaggctgttatgaacatagtgcagcatgtgtccttattactagttggaacatagtctcagtataagcccagaaaaggtatttctggatcttcggtagtactatgtccaattttctgaggaaccacaggactgatttccagagtggttgtacaagcttgcaatcccaccagcaatagaggagtgttcctctttctccacatccttaccagcatctgctgtcacctgaatttttgatcttagccattctgactggagtgaggtgggatctcaaggttgttttgatttgcatttccctgatgattaaggatgttgaacattttttagatgcttctcagccctttggtattcctcatttgagaattctttctttagctcggtaccccatttttaatggggttatttgaatttctggagtccagcttcttgagctctttgtatatagtggatattattcccctatcagatttaggattggtaaaaaatccttttcaaatcttttggtggcctttttgtcttattgacagtgtcctttgccttacagaagctttgcaatttcttgaggtctcatttgtcaattcttgatcttacagcacaagccattgctattctgtttaggaatttttccccagtgctcatatcttcaaggcttttccccactttnnnnnnnnnnnnnnnnnnnnaaggaatacttatgtcacgtatgggctgcaggaaaaaggactatgtacaaaaggaggtcagggacccccatgggccttgcatacttaaacttctaagcattcttcattagtaaccacagagtcctctggtatttgaccaggccctatgcagtactacattgttagtttccatatagtgatctcgatatggcatacagcacaacattatttgcaattatttcccgtgctctcatctgaatggaagttttcctgcttggattttataccaggggctggaagataactcagtagtagaccaccttcttagcacccttaaggttcttgaatcaatccttactacccaggtaaataagtagatagatagatagatagatagatagatagatagatagatggataggcaggcagacagataattaggaacggaaaggggaagtctacataatgcacagtatttgtagtttctccctagcttttagaacatcagtccactgtattcttgtgttcattgttaatgatatgcccacttctggtctaaatattcctttctaggcaactcctctcttttcctctaatagactctgaaggttcctttaccacactttcttggtgttcagcaatttaacttaaaagagttccaatgtggatttattaatctctttctcctcccccatttcccctccctcttctcccctttctgctgcttctttccctatccttcattatccctgttttcttgagatcttcctctgtggtctaggctggcctgaaatttgtagtaatcctcctgcttcaccctcctaattgttgagattatagtaaacttagttttaactcatttgctaagcagtatgacttttattttattttttatttatttatttttatttatttatttatttgagatagggcttctctgtatagccctggctgccctggaactcactttgtagaccagactggcctcgaactcagaaattcacctgcctctgcctcccaagtgctgggattaaaggcatgctccaccactgcccagctatatttacctttatcccttgagattataattataccatctcgccttccctttcctctctctaacaccttcatttccctctttcaaactcatgtccttatttttctttaatgatgctacatgtgtatatgtttatgtatatgtatacgtatatgtatatatgagtgtacacgcacacacacgcacacacacgcatgcatataccatgtccttgctgttctgaagacttggatcttttctctttgaataactcctgtatgagtccctcaattctttcctcccagagtagagcatcacctcctgtagctttttgaacttctctctgctctgattgtttgaaattatagttttatatgaagatcgtatgtagggagatgtttcattactctcctcaaattaaccattcccattttttatcgttttgtccactgttcgtgacatttctaattatctgtgaatgctcacttatacatatgtttctgcttcctattcatggatattttaaggttacgtggaaagctgtgtctatcagtctcttttcttgttgtaaacaaatatctggcaagaagcaaccaaaggaagaaggcttgccttgtgctttgaatgttcagtcagtctatcatgacaaggaggccagggctgggggaccatggcaactggtcaagctgtgtctgtagcaggaaggagagaccttggagggctggtgctccaccagccttcttcatttccattttattcacactcggatcctggttcatgggatgggatggtgtgcagactctcagtgtgggtcttccctcttctattaagcctatctggagcatacccacaggcctacctagaggtgggtctcttaggtgattttaaatccagccaaggctacagtcacaatcttattccatcatcctactttaaggagtctacagctcttcatgagtccttcctaaaaatacttttaaaattaaattttacttgtgatctcatgctgccaatcataaactcactgtcctcacatggctcccaagaacttatgcatgtgcactgtatacacatttgtgtgcacatgtatatgtctatgtgcacgtactgagatgccatagaataagaggtatcctgatttagcatcctccaccttattctgttgagacagactcttactgagcctggacctagactggcagccagtccaccatctctgcctacttcccattaccaagcttacagatacatatgtgccataactgccttttacaggagttctaggaatttgtactaaggttacctgttgagccacatcactagccatactcatgtgaccttcttggtgtatttttgaatttgaattgtagatctgaatgacaaggtnnnnnnnnnnnnnnnnnnnnggtccatctcataatcagccaccaaatgcaggcaatagtgcatatgccagcaagattttgctgaaaggaccctgagatagctatctcgagtgatgctatgccggtgcctggcaaatacagaagtggatgctcacagtcatctatagcatggaacacagggctcccaatggaggagctagagaaagtacccaaggagctgaaggggtctgcaaccctataggtggaacaacaatatgaactaaccagtacccccagagctcttgtcgctagctgcatatatagcagaagatggcctagttggccatcattgggaagagaggttccttggtcttgcaaactttatatgctccagtacaggggaatgccagggccaagaagtgggagtgagtgggtaggggagcagggagggggagggtatagggtacttttgggatggcatttgaaatgtaaatgaagaaaatatctaataaaaatttttaaaaatatgtcttaatatatcctgaatgtgctatggtaaatgatttctttacatttattttaaaagccatgcattactagtcctttattcctaaaagacagataaaaatggaaatccctgtgtttgttttccctcttactaaatgtaaaaaaaaaaaaaaaaaaaaaaaaaaggtctcagctataaaataaaaggcccaaggatctgtcaataaaatagaacagtgggctccaaacaaatgggaaggaaagcggggccgtggttccacacggccacaagatggcactgtttctccagcactgactcaggtcctggttgaaagtttctccaaagtatgtcacagtttaattctcatattcaacttgccaacaaaagagcaaaacaaagcagatattacaagagttttatctaaaataaggcaatgtctgattctaagtcaacccctttttatggcctagctgtataattttagatttaacatcttggatgttctttatccatatctgtaaattaaagtcacagtccatcagttgttcctataactgtaatgcacaggaatgagacacccatgagaggatgtgataaactgtaatagagtatgacattggttcttaagattaacgttcatagaaaccacctgaggatgtttggaaatgtgtcctgcagatgatgtggctttgggaagggggggggaagcacttgtctcatacccatgagtccctgggtttcatgaacagcactctaaaattcatatccccaggtccagacatgcttcagaaggtttgagactggaaatattcatgtgctgcataattaatcagcaattatgaaaatgtgcaaagtctcgggtcacagcctgaaaggcttcagtatgccaacacccatggaaagaaatatttccaacttagagattaattcactatttaactaaaagttgaacaagcactccaccatttttagactaactaaaggtacgtgtatattatattataatacaaatatatcaagtgtaagtgcccattctcttaagttaatagaatggacttgagaaggaagtgtttgctgggtgacagtcagataacaggaccaggtgcagaacatctggaagtcagctgatagacaggtatgctcatgttgtaggacccagacagagttgatggagtccccctgtgctctgccttgtgacccctatacactcttatttgtctataaacaagtgacttggtgtcttctattaaagactgaagcaagctctactgtactgaaagagagtgagaaaatttagcaacaaagttccatgaacctcttagaattctttgtcacacaactgccaaggtttgttggctaaagccaatggaactttttctaatctcttctcttccttctccgtctgcaaggggtctcagtctggttcccagaaaacatggtgggaaagattgaaggtctagctctaggccagaggccagtgtgttatcctcagaacctgggtgtgcatgctcaaatcccatcttaggtatcaagagtgcacaacaacaaagtctttacaaattgcagcaaaaccggcttcatttggaaatatattcaatactcatcaataaagagagacagcagtttatgttgaaccactaggactcttgatctttctacaactatctatcaaatagttcttactttttacagctaggcactattctaggataacatgctaataacatgctaataacatacaaaaagaccaccaatctggagctggatctctcataacaggacggacaagaatttgtgtaatgattgtgcagaatactatgttatgagattataaatgctccgatccgtttatcaggacagggagaattgaggcaaaggtagggagagagagaaaaaaaaagcaaggtgtgttactactatatagagtggtcaggagaggcctcagtgagatggagcaannnnnnnnnnnnnnnnnnnntccctacccacccactctcatttcttgaccctggtgttcccctgtactggggcatataaagtttgcaagaccaaggggtctctcttcccagtgatggtcgactaggccatcttctgctacatatgcagctagagacacgagctctgggggtactggttatttcatattgttgttccacctatagggttgcagaccccttcagctccttgggtgctttctctagcttctccattggggactttgtgttccatcctatagatgactgttagcatccacttctgtgtttgccaggtacttgcatagcctcatatgagacagctatatcggggtatcttcagcaaaatcttactggcatatgcaatagtgtcagggtttggtggctgattatgggatggatccccaggttgggtagtctctggatagtccatctttttgtcttagctccaaactttgtctctgtaactcctttcatgggtattttgttccctattctaagggggaataaatatccacacgttggtcttccctcttcttgattttcttatgttttgcaaattgtatcttgggtattctaagtttctgagctaaaatccatttatcagtgagtgcatatctaatgacttcttttgtgtttgagtttcctcactaaggatgatatcctccagatccatccatttgtccaagaatttcataaattcattgtttttaatagctgagtagtactccattgtgtaaatgtatcacgttttctgtatcctttcctctgttcagggacatctgggttctttccagattctggctatcataaataaggctagcatacattttcattggtttaaatgcttacttagacctcttagcagttcagtgcttggatgaataccttggttctaggcagaaagaagataataaactgtagtgagctgatttgctgtattatataaagtgctgatcctatgaagtagttctgttggggtatgacaaaccccttccagataccctccagtggaaggctccaaagatggaaacatactgacggaggttgtgctgtcacctgaaacaccttggagatctgtgatgtagatgttatgtatatttataagcttttgggacagaagggttttccttcagatatagtcaactttgtattttaaagtagaaactgggatggggcgagggcaggtagctcagagcgtaaagcatttggtgcgtgtgctttccagcctgaatttgcatccccagccctaaaagaaaccagtcactgtaatggtggcacatccttgtaaccccattgttggaaagcagagacaggtaatgccagaagctcctgaccagctagtctaccagaaccgtgggagtaagatgtgttctcaaaccaaagcggtggaaagcgatagagggggacatcctaagtaagaatggctacatgtgcatgtgcacctgcgaatgtgcacgcatcacagacacgataattaaatatgttagaagggaagatgttagttaaccaagtgactgcaaggagacatgctgattgtgtgtgtgtgtgtgtgtgtgtgtgtgtgtgtgtgtgtgtgtgtgtgtgtgaatatgatgtatatgatgtattcagcttttatatcacctgtttactttctagtcagaaagacaagatcttcattctagacacttcaccatcagtaaaataacggtcaatctctaactttgtttctaatataatactgctttagggggaagattttttagtgagaggagacacgtccttgatactttgagcttcattagaagatgcctccagttacagggtagaaggatctacctgagccacaagtccagaatcatacaagtggacaaaatggtcctacaccccagtaaataaagtgagaaaaaatatgaatcacttgactgttggttactatcacatgacttaattaccttgtttttgatgagtaaatccatgaaatgtaggataaaaatgtctcagctccagatatatccatttgcctaagaatttcataaattcattgtttttaatagctgaatagtactccattatgtaaatgtaccacattttctgtatcaatttctctgttgagggacatctgggttcttaccagcttctggctattataaatagggctgctatgaacatagtggagcatgtgtcctgagtgaggtaacccaatcacaaaaaaagtcacttgatatgcactcactgataagtggatattagcccagaaacctagaatacccaagatacaatttgcaaaacacaagaaaatcaagaagaaggaagatcaatgcatggatacttcattcctctctagaatagggaataaaatacccatggaaggagttacagagacaaagtttggatctaagacaaaagaatggacnnnnnnnnnnnnnnnnnnnncaagctctactgtactgaaagagagtgagaaaatttagcaacaaagttccatgaacctcttagaattctttgtcacacaactgccaaggtttgttggctaaagccaatggaactttttctaatctcttctcttccttctccgtctgcaaggggtctcagtctggttcccagaaaacatggtgggaaagattgaaggtctagctctaggccagaggccagtgtgttatcctcagaacctgggtgtgcatgctcaaatcccatcttaggtatcaagagtgcacaacaacaaagtctttacaaattgcagcaaaaccggcttcatttggaaatatattcaatactcatcaataaagagagaaagcagtttatgttgaaccactaggactcttgatctttctacaactatctatcaaatagttcttactttt

SEQ ID NO: 1260 - DNA, 1480 bp, Mus musculus
gccgcaggctgcccacacaggccgcccgctgttttcccttgctgcagacatgctgtggatctgggctgtcctgcctctggtgcttgctggctcacagttaagagttcatactcaaggtactaatagcatctccgagagtttaaagctgaggaggcgggttcatgaaactgataaaaactgctcagaaggattatatcaaggaggcccattttgctgtcaaccatgccaacctggtaaaaaaaaagttgaggactgcaaaatgaatgggggtacaccaacctgtgccccatgcacagaagggaaggagtacatggacaagaaccattatgctgataaatgcagaagatgcacactctgcgatgaagagcatggtttagaagtggaaacaaactgcaccctgacccagaataccaagtgcaagtgcaaaccagacttctactgcgattctcctggctgtgaacactgtgttcgctgcgcctcgtgtgaacatggaacccttgagccatgcacagcaaccagcaatacaaactgcaggaaacaaagtcccagaaatcgcctatggttgttgaccatccttgttttgttaattccacttgtatttatatatcgaaagtaccggaaaagaaagtgctggaaaaggagacaggatgaccctgaatctagaacctccagtcgtgaaaccataccaatgaatgcctcaaatcttagcttgagtaaatacatcccgagaattgctgaagacatgacaatccaggaagctaaaaaatttgctcgagaaaataacatcaaggagggcaagatagatgagatcatgcatgacagcatccaagacacagctgagcagaaagtccagctgctcctgtgctggtaccaatctcatgggaagagtgatgcatatcaagatttaatcaagggtctcaaaaaagccgaatgtcgcagaaccttagataaatttcaggacatggtccagaaggaccttggaaaatcaaccccagacactggaaatgaaaatgaaggacaatgtctggagtgaaaactacctcagttccagccatgaagagaggagagagcctgccacccatgatggaaacaaaatgaatgccaactgtattgacattggcaactcctggtgtgttctctttgccagcaaatggtagttgatactcagtgagggtcaaatgactagcaggttccagggactgcttctgttattctctgcagttgctgagatgaaccattttctctgtctactgcaatttttacattcaaatgtccatgaaatttgtattaaatgtgaagtggaatctgcagtgtttgtgtttatattcatatactatgaactgaggagaattataaactgaaacaaatactcgcagttaattgaagaccttccattgatggacagttcttttcctctctatatggaaatgtataatagaagaaataatttttaaattaaagtatctctttttgcatttca

SEQ ID NO: 1261 - DNA, 984 bp, Mus musculus
atgctgtggatctgggctgtcctgcctctggtgcttgctggctcacagttaagagttcatactcaaggtactaatagcatctccgagagtttaaagctgaggaggcgggttcatgaaactgataaaaactgctcagaaggattatatcaaggaggcccattttgctgtcaaccatgccaacctggtaaaaaaaaagttgaggactgcaaaatgaatgggggtacaccaacctgtgccccatgcacagaagggaaggagtacatggacaagaaccattatgctgataaatgcagaagatgcacactctgcgatgaagagcatggtttagaagtggaaacaaactgcaccctgacccagaataccaagtgcaagtgcaaaccagacttctactgcgattctcctggctgtgaacactgtgttcgctgcgcctcgtgtgaacatggaacccttgagccatgcacagcaaccagcaatacaaactgcaggaaacaaagtcccagaaatcgcctatggttgttgaccatccttgttttgttaattccacttgtatttatatatcgaaagtaccggaaaagaaagtgctggaaaaggagacaggatgaccctgaatctagaacctccagtcgtgaaaccataccaatgaatgcctcaaatcttagcttgagtaaatacatcccgagaattgctgaagacatgacaatccaggaagctaaaaaatttgctcgagaaaataacatcaaggagggcaagatagatgagatcatgcatgacagcatccaagacacagctgagcagaaagtccagctgctcctgtgctggtaccaatctcatgggaagagtgatgcatatcaagatttaatcaagggtctcaaaaaagccgaatgtcgcagaaccttagataaatttcaggacatggtccagaaggaccttggaaaatcaaccccagacactggaaatgaaaatgaaggacaatgtctggagtga

SEQ ID NO: 1262 - DNA, 45121 bp, Homo sapiens
cttagacttaagctcaaagcctccattcaaagaaagtggccaaaatgtcccccctctggagcaagttgcattctgattaggaatgagactcaagccatataaagtcaagtacagttacaaggcaatgataagaaagaatgagatagctcaattccaaatgaatctggatttatctgatatgtaaatttaaaaagagagagataattttcccagactccaaatgccaaatcagtttcactccctcctcaaaagtgctgagaaagttctaaatttggaaaggtcacaaagggataaagtgagtcagaggaggctttggtttgccttatatgaaaagtgggatttggactatggaggaatagggtccttccagaggggatgtttgaatgacagagtaggaacagggcatggggaggccaactgcgaggaagtcagcacaagcaaagggcaggcccagcaatatccaagagagagcggggccagtccacagggtgttcagtgtggagcctccagacctgtgtcctaactcgagctctgccacatactagctgtgtgcaaattagttaaactcacctaacctatgtttcttaatctgtaaaatgaggataatattagatgttaagattaggtgaggatcaaatgagacattgtgtgcataaagcacttttcctgtgcagttaaacccttgataaatattagccacttattaaccatcgggttaagagagaaatgacttttttttttttaaagaactggccattgctttatcttccatcgtcgtgatttatactttttaactatattcacaccaggaaaagttgatagtaaatttcattttgggtgaggtctagactagtatccgtggaaaggaaggcaaattgaagaggtatgatcctaggacagaggaagaaccaaggtcaaaacagggacatttcccaattcaatccaacagctgctttgttaacagtgccacaagcagtggggtgggcagagtgggagacgcatcatatcctgggaagggaacactgtagggagggagagagaggctggatgggggaaacggtagataaaagattgggcaaagtaatttagtcccagtcccagatactacgtgtttcagtctgtgctcgtgggtatgtaaaggtttcagatgggctttccatgaaaaacagcaatgaggcaaaccgtcccattcactaaaaagacaggcattatcatgatactgtgcaaagagcccaggctttagagtcaagcaaatcttgatacctttacttgacacatgaacttgatcgagttacctctatgtgaatcaggaaagttattctttccctgtaggtgtgggtatgagaattaaataagttagtatatataaaagggtctaacacatagtgagtgcttgattaactggtatgtgttagttcaagaaggcagtatgttgttatatgcgagaagcaattgctttggttcaaaccccagctctacagcttactggttgggtgactactgcaagatcctcaagtgcttgggcccatgtttgtttcacctatattgtgcacacaataagaagacctacctcccaagatttttatgagcattgaatgagatcatatttataaaacccactaaatggtacctggctcatactaagtgatctaaatgaagaggtattatcattaagaagcaattaaaagttgcatgtgtatgaagttaacagcttttaacataaaagacaatggattatttggtaagagatctcaccgagcttaaatgtgtttttttctttttttttttgaaatgaggaaaggaagacataaatggcagaatatgtggtacagaactgtaagatacatgtcccacgacagaaataaaaaaggcagagattcactgaggggggaattcatggacatttatggtcacattatcctgattggctgagggagtcagcaggcttctagccagttttcttgctgttcacagaaataaaagctcagtgtctttgaaaatgaactaagtttttttttctttttcttgataggaaaatgtatttatgtagtcaagtaagacttgtttctgctaagtaaaaattcagcctaagcagtgtaatatgaagctaaatggagactggatacaaatatgtttataatgagattactgaatttgttgatttccctacatttcccatctactaccactaaagaaatgctgtaataataatataactggccaaagtggtaaaagtggggttaattggtccttatctgtttgaggtaaacaaccgaactgatgagtggtttccctgagcaaagactcttgctacttcatgtgtcctttccagaacgtggcatcaacatcacatgggagctggtgagaaattcataacctcatacttagacctaccgaatcagaatcttaatcttaataatattgacaggtagtttatatccatattgaggtttgaaatgcactgagttagagtgtggagttatggccacactgtcttaattagattatctttatttcaatccaatttgcatggctatgtgagctatgattcttagaggagtgaacataaacagcaaaaattcttacttagcagacttacccagtgcaagaaagagttcccttatctcactgtattatgatcttagtcaatatgacccggaatttaagaaaataatatgacaagagtatggttttaatcaaccggaaaccatgtgttcaacagaacaacaaaacaagaaggctttgtacttacttagggagtttacatcttgatgataaggccactgaggtaactaaagaggaaatggattcagcataggctttggaagttcacttctgttacctagtaactgtgtgactttgggcaagtctttccaagtttcttttctataaaataggatggtaacaggacctactttacagggagttgtaaggtttagataagttaacaggttatgcaaaaaaaaaaaaaaaaaaaaaaaaaaaacacacacacacacacacacacaaatgttctggacattttataagcattagatattactgatatcttatttttgtttatttttaaatgtctgtccctttaaaccattcctttcaacatatttgtgtggtttaaataaaaataagtttgaagaaatttcagaaagaactttgataaacccattgaatgacttggaaattccaaggggatttcaaagccaggtggaggaatgcctgcttagtgtctttcctcagtgcaaaggctgataaaggcctcaatttctccctcagtttactgtgatcagagacttaggctgcctagttatccttgttgcctggacaaaaaactctttagatgcatgcaggtttgtgtagagtttgtggggaggtttcagatggtaaaatgcctcttcctacctcaggtgaggggagggttactatcattcctttttcacagagctattctagttctgtttataagtagtgttctttgtatagtggatgttgagcaaacacttgttaaactataggaagttataacatcgggagaatttctaacaactgcaaagtgttctgatatgtaataaattgccttgagaaatagtaggagccagtgctggaaggagtcaagctaaggctggtgtagtctcctagggctgttgtagagaagagtctaaagtgggaggtgttgatcttatggtcccagaggtctctcccacactacctttctgcctgtataggtcagaatctattaagagtgagtaggaatggattacaccccacagtcatgaagggccttaaatgatagtagcacactagtgtcatatgtcaagtggcaaatgacactagcaccaaatgtgattctgcatttaagttctaagtattaaatgcatctatttgctatatgaaaacataagatatcccagtgtttgcaaactggttcaatattgtgttgatttttgttttgctttaatacactaagggaacttcaaaaggctgatgtggtccatgctctctgagccaggcctctcttgacttcttatgtttagttattcatgaaaccactgggcctgtctaaatggccaagtcatataggaagagacagagtgaaagggagagcaagagctagagtgagagaaagagagagagacatcttctcaccttcagacctgatcagaggcaataatgggagaccatgggaggggagagcctgatctgatgattccttttcagttattttctggaaagtttaaaaaatatggtattcttcatggagaagccaagatgttaggctgcaggcagtgcttatgctctctagcctagtgaggaggaaagcagtataggtaaataaaatgacatttagttggtaatataggcagggcctatatcaactgccacctataaaaggcgttggtgatggtctttagggggccattggcaaattgctacaacaaaataataaaataaataaaataacaaaatccaagtttatctcccagaatctatctgggcatatcattactgttggaaagacttatgtttaccaggtgagaaaactgatgctgagaggggttaaatattatgcacagcttctcacatctagtgaagtaactgaactaggatttatatctagggactctgtccttcataggacaagttgctaatttgggggtgttctcagggagaggaaaatgtctatatgctcatatgcacagattatccaaatcaaaactctttctccccattgtcctttctcagttgaactagatgttaataccactattgtattagtcgactaagattgccttctgcagaaaaccacctatgtctcctttctacccaagtgctctggggctcctcccctgcccattctcctccaacatcccattccacattctctttctatctctgcaggactccctgtagtcctccctgcccatccattatctccctcaagctgtcccctcagccttttctaacagggaaaggctggtgccctggtaaagagtcccccacccccatcccactccctggcactagatgggcttgggagacaatgactgcccctccctcatgctgttctgatgtctcttgttccttccagtcacctcccttccaggcccatgaggagggcctgaggcccacactagctagtcttttctctggaggttgtttgggggcagggaggaagtctaaagtagagagaaagcgctgccatgccttaagccaacctttccagaagtataatgcccttgccactagtagtttgggaaacaatttttattggcatgcaggcaaatattttgtttcaatagtggcatatttatttttatggataccttctatttttggcaaggaatgctgattttccatttatggttataatgtaatgttttattttaaaaacaaaatgacttagggaacaaaataagttgacttaaaaataaattattagttaaatatatatttagtatatacaagtagactacagaaatggcaaaatagattgaagttgaagaaacattgccttaagctaagcccactcaggatgaaattttatctgcccccaaatcaacatctcttgaaaagtggtccctatctttccttgtgtcagttcttaacacccagggggtaggcatgcttctcatgtttgttttcatagaatatctgtgttttcaggggaccaccatatgcaaaaatgtcaggggaggggtactcaattggattaagaagccagggcccacagaacagatgttttcaccctactaacccaattgctgtctgctttttagttgccacagtctaaacattctttaatgcattgtctttttcagtcattgctcaagaggtaggttagtataccagttttcatagtgggaaaaattaggagacttaataatttgctgcatatcttggtggccaagttttccagccctggtcagttaggctttaggacacttttcttaggcttcaggaatgtgagcatggaagtagtacagaaaggaagtagtacagaaaggaagtaatacaggaaggaagtagtgcaggaaggaagtagtgcaggaaggaagtggtacaggaaggaagtggtacaggaaggaagtagtgcaggaaggaagaagtataggaaggaagtagtggaggaaggaagtagtacaggaaaagtggttgtaagccatttaacttactttttttcatctgaactgtgacccccaaattatcaatttgtcttgtgaagtcacttcatttaggaaaagcaatgtaaaagtaaaaattagtatttattgtgtgtactaggtgctttgcatatgtcatttctttaatcctgtaggaaataatatgttctccaggaggtgacaatgtctatatgattagattcacagattacctatccaaatctaagatctccgtcctctctcttcctttcccaagaacccatacatatttctattaattggtagaaataattattaatagactttgtcacttggccactgtgggctctgacgccctctagtgacagaaaaattctttggtagaagaagtaatatccctagatagcagtctacagaattgtttaagcaattatctttacttgagcttgaaactagaatagctaatttgtaacaattaacttttgtaacaaaagaattattatactgatcaaagttctgataatttatcagttaagattttttcagttgtaagaatctagcttaagcagaaactaagaatttgtagagttgggtaactttgggtggtccagggttcaatttaagaaccaaatgcatccagaacttggatagctctaccaaccttgatctttcagcatggtttcctctcagtgtggtttcctctcagcatgagttgactgttttcagctctggcagggccacaagctcccttcacaaccaaccacatcagtttcacatctcacatatttctacttcaaatccaatgaaaaagaaagggtttgtgtcccagtgtttccagtaaagatcccaaaatctactccaactgaatgtgatgtgctgattggcttaagccaagtcacatttcccacccactacctccctccacctacacatatacccaagccctgggattggtaccaatgccactgtgatggttaattttatgtatcaaattagctaggccatggcacttggctatttagtcaaacactatcttagatgtttctgtaaagcaatgttttggatgggattaacatttaaatctttacactttgagtaaaacatttgctttctataatgtcaataggccttatccagttagttgaaggccttaaaaaagaaaaaaaaaaagactgacttccactgagtgagtgagaattatgccagcagacggcctttggacttgaactataactttttcatgggtctccagcctgttggccaatgctaaagttttggacttgccagcctctacaatcatgtgagccaactcctatctatctttccatttattcattctcttggttctatttctctagagaaccctgactaaaagaaccactcacatcaaatagttaagaagaggggagagggacagtttttctaaagacaacttggaagtactattaccagaaggaagaagaaggagaaaggcaggataaacagtcatggatatacactatagctgggagttattaaaatcaacttattgcaatttagtaaaaacaatttggttgacaacattttttaaacattaggaccaaaggggaaaagaacaaaagtcttagtggtaaaaagatgtagaagtttttttttttttttttttttttaatcttaactcttcctgtttttttacatagtcaagattcttgtttaagtgttattcagaatgttcagaaaccaggatatcttttgagtagaagctttaacttatatggtatggtttgaataaggatggttgtccaaaacatctccaacatctgttggagtgcctgaaattctattattaaaattttatttctttgcccttgaaggcctgaggactctcaggaatatgctggtaaaataaaaataacctttagagatgcccaaactgttttccccagaacaccagcattcattaggtgttcattcaatagattcttcaaaggattccaaaggcaaagaagtttggggaacagtatatataattacccaaccctttgacattagcatactaagggccctgagaagttttggattaagaaagttttcaaattaaagtaacccagaattttctaagattatttgaccatgaaacatatgtctccccacaaagcacatattcctatctccttgaacttgaggataattagacgtacgtgggtagagggtaggggaagggggtatggcatagaaagagcaggaccttgggagcaagaatatctaagtttaattcctgactctgctatttattaactaaccatctttgccaatgttgcttaagcttttttggctacatttttttatttgtaaagtaagtttaataatcactcatctcactgggctataatgataagtattaagtaaggaagatccacatatgtgagttgctggcttataattcacactcaagagatactgattttgtcaattgtcctttcccctttttttctctcttccctccttccattccttcttcccttacctctcctttccttccctcacaccccttttccttccttctttttacatttttttatttaaatgaacttttcattttggaatagttttaggatttcaaaaaatttgcagagataatacagagaatgcccatataccatcctccttatcccacttctttttgtgtctattagatgctcagagtgtgtgcacaaggctggcacgcccagggtcttcctcatggcactaacagtctactgaaaggtggaacagagacaagcctatcaacacctacaagactggtggtaagtgcagtgacagatgcaaaacacagggtgatggaaagccctcaggagggtaacctaacctagatttgagggcccaaacaggctccagaagaaaatgtcaactgagaggaagcctgaaggatgaacagtgggctaagcaaagggttattaatgtgttattaatgggttgaatctaattgggaagggagagaggttgcagagtgaggtgcagagcttggtggacgatgccaaaggaatactgaaacctttagtgtgtccagtctggaactgcatccaaattcaggttcagtaatgatgtcattatccaaacataccttctgtaaaattcatgctaaactacctaagagctatctaccgttccaaagcaatagtgactttgaacagtgttcaccagagcacgaaagaattacaagatttttttttaaagaaaattggccaggaaataatgagtaacgaaggacaggaagtaattgtgaatgtttaatatagctggggctatgcgatttggcttaagttgttagctttgttttcctcttgagaaataaaaactaaggggccctcccttttcagagccctatggcgcaacatctgtactttttcatatggttaactgtccattccagaaacgtctgtgagcctctcatgttgcagccacaacatggacagcccagtcaaatgccccgcaagtctttctctgagtgactccagcaattagccaaggctcctgtacccaggcaggacctctgcgctctgagctccattctccttcaagacctccccaacttcccaggttgaactacagcagaagcctttagaaagggcaggaggccggctctcgaggtcctcacctgaagtgagcatgccagccactgcaggaacgccccgggacaggaatgcccatttgtgcaacgaaccctgactccttcctcaccctgacttctccccctccctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggtgagccctctcctgcccgggtggaggcttaccccgtcttagtcccggggataggcaaagtggggcgggcgcgggacgcgtgcgggattgcggcggcagcggcgcacgcgggcacctgggagcggcgggctgctgcgggaggcgttggagactggctcccgggggctgttaggaccttccctcaggcccgggtgctcagaacgctggaggacttgcttttcttgggccttgatgcgaagtgctgatcccgctgggcaggcggggcagctccggcgctcctcggagaccactgcgctccacgttgaggtgggcgtggggggcggacaggaattgaagcggaagtctgggaagctttagggtcgctggagggggaccccggttggagagaggagcggaactcctggacaagccctgacaagccaagccaaaggtccgctccggcgcgggtgggtgagtgcgcgccgccccgcgggggcggggagagagcctgcagccttcagaacagatattgctcattttctggcagttctcagacgtaggaaataagtcagcaccgaagcagtggttaagccggagggctcggaagaacggcaccttttctttctcgaaaaagttatatgggggctgaatgagcttctggaggcttgtttaccgttttttattgtcacacagaaaaggaaactgccttgtctcccttccgggaattctctctttaagactgtaagtcgctgcctgagtggtttcattttgttttgtttttctgcccttctctttcttcttttgccctttcttagcttgcactcccatggtgatttctgcttggtctcctgctggggttggtggtactcgttcccaccgcacagaacccggcgcctattattggccaagaaacttgagcagcctgttttgaaaagtccctcgctcagaaatgccagcttgcagatggctaatcaaagagacgtggatccaggaggctcatttgagtaccggagcctctgagagtccatggatttttattttattgggccccaacaaagtgccaggcatagcgagagaagtgtttacaaatgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggattctttagaaacttccttggagaaaattaatgattcaagattgagaaaacatttatacaacctcaggccacactcttctctctcttgttattaaccattgcaccactgctatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcaacactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggtgataactatagtcaacaagtatccccatccttaaccccttttgcttctctttctctttccttctctcaaccttcctggtgttagttttctctttcctatttctgagtgtttttactccgacacttacaataaaaaagtttgaaatcccaaaaagttgacaaatttctaaaggagacagaaaaagagtcaaacttactttacaaattaatttgagaaatagctgtgggttgcattttttttttttattgtgcatgaccctgttattggccaagaaacttgagcagcctgttttggaaagtccctcgctcagaaatcccagcttgctaattgaagggatgtggatccatgaggctcatttgaattccgaagcctctaagagtccatggatttttattttattgggccccaacaggttttgtcttgcattatttaggacattggccaggcaatcactggacagccagtttgctctcctttacattttgtagaatggttatcttatggtcaaaggaaagggagagggcctttggaaaataaagctgtgtatttacaagcagtcatacagaatagttttgtggggaaaataaagaacagttatttaatttgtaatttaatcatttttcttaaaccaacccaaagagcataaaatggaatatttatttatttttgtagcttaatttgtaatttaataatttttcttaagccaacctaacgaacatattgggctgtttattttcatttttaatgggccatatttacatcacaaaggacttgagaagtcttacaaatacaataaaatgataaaatatgaattaagacattagcaaccaggatggaaaaacacaaatttgtaaatgatggccaggtttgcaagcaaaaattaaattgataaatggcagcacccccactaccagctatagttagactgatgaaaaatcctctaatgttcatgcctgaaatacagttaccacccttagcagcaaattagaggcaaagaagttctggaatttggacgttgtctctgagtaagctctttgagacactggacaagtaatttccttctgaatactcttatactgacacataggagaagtgtcagtgtttcaaaggaatctctttgaaggctactacattgctttaggggtgccagattaccagagtaaactgccagtttgagagaataactgtttcttaagagatggtctgaaacctaagtaaggaaatccccccacttgaaagcccctaggaagttaattgcttttggcaaattatcttgggccccaaaagtcccttgatgagcacatgttttgtaataggtactaaagactatttacttatgatgaaaaataaaataacacaatttaaaacttgaaattgataaaaagcaacttgaaaccaaatttaggacagtgaacccatccctttcttatttttaaataggtaaatatagaaaaaatgaccacatgatgtgaaacaaaaagcaaatatttaaaaactacatttatactttatctcaccacactaatgtaaagaattttgattttacttataaattcttagccttgtctacacatatacataattgcatgtttaatttgagctatatatagtctgttttttgttcctttgcatgttacacaaacctttttctatttccacataatttttatctcatattttttattggatacattatagagagagcatttattaaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataatttaaaacgataaaaagcaacataattttatatgttgtaccttgtacttccttataaggtacaacactacaatagccttagtgtgtagttttctttttgctatgtatgtatatatatattcataaaagtggaaaaataacatttaataaatcctctttattttctggaaaatccttgctttaaaaaaagtctttagctttttatatagttctacttctaacaccaattaaatatcttcaattcagtctcaagcaggaacaaatcttcagtccacttgcctacctttactgtctttgaagtgacagtgtgagtagtaaagcccaaatcagagagaaattgacttttgtaagattggtaacttcaccttccccggaaggaaatgaggtggttcttccctttgatcacaactgctttcttgatttgaaataaactgttgtacagcccagtcaccccatctttagacatttagaaatggcaatcatagttatataggacaactagcctgagtcccactaagtagaaatgatagtgaatttagtataagattatacctttaggctgggcaggtgactcacacctgtcacccagcacttcaggaggccaaggtgggtggatcatggatcacttgagattaggagtttgagaccagcctggccaacatggcaaaaacccaactctactgaaaatacacaaattagctgggtgtggtggcgtgcctgttatctcagctactcgggaggtcgcggcaggagaatcactggaacctgggaggtggaagttgcagtgagccaagatcatgccactgcactccaggctgggcgacagagtgagactccgtctacaaagaaaacaaagaaacaaaaaatcatacctttagagcaaggccagccttgtgaattagcaaatctgactacaaattcaatcagcagatgtactcagcccagcaaagtgagcaagcttactataggttgtgttaaggcatggactgggataaactggcaaaattagagtaaatttgacaatttgacattggattcattaatgatagcctgtccttcaatgaagtcaggcagcattgtgtttctattcacctctgtgttttgtgaggctataaaaatataagatatgagaaatgtgaatactttttatttgtgagggcagatatcttgaaaaagagagcgagaggaagtcagagtatgcgggtgaagactcttgtttttttgctgaggatttagctttggtttttagccattctcacagagatcattggtcctaattaactggttgttgttgttttttttcatgtgaatgtctgtaaggtttcaggcttgattttaaaaattgggcctatactcacagaaagacaaatactgcatgatctcgtttatatgtggaatctaaaagttttgaatccataaaagcagagagtagaatagtggttaccagaggctagttgggggcaaagttgggggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaaaatatgtacataattcaagacatcatgttatataccataaatatatataatttttttatttgtcgaataaaaataatacaaaaaaaccctgggcctatactgcccacaggtagtggccacaggcagagctggtcccaagcccctccctctctctgtagtcccttatcccaggttgctttattcttgtatgacccacgtggcccctctgggcttgtaagggctctggggctgtattttaggactctatagcccttacattacccatttcctctaccaaaggtcatttctcttatcttcaagcttatttttggaagggtcattatttcttcatgagaagtcaaattctgatttgcaagtgctgaacacagatgccattagtctataaaactcttatattctcacatgtaaatgtagtaacctgctaacctcagattctgcttcctctaacctagttgccctgcaactgtgatgaacctcaaaatcaccaagggtacttccccattctcagagatcctgattccttaggtctatgtaggggccttagcactttttattaaataatgcatcactacaggattctgatgtctgtcggggtcttgagaactatttttctgactctagcactaaactcaaaatgtaatttcagatggaatttcctaggctcattcattttattttatttatggcttggccagtcatggatctaatcagtaacttgcaactgttgcttcaactacctctgtcctggactttccagagattggctttaagaaagaaagaggacatccctgggataagattaccatgtgtatttttatgtacacattttgaaaaacatacaaatgaatgggatctttgcttatctcttccatgtagaaaaatttattttacttctatttcaggttttcaataatgtagtaggacaagatgacatcactatatccctgttttttacacagatatattagagatgcattatcttattggaaattttaaactattcaataataaactattagtcttttagaatttctttttcctcaagtgttgataagtaactgaaagtctacaagcagacaagcagaattagtcggtggaacttcatttcttgctccatttttgtcctcagcagtagagggtggtgagatttcaacccagcctagcaggaccaataagtctggaaagaagtagctctagttcatattggcacctgctaattctagttctgaagaccatgggaaatctcttgcctatttagctcagtgatcatccaagatgggaaattcttgggctcagctgtgagggatcccaagtttatatgtaccactaatgtctcacaaatcaagaatccaagagaatcaagagactatagttcattccttatattaaattcttaggactgccaactgggtggctacagttttgggggctagaagtctgatatcaaggtgccaactggactggttccttctgaggaccacgagggcaggatctgttcaggcttgtagatggccttcttttccatgtgtcttcacattatcttcctctgtttgtatgtgtgtccaaatttcctcttctttttttttaatttagaaatttatactgtctacaagctttatatagctttagttaaaaaaaagcaaaaaaaaaaaaaaatcaaaacaaaaacagtgaagccaagacactcttccaaagtctggacccttccggccttccaaatacaagagctctggaagttgtatataccaaatttcctcttcttaaaatgtcaccagtcacattggattaaggcttaccctattaacaccattttaacttaatcacctctgtaaagaccctatctcctgatacagtcacattcggatgctcaggaagttagggtatcagtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggatgctttgctggtgtcaacactcccctttacaaaaaaaaattcggccgggcatggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggcaacagagcgagactccgtctcaaaaaaaaaaaaaaataaataaaaaaaaataaaataaaataaaataaaaatctcactttctgtttctactgttctctcaagtacccctctgccttctgttacttctttgctgcattctgagaggaatggggtggggagcactctttcctgtagaaccccataacccatctattttcatcaatttatttgaaattcaaagccaggggttaaaatgtccactttcaatttgagatgtctaactttcagataaatctattaacatgcatttctaagtgacttttaagctaagcattttattttattgagctcgtatggaagggtaactattatacttgtataataaagtgcactttcaaaaatactcggttcaaatgtaaaataatattcgtaatattttaagacaaacctcctagaacttatatgtgtctttcttcccagagcagtctctatgggtgcctaaacaatactgcattattagatttttttcagtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacgtttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtctagtaattttacttcaaaaataaaagagaattttctttaccatcaaacaacgttgctgtaatgagtggtgatatatttagtcctagaggaccaaagagaaataaaatggctttgattatgctggtttaagaaaatatatccgattaaacagaggttaatatttgtgatgtttgatttagtaaaattataagactaccaaagaaaactagaagagcaaaataaccaaaatttatataaagaattcaatgttgataattcaaaggtttagaattttttccacctttcaaatactaagttgctgttatagatttactaccattattacccagattttccattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgtgtgttaaaagataatatactgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagactagcctggccaacatggtgaaatgccgtctctactaaaaatacaaaaaattagccatcatagtggtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttgtgcttctttttaaaagtcttttcctgtttgctttgaacttcaataaaaacagggggtaagaaggtaatatgcttttattttgtctgtggggtttttttcttccttcttttggttccttttcagatcctagctcatcaaggccatttgccacactgacactggaataagcctgaatgggggtctatatttcttccagtagttagtttaattcggtcattgagctgttgctctatttgtaaccgtcatgctagatccgagggctgactattcctgagaaagtgtggagatcctttcagactgccatggtgctagggcagagtttcagtcattatcttctgtgtctgctaattcttgcatcatttcttctactctgtaacctggttggctatgaaaagtgattcttcctcactgatgctgcaggcaatgggtgaatatccaattgttctctcaggttcttgtcatcggatacaaagaacaaatttcatgtgtccctgtttctgagaggttcaaagggagcaaatgcacagattctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccaagcttcagggcagggctggcaagttttgccttccccgccagcaagagccctggctttaggggtcttgctacagttttcccagactggaggtcttggggctggattctggttcttagcgaattcttgccaaacacctcccctttccccagtatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtcctgagtctcttgttagccactcttaactgtgaattattggacaaatcatttctcgcactctgtgtaatctgtcacctgggtacttgatgatttaaaccaggaattgtggcccttctcataatactgtctcctaaatattgggtgaatttagtatatcaaggagggcagggcactatacccgtaggggactctctctctccctctgtctctttgcctttctcagatatgcatctttggtggcagacctggggttcaaaccacagttgttttgaaatttctctttccttctccactatgctccccctcactgaaactttaataataaaagtagcacacttattgggcatgtatttgttatgttccaggttctgtgctaacagctttaagtgcattattccacgtattttcacaacaagcctgtgaggaagaggttatttccacttatagataaagaaactgagacttggagaatgtaagtgattttacccacaaacacagggcagtaagtgggaggccctgttcaccttagaacacctggcttctatcattcatggtgctgtttctagtgtggtttgaagaacctgagatccaaactgctatacaagtgacctgctgctttcttggagagagaaatctgaaagacagtggagccctcacattgtctttgcctgtgcacagcagatactgccaattttgggtgggttacacttgtttaccacgttgcttacttcagaaatcaataaaattctcttcatgcttttattttacaggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataataattttacagtttttggttcccctatattatataacataactgagagaaaaacaactatgaaattattttccaaagatgagttttatttatatttatcacgcttatttgatgtggttatggataaatttaatttacaagtgacatgcacctctgaaatgagaagactggtctatttggctccatttttttctaagcaaaaatgactcatttgtgaatatgaaagcttatcatgtcaaaactgattaggatctaccataacaatagtggaactctgaaagcaagagacttctcctcttaagggatatgtctcagcacttcccttcaatcagaaggtctctaagaaagctgtcctggcactgaagcctgcaaaatatatttgcattttgcagctgaataactagacgaataagaaaagcaacaggcagaaaccaacagcttttttttttaaatcaatactttgaagggcaaactaatttcagatcacaaatccttcaaacactggtaaattagaagctaagcaaaatgcaattgtgcaaacatttcttcaactttgagtagagttgaaaaaaggaaaatagcacatgggttcatgtgatagattaatagaacaaaaaaggactgtagtatgtttcatggttgtcctcccaggcttccagcactcaagctgtaaaacaggatgggtcctgtttgtgaaaagattctaccagtctccctgtgcttcatgtccagattttaataaccgttatggaaaaatctcccctataacccaacccatttatacttaaacccatttacacttaaatcttctccaacacgaataaagaatggcgtcctggctttattataacctgctaaacacaatcaatttgctctatgaattgaaatctttgttcataattttaaaacctaaaatgtaaattaaaatgaacaaaatatgctttgcacatcaaactgtcaaggatttttgtctattgctttttcggttttgctttgttttattttaatttaagaagtgaatgtaaattgttacaaacttttaagaaatacatttggatatatgagtcaaaaatttgaaaaaaaattttttttaacttttttttcttattattatactttaagttttagggtacacatgcacaatctgcaggttagttacatatgtatacatgtgccatgctggtgcactgcacccactaactcgtcatctagcattaggtatatctcccaatgctatccctcccccctccccccaacccactgtttatacttgctaagatagcaattaatttatacgaaaataccctgagaaaataatcaaaaataaaggaaaatattgtacacatgatatttcattatcaatatgatgtaggattccttaggtaaattctggaatatttaaagactgaaatagtatgtatcaaagtcatgttttctgatatatttctaatataatcctcaattatataaaccttcttaagtaatttccaactgatctggctggattaactgattctccctgatccgtctataaaatatcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatacagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgacatttttgattaaatgatcaaagaagtcctccccacatcatcatattcaataagaaggattctatggtatactgcacacatatttcatatatacacattgtacatatatatatatacacacctgttatatatatgctcatgcatatacatgtatgtatgtattatatgcataggaatgcaacaaaataacggcaatatctccagattgttgatatatagttttttgtttgtttgtttgtctgtttttttgagatggagtctcactctgtagtccaggctgaagtgcagtggcatgatctcagctcactgcaacctctgccttctgggttcaagcaattctgcagcctcagcctcccaagtagctgggactacaggagcacaccacaacaccgggataattttttgtgtttttaatagaggcggggtttcaccatgttggtcagtctggtctcaaactcctgacctcaggtgatctgcctgccttggcctcccaatctgctgggattacagacatgacccactgtgcccggcctgatacataagttcttattatactttcctgccttttccaacatttctataataagcatatgtaccattatactaaaaaaagtattttaaaatctgattttcaataaaacaactacttattttcttattttaataaattttgttttcatactttggaggaacgaaagaacctgtggtttactgtatctccattataccaaggaagttgtgctaggcacattctgtaagataattcattaaagagaccaattcattcagagaccagtataataccactagcaaaaaataaaattatacttggacttgggttctgttttctttaaatattgctacaatgttatatagccctatgcactatttttgaattttgttctgggaatctccagtttgttttttactattgacagactattatctttacttactaaaatagcatatatatttacatgtcataatttgctcatgtagtaaatattttgttttatcaaaaagaatatatgaagttattaaggaattcatgttcctaggaaacacagcagaaattaattttgctgtataggtgagcagagcagattaaactgcttatatttttaaaactagttataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgcataatatcaaacttctaaaaagttcctaggactcaataggcatttaataaacacctatcagataaatgaattttttaagagaacacattacataatgctttctaatagcaatacagtgacaaactttatttttaaagtaaattaatgcaaatatgtatattatttaaaattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatgaaatttaggcttggagaaaacaacactttgttaaagattttatagctgctcaagatttgaccaaggcttttaaaacttcaaatgttcttttccttattacactgtttcttatcaggatttgtggactttggaaagtaaaatgaaaagtcagagcaatgtgagttagtttgataatctcagtggccagtaacagctatccccactctgaatatataccaaccaacctctcccctttctccaaggaagttagttcttggcaaaggcatttcatgcagtgtactttgtcattctaaccttcctttttttttgtatgctcctgttgctaatcatcctatttctatgggcttcagtcactcttttagcttttgtcttgggagactttctgtctgttgacatgacttttaaaataatcttctcccccattgtatttatatctcattagcctaccccccctccccttgtgttttagaagagttttattgtctgtcatccctctatacttcccaccctgttacctgcccgtgtcctgttcaaacacttgctccttttttccttgggcaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggtaagagtcttaaaatgcaattgaaagaggccaatcttggaatttcatgtagaaccatttataagacaatttgaaattggggcctactgtggtgctatgttgacacacaggaaagggaaggacaggtggctagggtaccgcagaaccaggtgccgagctaactactggtctagacctttatgagtaagtctaggcaattcttccagatataggagaatgagtaaatatgaaccctaggaacagggttcatcagctcaaatcaaaagctcagaaattattttttttctggccttgacttacgcttatataatggtgctcgttcatggccagaaaaattcagaagcctgcagatacaaggacacagaaatccaaaaggtaggtaggaatgctccccctttctttggggatttagtttgtcctgataattccatctggggacctgaattttcatggatatctcaatgtattctaaggacccagattgaagtataacagaagtgtttctagttttgtttgacatgaagaaacctctggacataaagcttttcccatccctattcagcctataaagcaatgtttctcatccctggcagtgcattagaattgcttagggagctactaaaaatgtttcatgtttaggtcccacctcagggcaattacatcagagtctctgagtgaggaccttggtattggcctgatggagtaagtctggggtagagcctaacattctacatttttaacaagctcccaggtgatgctcatgctgccagtccccaggtcaccctttgagtgttaaggctagagactagaggaacaggggagacgtctaagtattggtgaggtttgtcttggttgctgctaaatgattgctggccatttcaacctggggtttcctgttctgtgtttaaacactgactgtattactggtgtcatgctgtgactgttgatataagcagtggatctcaaaaatccatgcagctcctgcccaccattttcatagtctgcttataattagccgctataactaatagtttccaaactgattttctaggcttagaagtggaaataaactgcacccggacccagaataccaagtgcagatgtaaaccaaactttttttgtaactctactgtatgtgaacactgtgacccttgcaccaagtaagttttagtctttctctgattaaaacactagatataacatgagagttatcattttcctagggaagtaacactgactgagagttaagaattagggttctagtcctgctttgcctccaagcaactagatgactgtttgctcatttaaacactggtgaacttcctgtgtaggtgacactttgctggccacttaagctaaagatatgagccagacatatgcctggcatcaaggtatcagtccagaagcacagacagtcaaggaaagcaatggttattgtgtttcaacagcatgagaatagcatcagaagagacttatgttccaggtgttacaaattatacagaaaaacttttcaactctgcctgaggagatggaggtgaagacatgaatgtgtctcatgacttgaatcttgaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgttttatttgctaggaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcttggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtgaacatggaatcatcaaggaatgcacactcaccagcaacaccaagtgcaaagaggaaggtaattatttttttacggttatattctcctttcccccaaccccatggaaagatgtgaagaaaaaccaatcactcttgattagtagaaagtcctttatttaatcttaaagattgcttattttcatataaaatgtccaatgttccaacctacaggatccagatctaacttggggtggctttgtcttcttcttttgccaattccactaattgtttggggtaagttcttgctttgttcaaactgcagattgaaataacttgggaagtagttcacaaagatttgcctcattcttacctataaaaagctaccactttggtagatttatgtattgttaatttcttgcccctgaatgcagccttgagagctgactgataagaacaaatgaaattattcctcagctagtttctgagcaacagttttggggcattgagtggtattctcatccttcctatgaacaggtgttctctgcagcagcagaattggccaaaaatcagaagtaattcttcactattcattgagatctccctatgcaaaaagagaacacaagaagcaaaggcattcccaggaaacacattgcagggaacactttaaaaacttgtacttcactgcctcctcttcctcggcctaattgcttgtttttaattatttctccttcttaacttaaaatactatggggacacatgttatacaaaggtgacttagtagagtcagtagaaaagccaaaattagatattatcataattagtctagaaaaatccctttaagtcattcatcaactacagggtcacaccaactttcagtaacttagaagtattcaattttcccttctcagaacaattatctgtttcttcagttcagttgaagaagaaagtttgccttgcctttagcggttgtttagctgaaaatacatttgggatatttaagcactgtaattgtgctcagagacatacagattcttctatctcacattgactttaatgcatacacctattgagtatgtatgcttgagttatttgtgtgtgtatttcatttctgggcatccatagcaagttgatgttgacttgcttgtcctacggcttctgcatcctgccatagtcttgccgtccacatctttgctggacagagagtggtgcttgccatatggtaagtcaaaagccatctccttgctaggccagcctgtggtaattagatgactaattaagatatgtcctttcactagaacacttgacttagtagtacgaaagttccaaaatcagcggtctcctgcgatgtttggccacttttaagtttcactgaatttctcctttttccttcttatatttctcttagtgtgaaagtatgttctcacatgcattctacaaggctgagacctgagttgataaaatttctttgttctttcagtgaagagaaaggaagtacagaaaacatgcagaaagcacagaaaggaaaaccaaggttctcatgaatctccaaccttaaatcctgtaggtattgaaataggtatcagctttccttgaaaagaaaaatagagaaattagtgatttggctttttgttacttccttttacttttttgtttcttgtttgtttcattttgtttgagatggagtcttgctccatagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctggtctcaaacttttgacctcaagcaatccttctgcctcagcctcccaaagttctgggattataggtgtgagccatcacatccggcctgttactttctttatttaaacattgcttgtgtttgtgggtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagagaaacagcctttaccaggcatgggttcagtatccaagcctgagcaaagagattgctcttaaagtttgtcataagggcacagcttaactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttagagtagttatatttattatttattttaataagtctatatgaaaaataacctcaacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgcttccattttttgctttctaggaaacagtggcaataaatttatctggtaaggcttttatcattttatttcatagagatggcatcctttagagtaataggccaatttcagagtaaaataatgttactaatttcagtgacatattatgggatcttgttatttctcatacaattctacctgctcagcataaagcatttatcaggcagtttgtttaaatttataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcagactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtatttctggttttctcttttttggtaggggcttgctttttggttttgtcttccttttctctaactgatgctaaatataacttgtctttaatgcttcttggatcccttagaaggtacttcctttttaaccttaacccttttagtagttaaataattatttccataggttgctattgccaagaagacctcttccaaacagcacatgattattcgtcaaacagtttcgtattccagatactggaatgtggataagaaagtatacatttcaaggggtaggttttattattaagaaagccaaatgaggattttgaaatattctttcctgcatattatccattctagctacatgctggccagtgggccacctttcttttctgcaatttaatgctagtaatatattctatttaacccatgagtcccaaagtattagcatttcaacatgtaagcatgtcggtaagatagttgtgctttgcttagggttccctcctgtgttatggtctggaaagtgtctttaggcagaaagtctgagtgatcacagggttcactcattaatttctcttttctgagccatcatagtctgtgctgtctgctctccagttttctatttctagacagaagtagggcaagttaggtactagttattcttcatggccagaagtgcaagttctactttgcaagacaagattaagttagagaacaccctattccactttggtgaactcagagcaagaactttgagttcctttgggaggaagacagtggagaagtctttgtacttggtgatgtggtttttttcctcatggcttcacctagtggccccaagcatgacttctcccatgtcaatgagcacagccacattcccgagttgaggtgaccccacggtccagaatcatcctcattctggtgaacctggttctctttgtggtgggcatactgggtaggagaatcacccaaaggtcacccatgagctgcagaaaaaaaggctatttgcagaaggagctcacagatcacattgaaagcattgcatattcaaacatcttggtcttctttattggcatgcccacagggtcttctgacctctgattagatcagacactttttagatattgaatcatcagtttctgtacaactatctgaataaggtatataatcaatgaaatttagaatttttttctatgcttactcctgattggtaatttgtttgggtttagaattctatacaaggccatttgtaattttcctcagcactttaaaaatattaaaccatgttttcttaacatctgttgctgttgattatgtctgctcttggtgtaaatatcattcctttgtaggtaatctgtaattttttttcctctggtaatttttaaagcttcccctactactttcctatgtgttctgcagtttcacaacaatgactttcaatgtgtatttatttttacttaatctatttaataagatttaattagaaaggcagggctttcatcatttctggaaaaaatcccagctattttctctttaaatagtgtttctttaccattctcattctcttcttctgaaactgttgttattatctgttgaagcttcttgagttattttctaggtctcttaattttttttaaaacaataattgtctccgtatgttgcattttaggaaatttctcattactctttttaaattaactgttagtttttactaagcccggctagaatagtctatccactgaggtatgtattttgttttctatatttttcattcttaatgtttcttattgttccttttacatttttacttgtatatgtttcattcctgctttttttaattttctttcttctttctcttttctctctttttttttttcttcttgcagtgcagacagactttattagtacagcagaggtgcccacagagcaggcagaagggatcagtgcctggatctgtcccttcctccttctgccctcgctgagccctagtgtgtccggaattggtgggttcttggtctcactgacttcaagaatgaagccgcggaccctcacggtgagtgttacagttcttaaaggcagcgtgtccggagttcattccttctgatgttcggatgtgttcggagtttcttccttctggtgggtttgtggtctcgctggctcaggagtgaagctacagaccttcgcggtgagcattacagctcttaaggcggcccgtctggagttgttcgttcctcccggtgggttcatggtctcgctggcttcaggagttaagctgcaaactttcgcagtgagtgttacagctcatgaaggcagtgtagacctaaagagtgagcagcagcaaaatttattgaaaagagtgaaagaacaaaacttccaccctatggaaggggacccgggccagttgccactgctggctctggcagcctgcttttattttgttatctggccccacccacatcctgctgattggtccattttacagagagccgattggtccattttacagagagctgattggtgcgttttgacagggtgctgactggtgcgtttacaatccctgagctagacacaaaagttctcaacgtccccactagatcagctagatacagagtatcaacacaaaggttctccaagtcaccaccagagtagctagatacagagtgtcgattggtgcattcacaaaccctgagctagacacagggtgatgattggtgtgtttacaacccttgagctagatacagagttgccgattggtgtatttacaatcccttagctagacataaaggttccctaagtccctaccagactcagaagcccagctggcttcaccccgtggatcctgcaccggggctgcaggtggagctgcctgccagtcccgcgccatgctcccgcactcctcagcccttggatggtcaatgcgactgggagccttagagcagggggcggtgatcgttggggaggcttgggcatggtgggctgcaggtcccgagccctgccccatggggaggcagctaaggcctggtgagaagtcaagcacagcagctgctggcccaggtgctaagcccctcactgccccagggccggcggggctggctggccgctcccagtgcagggcctgctgagcccacgcccacccggaactcatgctggcccacaagcaccatgtgcagccccggttcccgcccatgcctctccctccacacctccctgcaagctgagggagccggctccgaccttcgccagcccagaaaggggctcccacagtgcagcagcgggctgaagggctcctcaagcacagccagagtgggtgccaaggctgaggaggtgctgagagcgagcaagggctgtgagggctgccagcacactgtcacctctcactaggaggctggggcctggcctggaccagtttctcttgttccacctgaaacacatgagaatggagagcttagggctggccttgcttctggctcctattgtcataactctaatgttatcacttcattgaaaagattagacctctccttccccagtccctaggcagggaaccccagccactggggagagacaactttgtggggcctgggcttaggtatatcctctagacacttccgaccccaccccacaccctttagttctctgaggctcaacgcactttctttatttcattgacaatttatcatagtttaatataacttattccattatttaccttcttgaagatcctactgagttattttagagtcttttttagagttgctctattattttaattttaactgcagtgatttcatgctgactttgtaggctggctttcctcatgtgattttccttatgaatttttgaaatttgtaggcttatcttgaatagcccatttttttctctctgcactcatctctccatatttaatagttctgtgtgttcttttgccagttcttccagagtccccagttctgagccaagatttactgagataatcttgaggctcatacatcatggtgatatcaggactatcacagattcagtcatgcatttgggggcagcttggctcagccactggtcataggctgtgccgaatcttctcagacccttaggcctgtagcttcctagaagccacagtcccagggagtgtttggcagtaggtctgtcttagtagctctgtcttagctgtcttccacaagacagaaagttcagagagagaagaaggaaaagaaactggttaggcagacagttaggaggggtccttggtaaaactccttcaaacagagaaatagcctgaaaaaatcaaagctacaggcacagatagagcagcctggggaaaaatttagctttagctgcagagataagggagcaaggcctaacaaagaagcctttgttctttggataatcagcgggctcccaggaaaaagtttcctccccttttcagacatgtacatgatgggctccatgggaacttgcacagggagaggggcttacctaaaacatacccacagtttcataaacaagagaagctgtactttgtgcttacctaagacatacctgcagctgcacaggtaaggagagttacacagacagctactacacagttaagggaagttacacaaacagctacagagatgaaaggagttttttcttataaaagcttttggattcaactgtaaaagtggcaaccctctttcagcctcctctttgctgcagagagctttcttctttcaattattaaacttttactccaacctcacccttgtgtccaggctccttaattttcttggtcatgagacaaagaactccaggtactacctcagacaacaagactgaaacattgtggtgcactggcaagactgcaacagttctacatcagcccgtggttttaagaagggagcctggttcctgttctgcctcaggtggggcacatttattccgtaccaaacctaaaagcaggctttgctttgcttccaagcattgatccaactaagctttggcttgttgtgcacaagtcatcatcttgtagttgtttccattcttataccatgaaaggattgatcttatttttgagcttggctatgcctttttattttcctttagagacgttctatgtatcattgctatttgctcagattggtaggaggtggccctcaagaaatgaacttacaatttggtattaaccccagggcccattagataactagaaacaatgttttgttttgttttacatttttaagttaaaactaaggatcaagttgtttttcagttatatagggccctttgacaggacttgatatggtttggatctgtgtccccacccaaatcccatgtcgaattgtaatccctaatgttggaggtagggcctgattggaggtgattggatcatgggggcggagttctcattaatggtttagcaccaatcccttggtgctgttcttgtgatagtgagtgagtaattgtgagatctggttgttttagaagtgtgtagcaaaggccgggcacagtgactcacacctgtaatgccagcactttaggaggctagggcgggcagatcacctgagatcaggagcttgagaccagcctggccaacatggtgaaaccccgtctctactaaagatacaaaaaattagctgggcgtggtggcacacgcctgtagtcccagctactatggaggctgaagcagggagaatcacttgaacccaggaggtggaggttgcattgagctgagatcgtgccattgcactccagcctgggcaacagagcgagactccatcccaaaaagaaaaagagaagtgtgtaccacctcccctgacccttgctccttccctggtcatgtaagacatgcatgctttcccttcacctcccaccatgtttgtaagtttcctgaggccttcccagaagcagaagaagctacatttcctgtacagcttccagaaccatgagccaattaaacatcttttatttataaattacccagtctcggctgggtgcggtgactcatgcctgtaattccagcactttgggaggccaacgcaggcagatcacaaggtcaggtgtatgagaccagcctggccaacatagtgaaaccccatctctactaaaaatacaaaaaattagccgggtgtggtggcgggcacctgtaatcacagctattcgagaggctgaggcaggagaactgcttgaacccaggaggcagaggttaaagtgatccaagattgtgccattacactccagcctgggcgacagagcgagactccatctcaaaaaacaaacaaacaaaaaattacccagtctcagttatttataccaatgcaagaacagacaaatacaggactcaggagaaaagaaaagagactgtagggtttcccacataggtctgcatcttatgatagtggtgaattgagagtcatacagatctgggatcaaatatttattttcctcataaaggtagaaacaaatggcttaatctcttcgagtcttaatttccttattttttgtgaagattaaagtgtatatgaagtatctaccagtgtttagctctgtaccttgatagatggtaacaacaacaataaaaaacctcagatgcttaagcaaaatggaaatttattgacatatgttactagatgctcagatatggggtgggtttgactaacctaaaccagtgcctccagtcaagattccttgttattttcttgaatctaccctcttcatttatctacttcttgtccatctcttcatatatttgcttgccaaactggtagtgacaaggtgcctgcaaccattctcgacctatctaaatatcacagtccagaagaaatgacacttatgccccccgtcctccaagcacctcccctgacccttgctcctgctgctccttgctgctgagagccattcttattcaactgtttagatcataagcgacctctgaattaatgacttatgattggagaattggatatgtcgattggcttaatccacaggccccattcttggagcctggcataggatcagcttcccctgagtgtcaaaagattgggagtggggaggcaggaggacttctgttaagaggatgatagagggttctgggtaggagtgtcaggatgtgtttaggtactcaagctgacttaaactgtagaaaaaaatgtattacctcatatgacaggcagtccaaaggtgtggctcactgaagcctacttgtaccagctcacaagagctaattactaaattcttaggaattttgaaagccagttgttaaatcgttgatagcttgatattgtcatactgggagtatttacactatagaaattgtcaaaggctacagatcaggaatctcccccgacccccacaaagacagttactggctactgggcagaagtcagtgttggtggctgattcagtgtctcaatgatactatcagggtcacaggattcttttctagttttccaatctgtagcttcaacattggcattcaattagagttatttgtttttgcatggtcatccaatggctttatcagtgaatcaacagcatgattctttatccgtattcaatagcaaagaaaaagagagaaaaacatgaaaaaattctcccctcagatatggatcatatacctggccttttagtatgattgagccaaatttagtcgtctgcctacctgtgtggtctgccatatactgattgactcaggcaactcaggagccacctctggagctgtggacaggatcagtttctcctaagctttatgagttatgggaaaaagtagatcagaatggaaatactactagaaaaacaaaagggtgaaatggatgctgaatagtttcctctgtagaaaagaacaaacaatatcaactacacatattctccatgtccctcacaagttgagtaggcacttatagagaaaatctagatcctagggcaaaaggaagttcattgttattggccttactgtttcagaacccccaaaacagacacatggacttttttatgaagtaaagagatcttcaagaatctttacaccttttaaatgacctcaactgagtctaggtcaagtcatggctgctggagaatgtttttgattggatttctttgaaagaagccttgaggcaaggtttgggtacaggtggttcatttaagacgtgattccaggaaacatggtgatgatgttgtaaagtaagacagggaataaggaaaagcccatagtgcaggccctgataactatgctattgctatagacaagtggggcccaattctactggggtccctctgaaaggctatgtaggacaaacctccacattgtaccaacaaggcacagggaagctgagtcttgacaccaactccagtctttcattggttgaggggtctttctagggcattaactccctaatatccctaatacttctggcctgtcttcttccctccagctttggtatcctgaggacagacacctttaagcagagagatggaggaggccatgtgtcacatttgttagcaggtgatctcttgatgatccagggtccaatagtgtctatggcaaacagcaggctgctgagatgtctaagtatagaaggactagggtatctcatgggataactcgttctgcatgaaaaaggtaatgggcatggtgaattttgtttattaagaacaccttagttggtgacattaattttcagtatagattggcgtctattgcttaaatctcttgcccatggatgaaagcaaagaaaaatcaataaagaaagttgaaagagctattttacaaagcttggaaaaacactggtctctcatccctgtgtcaaaatatagtgcagatttatccagacatccaatcttcctttcctttcctcgcttctcccctctcctccttaacacgtgcatattgtccaaaccaccatcttgctttggtataaggggaattccactcttgtgggtgtccaaaggccactcctgtggaattcttacccttatgccatctaaaccatgcacctctgatatgcactcacatataattgtcttctgtagatgtttaattatctcccctttgctaggccataagccatctgagggcagaaatcatgattagcacagagtaggtgttcagtcaacatttcttgaatgaatcagttaatgaaggaacattatgtatgcagtagtcatttgtgttctgtatgactggcatttgatggaaaagtcacagcgagtgttagggaagctgaacttttttttttttttaaacattgtatcattaatttatcacgtgtatccaagctcctttgagtttccctgcccccatccctgtgtcattccagccatatccagctactccttccatgcttcccccattcttgtttctgactctattactcccagtccaaatcttgctcttcactgtctgcaccttgtgctctcctctctctcaaaaaaatctacccaaattccacccctcttcacaggcccagggaaatcactagttcccgcaggaggctgtaggctgtaaccaactctctgaaagctttgagtcctctctgaggtcatctgtgcttgtcctcgttccatcaggcactcctatgttacttgacctgtggtctgcatgtacagatcttgtaccccatatacattgtaaggtccttgaaggcagaaaaggaagcataaagaagtgggtaggagtgtaagctctgaagactgtgcatttgaatccctgccattcctagatttgggaccttgtcaccttgggcaacttatttacctcctctgggccttagttttctcacttctagaagagggaaaatgatagtatctgccatgtagtgctgctctgaggattaaatgagatactccacttagagcccatggaatggtatctggcatgtgataagcactaaatatagctttcctataattacagtaatgcccagggctccacaggcccagcccagcaccagtacaggaatagtatgacattgatgctagagttggcagattgaggagaacacacaaagggctaatgatgttcaaatacacatcagatttc

SEQ ID NO: 1263 - DNA, 2551 bp, Homo sapiens
gcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaata

SEQ ID NO: 1264 - DNA, 1008 bp, Homo sapiens
atgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 1265 - DNA, 96599 bp, Mus musculus
  misc_feature (3201)..(3320): "n" at positions 3201 thru 3220 can be any base
  misc_feature (9284)..(9303): "n" at positions 9284 thru 9303 can be any base
  misc_feature (24284)..(24303): "n" at postions 24284 thru 24303 can be any base
  misc_feature (28552)..(29294): "n" at positions 28552 thru 29294 can be any base
  misc_feature (37287)..(37691): "n" at positions 37287 thru 37691 can be any base
  misc_feature (38785)..(38975): "n" at positions 38785 thru 38975 can be any base
  misc_feature (43542)..(43561): "n" at positons 43542 thru 43561 can be any base
  misc_feature (56238)..(56604): "n" at positions 56238 thru 56604 can be any base
  misc_feature (64207)..(64226): "n" at positions 64207 thru 64226 can be any base
  misc_feature (65794)..(65813): "n" at positions 65794 thru 65813 can be any base
  misc_feature (70927)..(71719): "n" at positions 70927 thru 71719 can be any base
  misc_feature (73054)..(73136): "n" at positions 73054 thru 73136 can be any base
  misc_feature (76927)..(77052): "n" at positions 76927 thru 77052 can be any base
cctgaaaagagtctttaattttccctctgaaatttcacaagccaggcttccatcttctgcactgttctcaacatcatcttccaacctcctacacaacatctgacagagcacttaacagggaatggatcttctagcccaaagttccaaagtccttccacagtcctcccccaaacatggtcaggttgtcacaggaataccccactatgctggtaccaatttgtcttagtcagggtttctattcctgcacaaacataacaagttggagaggaaagggtttattcagcttacacttccacattgctgttcatcaccaaggaagtcaggattggaactcaagcaggtcaggaagcagtagctgatgcagaagccatggagagatgttacttactggcttgcttcccctggcttgctcagcctgctctcttatagaacccaagactgccagcccagagatggtcccacccacaaggggcctttccccacttgatcactaattgagaaaatgccttacagttggatctcatgaaggcatttccccaactgaagctcctttctctgtgataactccagcctgtgtcaagttgacacaaaactagccagtacaatcatcttagggccaggagtgggatagaaggaggtgcacacagaaccacgcacatatgccaaagctgaaagccataccagcctggtctgtggctgcttagattcgcttgtcgcacgtcacaccactgaaagaagcatctcccaccccggagagtgactgtccagatctggattcatggtgggctttcagagctgtgccgagcagaaaggcacacagccctttgttttcaaagtgcgcccagtgggctggactccactgcctgtttgtttcctttccacaactatactgtctgagcagaagaacgccacgatggtcctcagagatggtggcttgggcatttttgcctgcctgcatgtctgagtaccatttatacacccatggagtttatgttacaactcataaaagtaccctggagtaaattcctgaaactatctgcaaaaagtatcccaaagtttacgctgatgaaaatgaaatctataatcaagtattccttttgaatagaaaaaaaaagggccttccactaaatatggaaatcatcaggctgcatagtaggtggtataaggaccaaacaggaaagttccagaaagaaagatataaataatgtattcaaatcgaaagtgtttgacatttcaaagtatctcctttgggttttatgcatggtgccaccgaggtgttcacactgtgtttgtataaaattttaattttctcttaccttcaatgtggaccatgcttaagttaacaataaacgaaagtatctacacaggaagaagcatttatgtgatcagaggtaaatgctgggagagataacagagtgagtggcaagagtcctccaggctctcagtctggaagaaatagccattataaggtcgtctcatggaagggtgccagcattggtcgtatgtcctgtgaagcacaaggccataattcaaccagcttcacatcactgagaagtcaagggaagacgtgacgacaaataaaatggagataagtagagaatatcctgtctaatgatgggtccattaagttggtgaccctgacatggctgggcacacagtgtgaatttaatcaggcccacccaccccatgtgtctccatcatcagtgcccatggcataggcttgggctgcttggtccaaacacttccttctctcttctatcgtatggtggcttgaacatggctggctgttttctttctcatctccaatgatctgaacttggagtgtgactggcagatggtaatagcaaccgttatcttctctccgtcctttccatcaacagactgtcttcccagcccagagcaggattaaacaggtaagaagtaaacctctttgttaagaagagggaagtctgacaggccgtggaggcaggcacccaaaaccccagaactctggaggtggaggcaggaagataaaaagttggagatgaacctcagctacatagtgaattcaaggccagtctggattgctctagacctaatttcaaaaccaaacatacagagaggagcttaaagtcaggatccttagtttgaagttcaaaaacaaacagacaacaacaacaacaacaacaacaacaacaacaacaacaagcatgactgactgtttagttgcaaagttccacacatgataaaaaaaaaaacttaaaattttaggaactattacaaaagaagttgttcgtggacaaaacaaacaaacacccccccccaaaccaaaccaaaccaaaaacctaaaagaatgttagaaatcaaactataaaacacatcccagaaccattatcatgacacaatctcaaaaaaaaaaatcattatttttttttcactcaaaaacctgagataagtagagtatgcctaaaatttgtgtgtcccccacctgccaccgtaaggtgttttgggtatgtgcctcaagagtcattaattagattcacattatttacttgtgaagaaggaaataagaggggaagttggacagaaattagtatttttgcttaagaagtaaacacactgaccggagttcagcatgtttctcagcaaatccctggaattatggattaagaggcaaggagggaacagtcacaaatgcctccagggggccagcaagttaagaaacctttgtgcttctctgatgtagaagaggcgatttggaaatttacagcatgatttttgaaaccgtacgtggattccataattcccactgctcataaagtccagactccttgatctagctctgcccacctcttaccacacgttatgtcctcccaactctttctgccaactctcagaagatgccaggtctccgactcatggggcattggtcccagcttgttcctctgttcaggttccttatccacactggtatgtgatgtcacggcttcctccctgtttacatgctgaaatctaacttccactacccagaatgtgaccttatatttacatacttatgtgtttgtttagagacagggccttactatgtagccctggctagcccagaaatctctatgtagaccaggctagcctcacattcagatctgcctgctggaatccaggcatgcaccatcccatcgagcctttaggtgggtgctgaggacttgaactctggtcctcgtnnnnnnnnnnnnnnnnnnnnaactctggtcctcgtatccccccagtaactactttaccaactgagccatgtctccagctctactttgctgagtttaggggttacacatctgaaatttctctccttaatccctaaaggagtcacagcagtcctttcggatgaacatcaagatacagctgtggagccgtcctcacttcgctgctaaggcagaagcttgggaaatgatgacaaaaaccaactcatgtcagggtttggaagtggcaagccttccctttggacaagaacactcatcacacagagggggttggggagaggggggtggtgagagagggaggaaagaagggagggggggagagagagagagagacagagagagagaggcagagagagagagacagagagagacagaggcagagacagagatacacagagacagagttggggggcagggacagacacagagacagagttaggggaagggagagctatagagctatcctggaaatcgtagagttatgtttcctttctatttatcagaatacttattactaagcattgggtaatctgttacccaaaactcatgattctcatgatgttgtaacaaactaagggttgtttctttttccagtgaaatagaagcaaggagcaaacactcaaaagtgtctccaatgtgtttccagattcacagaactccctttaaggcgtgcacatcaccgaagtcctgctgcctttgccagaatctgatctgtaacctcccgtagtctttactcactctgtacttcaccgggatgatctctgcagtgatctctctgcacggacttaaacttgtattgagcatgcggactttgccttgtattgagcatgtgctctggcaggcatggaaccctcactgtgcatcctcttatgtcctcccgcctgaattttagaaccacagaggagtgccccagtggctggcacaggagtggttccagtgacgggggtggggggtgcagaactgcaaccttagctggcagagggtctctggtttcatctcaagggtacttagactttggttaacaagctagacagtacaccttcttacaactgtgatgtgcaattctaaggcctgtgataatagctagaggccatgtccctgccattccggggatgctatattggaaatcgacatggtaattgactagactatttaaaaaaaaaaaaagtgttccagatgactgtggttttggttcctttggtccattgctatatagccagtgctaagtagcattttctggacgcccagcacgtatttgtgaattgagtaatgatgttattaaaagtatctcctttatcagtaagataaattagatgtccattttaaaaaggggttcactctgagtgtgtcttcagtttctctggtttgccaagatgtactcatagagagagttacacacaccctgcttaaatacctattgtcctaactctcctgaagagatccctatccacacacccagggagatcctgtaggacgcccattctgcagataaaatgaaaaatgcaatccctgagaatatattctaattttactataacgcaaatggtactcttctcacagactaccaaaaagactgtatttttctatattgattcattttccacagagatgtgtgtgtgtgcatgcgtatgagtatgtgtgtgtgcatgcgtatgagtatgtgtgtgtgcatcatcaaagagtcaagaaatattttgtgactatgtggatcagtaccatgtggatgttctgagtcatatttatatctctgatctacagtgacatttcatcaagggcgtaagaacacggtcctattcatcctacgttttatgagctcaagggcctggaaaattgcaaacagtacctatgtctaagggagccccaggggctcaaactagttgtgtgtgtgtttggtgagggggcggtgctgtgatgtttcccagattcctggctcctgatgacatgaccaatatgcgtttgtagggaaagatgttatgagtactttaagagtgtaatcccagaatttgtaaggccaagcgaggaggatcctgacttcaaggcagcctgggcttgagatggtctgtgttttcctagtgtgagtattgacctgaatttggaatatatatgaatctcactggcatctaggaagtgatatatgtcagtagctcagagtttattttgaaatcatcaccaaatatggatgcttctcaacttgtaaggtgcctgacccccataaacacatttaccagtggaagcactgtatcctaaaatgctattgacatacctagtttagagaaagagtgtagcaactgggacattgcagtgtgtgggttgtttcacagggtggccctgtggttgaatgggagatgaaaaggtctgccattgcccaacatggcaacaaagtattatactgcttagtgctagtccaggaaaagacccacattcagaatttgccgtatgctttctactgagtccttgttgcttttgtaccattgcataattggaaaattgtaagtaaatgattgttaagttcaggaccatctgtagtgatatctcaggctctgggcgtggatgagagcgcccaaagagaaaaaaaaaaaaaaacccaaacatataaaatgagaaaataagagggttggagacggggtgcctggaaacaccataatttaggaggctggcagcaaaagaagagccagccaagaagcggaacagaacgggacagaacgatgtcacagaagcccagcgggggatgggaagtgcagactgcaccaggaaaccatgagcagacaaggatgggaaatggcacattcgaaagattacgaatgggaagcacatagaaatatccataggtctatttctgaggataaaattgcgggactccacctccgtatgtgtgtgtgtgtgtgtgtgtgtatgtgtgtgtgtgtgtgtatacagttatgtacatggtggatgtaaataagacagattcctgtctttgcttactttaagaaaatactaccaattgagctacatcttcaaccttgtttctttttaaacaaggtttccctatgtagctcaggcttgccttgaactcagacttcctcagcctggcaaatgctgggattgcagatgcttgctactacgcccaacaactcttattttctttcaacttctctatgttttctgacttccatctaatgttacatttgtattaaaatgttcttaatgggatctggcctaatggttcaaccgttaagaggacgtacaactcttgcagaggacccaggttcaggttccagtacccaaatggaaactcacagccatccacagttcagttccaggagatctgcgtcttcttttgacctccaggcacacacagaatccacatgcctacaggcaaaacatgcatgcacacaaaataaaaataaaataacgtttttttcctttttttttttaaaggatttatttatttatttttacatatgtgactacactgtggctgtcttcagacataccagcagagggcagcagatcccactatagatggttgtgagccaccaggtggtttgctgggaattgaactcaggacctctagaagagcagccagggctcttaaccactgagccatctctccagcccctcaaccaaccttttaaaatgctattgaagtataaaacaaatgcgctgagaaagtctggactattccgtacgaactcagagataagagcaaggaattgtggattcaaaaatagttgaccctctatgtgctgggccccaggctaatgacaaataagggatgtgagaatgactgtgacattctgcaaattaaggaaaagactgttggtttgcaagggggtggggatataggcacttgagctggtaacacgtgaggctagctgatagtctgctaccacattaaactgatttcacgtgccttataaccaagatggcctctattctgtaagctccagatgagcttctgaggggcagagaggacacgagttgggcttgaagggaagaaaatgtctgcttgatttggataaccatgtgtctattgacgtggacaaacccaagggaggtgactgggcatggtgctcagggactgccatgatccatctcatctggagaccctggggggttgcatggacctgtaactaggctgtgattgattgtgactggatgtgtactgataggactggatggatggattgctagaccgtgtgggaaagaaggaatcaagaactgaaaaaaaaaattaacagtccaagaaaacttttttatgtgtggttaaagaccacacataagtagggcattgctctttctgaaacagtgagattggggtgcacttagagcgggcaggactgtttcctgatggagaatctagtgaagacacaaatgggaagccaatcgtcaggaaagcacggagacaggatgctccctgtgcctggcaatggggtttccaggactagcctctgttcacggatacagggccttaggatgcctcttagagatttgtggacatggtcctctctggctcccctgagttttcatctctgaggaagctcctatcatagatagcagggaagagacatcggttggccccaccagacctcattgtttctgtcgttccttcggcctgcacatgaaggatgctgaaccgagataagaagctcagaaagaaggcgtgtggatggggaccggaggggctatttatgtaggcctttcctctccctgttctagggaagagaagacaatgggttgcacaccgattaaaataaacagagatagcacaggcccataattccaggattcaagagccaaggcaggaacgttgttagttcccggacagcttggaaaacaattctggttcacctagacttcctaagatgatcctgtctagaaaaaaaacaaaaaacaaaacaaacaaacaaacaaaaaacccagacacacaaacaaacaagcaaaaataaaaaacagcaacagcaaagaaaacaacaacaaaaggggccgcagagatgggggaagggggcttgctgagcaagcaatggggagttgagttcaaatccccaagactcttgaaaagccaggtctggctctgtgcccacctcattccagtgctgtggctggcagagacatgaagattgctggagtggctggctaccagcctagttctaggttcagtgagaaaccctgtctccaatcaacaccgtggagaagggctgagcaggacactctggcctccgtgagtacacatgcacacatgcacacatgtaccacactcacccatacacacacaaagccagaaaataatgacctgtggttattaggcttttaacttaggtgcctggtgggtaaagacatacaactaccatgcagtgtgtatatccctgtggttactgatatatgaaatataaatgcaaggagtgtgcagtgttattatgggagaaataaaggacactgtgcaggaaggatctattttgaggccacaagacagggtccttaatctcactgctctccttctacaagggcatgcatactttcctttatccctgtctgtggaatccactaattctatggcaaagaggaggtagaattatttttcagatgtttacacatagatagtgacagtctcctagggtgggatgctttccccagtggttagagaaggcaggtggtgggctgaggaaactgtaagccaggcaagaagcaggtgtaactaaatgtaagggaatacttttaaagttaagtgaccaaacagcaagaggttccaagcgagctggcctagtagagcccataggccgctgcacctgtcataggtactgggccctcttcttgcattcagtattgtctccacggaacagcacagaggacagcagccaaggatgttcaaccaataaggacagccaaatttaggagttaacaggcagcgttccctccaggttcagtcccaatcaagacagtttaagttcatgtaactcaaacccttgcattttgcaggaactggaccggttatggcaaagacatgaagtaactttggagagtgactttctaggggaaggccttcctaaccatcctagcttccacactgannnnnnnnnnnnnnnnnnnncccagtaggagatccaataaagtaggggcacaagtaatgccgtcttttcagctgacttcgttccttacattcctttgcagcgggcgactttccaagatgagtttgtatatgcagcctgtgcacagcggttctgagcacttaagccacaggtcgggaagggtccccaggcttccggggctctctctggtccatctccacccttcaggtaggatgtagagtcaggtcatctccttccttccctacggccaccaccagctggtggccagctcccaagccagcgccccgtccaccacttctggtgccccacagtcccagcgtggccccggtgaaaagcgcgcgcccttcggcgcgatccccacgctcacacgcgctgccgcttgttgctccccgcagccgcgacgtggggaagtgaaaatgaaattgacttttccgagaaatgatgaaagccgtgccggccgccaatgaacagcggcggcgaacttccgcacctccaggctggcggctggagccctccctctgcctccacctccgggttgcacaagcttgaaacaaacactggggaggaagggcggggagggaggagggcggagggggagcgagggagggagcggggccgggagagggcgggggtgggggggatttccagcctcggctcctcgcagtttcctctccttgttttgctttcgatctggactgttctcaggcaagccggggactaacttttagttttgctcctgcgattattcaactgacgggctttcatttccattttacacaccctaacaacactcacaccttgcgggattgtattggtagcgtggaaaaaaaaaagcacattgagaggtaacatttttttttttcaaataatagttgtggctgtgcgtgtgttttctctcgagggcatgttgacggggacaggaggagctatgtatgtatgtgcgtcctgatgctttgacacgatgttttgcagacggaaaaatgccggggttcataaatattaataccgatttttggaggaagagtcggcgcagttatggatcatctgattttaggggaagcaggggtctgctgctgttgccgctggtactggggctgctgaggctgcaaagaggaggaggtagagagggaggaggaggaggttagtgaaggtttaatttcacttttggatttgcagatgagaagaggtggctccatggacacagatctgctctgtgtgattctgcgctccaggtgtcgtgtgttgtgggtacaggtccgttggagtccggcctcatttaaaataaaattggtgtgtgtgtgtgtgtgtgtgtgttgtatgtgtatgagtgtttacagacactgtcgccaccaggtccgaggaagggaaccgggttcttctcggtgcccagcggcccttctttcccggcggtctctggtgtaaatagactggcacccgcggtccctagatgcccgtgcccgggcagtgaccactgtaaacttgaaggctgccctaaggcggtcccaggatgcgctcgcccgcggggcttggggtcgggtgaccggcgtctggtgccagtggacactcgggccgggcgggctccgcgcgcggctgggcgcgggcctggccggcgcgcccggcttcctggggactgggccgccgccacacgccaggaacgtcgcgtcctcctccccgccggccagcgtctggcctggcctccgggctttgtcactgcacttgtcccagcgcgtgaggcgcctcggaggcgcgtccccggagggctccgcgctcaggggtcacccaccccggcgcggcctagctgcgagtgcctccgggtccccgcgggcgcccccggggccggcctggcgcgctgggccccgacccgccttggctacggaacgggcgaggtgtgggggcggggaacctccggggaccgagcggcgcccggcgggctagcatggggttgggggtgaggctgacgaacgcttggggtctccgggacgtggtgggaatgagtgcccgccctgtgccctccgacccgctccgggcgccgggtgacattcgcccgccggccgaacatggttggtgcagagcggcagccaccacttcctctccgccccgccggcccggctctctgggcgagcgatgcgggccgcggccaatcgcggtgcccagctagtccctgtcgctcggccttgggggccggctcccctgagcggcccgggaagccttcgcgagagctcagggccccggctccccggacgctgtccgctgggccccggctctcggaccgtttgccaccctcagtccctcgccccttaggagcagggaagggaaggaggctagtagcctccgccgcgagccaggactgtgctcgggccccaggtgagacgcccggatcagtcggtggaggcgagatccttggtggtcggatgtaaataagacccctgggattggcaggccaccttgtcactcgtttgcgagcgggtttgcaggtccttaagcccagtgtgtttgaaacttgggggacatgtttcttgtcccctcctccctcccgcgtgggcactccttgtccttccttggttgtgtctgtaccagggaggcaaagtagtcctggggttagctttctgccactcgcctccctgtggctgggactccgggctgctcttgatgaatggctcctgagggtggaggacagttacatttcctgttgtgcattttcaggaatcacgggagcttgggagcttgttgtcatgcctgaagtcatttattagttttgtttgttggttgtttttgtttttgtttttgtttttttttatatcgactgactgcaagtaacatttgaagttagcagcctgcacttaaggtgcttaagggcaggtgcagggacccgtttgtttagcctactgtttttagaaggtggttgattgcatggtagacagatgcacactgcttggttagggcagagccctagaggttgccctgtttaacttaatcactcgcccaagtgcaggagtctctgatttttctcaactctcattcttttttggggggtggggtggcgtgtgtcacaaaaatagaaaccaataaaagcttggcatttggcttttctaaggcagcttcaagcaaatggaatatttcaggcttgagttggcatctctaaggggtaacgttggagcatctattgattgatggggcaaagtccggaacgtcactgtgattggtgaatgattataatttatagcctagcttgttgcgtaagaagttagattttgtcttgtgcttagatccaagagatcttgcctgttatgatttgttactgcttcttaaaattaaacacttacatatttcattctcaatgagtggtcttttttcccccccttgacctgcaaaagttaggaagagttgcacgtgtttcagaatgacttaacctgtaaaaatggcatcttcatgaaacaaaaaaagaggacttgtaatcaaattggaagcaaattgaggcaaaagagaaattgacatgaagtcctgaaggctctaggaactatgggctcctgaaatactttattaagtaaatatttaatataccagagcgagtgaaagctgtttaaatctaagagtggaagacttgaaactttggatagtcccttgacgcacattgatttcctcacatatccaagtgcaccactcttttaatctcagctttattcggtaaaatctggatcctcttttccagctttccccccaccccacccccttttttaatggcaaatagactactgaactacaccgggaattttattgcagatcccttatctgcctcctgccaaacaggccttagcgcaatctggagaacttatttatatatttgacaaatatttgtgggccatgaactaccagacacagtggcaggctctgtgaacccaactagaaccgtgaaggacagatagcctcttcaagttctacagaagttgcattctagctgtgagctgacaacaaccaaaaataaatccagtaattacctctgggggttggtctaagaaagggaatagtgtattctacttaccgggctgctttgggggaacaattgtgatactgtgtgtggaagaacattgtgtaaattatagtaacccacaaatgtgtcatgtattgactttctaagttctgttagattactgttaaagcgaatattagagaggtgagtgtcccggtacatactttttatcccattgaggctgaggcaggaggattgtgagttcaagtttagatacaggctgagagcttgtctttaaaataaaagtgaggaatcacaacaggacaggacagtgcctctgagggtacacaaatcatggcaaagaattacacatttggataactattatatgtaaagtatcaaaaatgtttagcagtgaaatattatgtgaatttttttctcttttttttggcctgctaggagaacagttgactggtatccatgaagaccaaatgatgtggggataactgacttggatgcatgtttttccaatttatttatacattaaattctttattgtaatgaacttacccataaagacatcataaaggtagagagaggcggccattcagacaaacacttgcccaatccccgtctctgtgatttctctgaacctctctgtggttggaaagggcccctctgaagtccacaaacatcacctggggggcttgcatttcgttaatcgttacatagttacacctaccactaacattaaaacctagaaaaacattagctttatgttctccttcatgcctcatggttccctttgcagtctgtctttccccatcacctaatagtactctttcttggtctcttttctaaatagcataggacacccacacttatagctgtgtacataggggtgtgtgtgtattataggctaggacctgagtatgagggacaatatgtttcccctttttataatgcaacacacaggtgtcactattctttggtctgaattttcttcaccgtcgtgtcagactcattaagttattgctgttatgggtatggcttagttctattctgcagtccattgcgctgtcattaaagggacttagttctattctgcagtccattgcgctgtcattaaagggacttagttctattctgcagtccattgcgctgtcattaaagggacttggttgacttggattcactgacgagtgcgcaacactatgtgagtaaaataatacgacattataagcgagaatgaacatcaatagtatagatttgtaatatatgatatgtgaacaaatacattgctgtgaagtaacaggaagtattaacagtaaagccaatgctattcatatgtatggcactccatactccttcctggacagggggagaggtgagcaggactttctacctctgtctgccctactcctgtactgctctttggtttgcatggattaatatttagttaagaatatcagcttaatgtataatggggctgagttgagtgggggtgttagccagtggagattgtagctaaggaggtttgatcaagctttgacttagccccaaaggaataataaattatgtataggtaccagatttaaacatgaagccattattttcaaataaaatgccaaggaaaacaatgacccagaaaaatgcaagccccaggcagctaccacccaaactgtggccatgtggtgaagatttcccaggctctgtgtgaattcagagcgagcagtaggcctatgatggctagcccttgactgtcaggtagccctttaagttgattttacaccttacaggattcatcttaggacagtccctgagacaaactgttcacgtaggaagccttcatgtgatttcttttcagtacttggatacctgtggcttccagtcagaactcctggtcaacttgtaaaaaaatgtgattcgggggctggcgagatggctcagtgagtaagagcactgactgctcttctgaaggtcctgagttcaaatcccagcaaccacatggtggctcacaaccatctgtaataggatctgatgccctcttctggtgtgtctgaagacagctacagtatacttatgtataataataaataaatcctttaaaaaaaatgtgattcgcatcaaatctagtaaaatctagtaagccttattctacccaaacagagggaaacccatgtgttggcgctctgggaaggtcctgacatactgggaccagctgaggccttccctcagaacttcgagttcctctggggacccaggaatcctataccattacttgaagtgaataatagttaaatgtcgtgatccacaaacatattcatttatcaaggatttgtagacaactagccatgtacagggttttgtatagagaaaggtgaatgggctcagaagcctagaattcactacatccatgcacaaaacacacacacacaaaacacacacacacacacacacacacacacacacacacacacacacacacacacacacacttgcacccacaagcacacatgtatatgccctgaattgaacccatagcctggagtgtgctaagcaagtgctctaccattcagctataccccgaaccttggcattgacttttatctctattattcattctttactaacttccccctttggaaccttaattccacaaactgtggtttgatagttctgcaatcctcaggggaccaggctagtacatttgcttattattaaatgaccaagggaaaggaacatttagaaaccattcaggattctttagattggagactggctccagtccatagcatttatagtatattacagaatatagtatagtatagtatagtatagtatagtatattacagtatagtatattacagtatatcatctatctcttcctctctcactcagtatgagcctcttgtcccctatggtgtgccgggcccatcattccagtcttcctccattgtgaggccagggcaaaagtacggaaccactcagtgttcaagggtctcttcccaggactaatatggataaccgtggatggttaagtcttggccttggcttagaggctatgccaagcaaacagcaagcaaaagctgcttgcttttacactgtccatacagctttgaataggactcacctgttttggggttgtccttattggcctgagccctcacagcccagatgatattcacatcatggctctcgtactctgacttttccatttccaggaagaccgcgctgcatggtgcagccttcgtgtgcaggaaggccgtagagagtgcgggagggttatttttcctgacttgttttgtttctgttctggtttgtatttccttccatcagctctaataagccagaaagaactagagttgaacaaatagatgtgtggggacccataagctcttggggatgcttccttaagtgttttgttttaattctgagagaacaaccaatgtagtcgaacatagatcttaatttaagattttgtgtgataaaagtctgtccagttttcattaaacgattttcttttttttgaataataaaatacctcccatgttactttcttaaattgatttattttcaaatgtacttatcaatatactgctatctttgtaccagctttggatgaaccttcactttaacttgctcttggtgagcctatgggtcaatccaaagagatagaggatgctcttttggcctgtgagcttcacatctctgactcattccacatcttgtttggttgatactttgaacgagaaggcactgaatccaaatggccttatttcagccgatatcagctatgcgttttgatattgttttccctaccctagatttactggagacgagaaaagctatgggaagagagtgtcctgatacctaaggagggtgttggtagggcggtgggtagaaaagtggccaagggggaattggagagagaataacgagaaagctagatggtgggttcttggtactggaagagagggaaggggcagttaggcaggcagagactctgttactgccacagctggcatggatggttaatattgatttttatttcatgtgtacgagtgttttgcctgaatgtatgtctgtgtaccatttgcagacctggttcttttagaggccaggcaagggtggcagattccctggagctggagttacagatggccgtgcgtctctgtgtggattctgcgaacagaacctggtgactctggaaagcatcaagcactcttaaccactgagccatctcttcagctccaagtttgaaaaaaacatttttttttaacattttaagcgttatatgccactaagttaaattccaggaaattccttacattacaaatcttcagctacaggatggagttaaggaaggaaaggggaacaagtacttagtcaagggtcaattgagatgctgaagagtttctgccgttgcctttggggttaaaccttttaaccccgtggaagatggattgtgacaggaaactgcagggcaggagcttacaggggacttgctggacttacaggagactgtcacctgggcatggttggggtcaccttgaaggtattgatgttgaagtattgggaactgaaggactgagacccacactctaagccccccaatctttctctaaaaaataacccaaaacaaaacaaaacacccccaaacctccccacaggcaatacaatgaatcaaagacactatggcagctctcataggcccgcctcctctcacccatgcttttctttgattggatgttactcttgtcagatcacaaatggtataaaggaaagcaggaaatatagaatgggcagtagtgtgttctcttcaagaataggtgatggttgaactgtgagcactgtgaccacaggtcacccactgttgggaaactgtggggaccataatgtagctgaggctttacacagaggaattttctggaattcaacttggcggtatatgcttacagtgttaaatgctgaatttaacatgcttgaacatttaacatgctacagtggtgcatgcttgccaccctaacacaccagggagactgaagcaggaggattgttacaaagttgaggttgtcttggggttacacagtgagtgtgaggctaatttggatacacagtgagactttgtttcaaaacaaacctcaaccaaacaagagttaaactttctgttctagtaatggtgcttctaggaacctacttcctggaggtgactggaggctagaacaaaggtttatgtattagggtgtttatagaatcagcttttactatataggtcttgaaatatctaacaagaaaagcatatgtaaattatgtcatagctgaaagataggtagtctttaaaattcataattttgaatggcatttaaagaggagaaatatttaacccatgctagttggctgggagaaaaggatattagattgtatgccacacaattttaaaaaaccgtatgtattttgttgatgtaatgctaaaacatggtgaaagaaaagagtttgatggtaggattatatttgatttttttaggcaccccttgagacaccgcacttttctaaatttgaatcaaatttggatcatagtcactgtcatacctaacgaagagttctcaaggcaatactcaggtgtccccactggttccctctagcaaatggggacaagaaaaaggaaattggcccgggcagtggcgcacatctttaatcccagcactctggaggctgagtcaggcagatctttgtgggctcaaggctagcttggtctacagagcgaattccaggacagctggggatataagaagaagccttgcctcaaaccaaactcccacaataaacaaacaaacaaacaaaaggagattgaacgttgctgaggatgctacctgtagactaagcttttcttctgctcactgtgctcccttgtgcagattccaggtctagaactgtggcctcttctagccaaggctgaaagacaccattgcctcactatgctaagaactagtaatggtctaagatgttaccccatttgacagttctgccttttatgattgtaaatacgacagaaatgcacgacatctgagcaggagacaagagctactgatatttgcaagcaagcaaacaagaggatcatgcagtgatggtccacgcacctagatcctggtgggtcatggttggggcatttcactgtgtggcggaactgtccctctccccttcctataggatcagggttcttctgacatacacaaccattaacatcttctgtggactgttccctatcctgtctgcagtagaaatgcttgggtagatagggctcttcttagctttagcaacctgggacaataatcaagcaagggatttggactgggtggtattgtttgaccctgttgaggagacgagtttttttttttcctatcagataagagcagttaatttagacaaatggccacagatctaattctcagggtgtatgcaaagtaagaggcctggcgaagcatcccttcccctttgcatcctataccttccccgttgacttcatgtcctttgtcccaggagggcagatattccccccatacccactttgcagatctcttcatagacaatcacttaggaagccgcagtcacactgtgatgtctgattttttgcagtggaagacgactctacgtgcctatttttttttaatctaatgaactattagaacagtttcactcctattatgaatacaaacttattttatcattgtgataaaactaaggttgggtgtatcaactactagcccagaggcagaaggatgaaaccagagagaggcaggattaatgaagaggacagtctccagtacaaaatacagcatgagccacttgcttatttcttattttcttttagtatctatattagaaaagtaaaaggaagaggtgacattaataatgaacgttgtttaacccattacttcccagatattattatttcaatataatcagtgcaaaaacaacgttattttgcattcccctttaaagcccagtatgttgctttttaagctgcagcttgtcttaattcaacctatctacattctgcgggctcagcagatacaggtgctagcagctaaccattagatggtccagcagatgggagatgcacagcggggagctggcgagatgctcggttgctatagtacctgttgcacaagcctgaggaccagaggctgatccccaggacccatgtaaaagccaggcctggtaatccacatttgtaatcccagcactcaggaggtggagacaggaggatgcctgtcagtgacaagccttttatcaaaacaaaggtagtctgtacctaaggagagatattgtagttatcccctgataccctaatacatacacaacacacacacacacacacacacacacacacacacacacacacacaaagagagagagagagaaacagagacagagacagagcgagggagcgcataagtgccctggggacagttttaatacaaggaatggagtttaaaaagaccgaagggaggcaggtgaagtcttttgttttcgtcagaacctcatggctctcctttgccctctcatcataagctttacttgatttttttttccccagccaaaatcaataaatatcccgagtgcccacaaaagcagcgcatagcacgtactgttcccatggccacgagctgtgtgtacacctgagtgtctgtgggcctctcggtgtgctgtgaaaggctctggttatttggacttttttttttatttccctctcctctgtgatatgttatttgagagtgtcacgtgtttctttgcattcctcaaggacacttgatacgcagtaagaactagataaatatttgttgctctgattttctgtttaaggcaaaagttagctcagaaagctgagctccaacttggaagggatggtacaggtctgctttgtgttagaaacctattggtacatgtatcttgcgcataggcatggagtctcgtcacttagcaaggagacttgtcactatgcagacgaggtgcaacactcagaaggtgaaaaattgttcagcttttccctttcataccaagacatttgaaagagcctgatatttcattcccaacagtgatatttacacctttttatgaatataaatctagttggtgataaactggagacaagcttccgagaattactgttttctgtatggattaaagtagtgatgcctttgttaatgctaccaacacagactcccagcccttaacctgtgcagtggaactcctctgaaatcaaatgcagtgttttatagctgcctccatttgttccccttgactttaattgtcgggctgaagcaccaggcctgttcacagagctaaggcaatttatttttactgaagccaacctaagaaatgcttaggtagcttgtcgctgcaagattaaatgtgaccttcatggaatcgtgttagcagggccagcagctagaaaaataaagactaaaccaaactgttcagcaacagaattcccagctgttcagtggggtagaactttcctggttatcccttccaataaaaacacagcaggttagttttaagtgaagtctagatggtttagggatttgcaaccgacagaagaacagaaaaatataatctcgttttaaaatgataatctggaaggctagtctatataatgagtctttcttggggggaggggcttggtgttttcctcatatgggagaatttaactctcatgcatagttggtctcacctttcaagttaaggacttcttaataaggaaagaaaagctgtaatggagaagtcaggcttgaggctgttgtcgcaacagcaggcgtctagggatgtggggcacattggtacctggcgccatatttgacactcccctttcttctctccactatagaaggaaggcagacgcttgaaaacccataagggaggcccaaggggactgtagatggactggttcttaccatgagatatgtcgcactgatggtgcgtgcattcagagtcattagaaaacataggagagaaattgctagggacagggggctttagggtatccaaaatattgattactgattgattgtatatttcttgagtagcagtacagctacagtttggtaggtgagatcaaggaaggtactcggcacaaaggattgactgttttgatcatgtcttgggtcatttacttgggggttatgtggtgaaaactgaagagggggcaggttttcttagctaggtattctccacaccaaggagcctcggttatttacagcgggatcaaacagctaggcaactaaagaaagagaatggttttagcagccactagaggttgtctgtgagtccaagggccagttcacagttctctcatcttgtctgtttggatgttactggtgtttgcccgtgacacttcacatatgtacctgcagcctatagagctcctgttgggggcctgattccattgagggaaactgatgtgactcaggcagatggctgtctccacttgatacttccctttccccagatgcagtcactggtcctgaataagtgctgccccactctctccctggaggcttgggctgagagaacctgcatcatggagtgatttgtagggctttcttctcacctggcctgagaggacatcaccatgaaggaaaaattggctttcagttaatagaaaaaatgtctactctctccccctcccccttctccccatccctctcccactctctcccctcccactccccctctccctctctcctctcccctctttccttttctcttcttctctccctctctctttctctttctctgtgtatgtctatagtgaatacttcaagtcacatgtgttaaaaatagttactattcatcagaaagactgaagaaaacagaggcaaagagtggcaaacttataaataaatgcactccttgtctctcgctctttcttttctgttgcaaattttaagtcatagaatttgcctttccagtcatctttaagtggagccctcaccacttaaccatttcctgaattaaaaaaaaagtctcaccagaaactcgattcatatttaaaagtcacttcgtttttctcggtccctggaaaccaccgttctcccttctcagggagcatggctctcggtgtcagtagaagcatctcacgtttgccattctgtctgacacatgtcacccggtggcatgttttctttggtcagccttgctatggcatgtgtcagaatctagctccactttcgaatgaaagatgttcacgcgtattttgttaatccgttcatctgtcggtggacactggggctgctattatctttgggctctcatgagcaatgcagctttgaatactgctgtaaaaaaaatatatcgatttgaggtattttttcctgggctcctctccatttctctgctccactaagcccctgtgggtatctctctactaagatgcttgctcctcttcctgtgttagagcctttcaaaaggctctcccaggccacctcttcagctggttcctcctgtacctgctctaactacttatcccccatcacctactgggtaagctgcatgtgaaaagggggtgcctctcctctaccatttgggacatgtctctccctcaagtctctcagtctgcttggggaaggcccagattgaacttcttgtcattacaacttttaccccctctgctacttccaggagccttctttacccccacccccgtcacggagctatggagctgaggggctgtggtcccacatcttccttaagcccttctgggcctctgtgatattggagtcctccctcggatggagctcctgtcttgaccctgtcccttgcgtctctcagctccctcctcccgctgcttctgtgtgccctcctgggcctgtagctttcttacaacctcccaggccctgtatggccatttatcttttcctccttggacccagagattttgttaaaacctccctatcttaccccaaatggcctagcctcagtacagtacagttcaatcaatgagcaaaaattannnnnnnnnnnnnnnnnnnngactgtcctgtaaactgtcttaagatttgtaagttcattgcacatgatttaaaaatctgtaacaaaatttagctgaagatttataacaaagggtttaaaagtctatgcaaaaggaatcttaatttgctctaacttactctgtctgagattcaacttttaggatatatcttaggatatattgcatataaaacttggattcaactcttgtttaaaaaatagatctactaggaaaatagatgtttttaaatagcaaccatgtggctcacctccatcttggtcgatgacctcatcgggagggaagctaccatgtgcctggcaggaatctttactaaatttaagagagtgtgtgcaatgtaactttaccaccgccaccattaagatgaccgtgtggtataacccaactaaggcaacactcataaaacttcactgccctaatgagatttctgcttatcactgaatctccttcagactaaggaggcaccggcaggtctccaaaaaaaaaaaaaaaaaatcttggaatgggatggatttctgtattatgataaatccccaaggttataaagattttcttagagatatgtgcctagccattcatgcttttaatcactattctataccaggattctataaaactttagataaggaaaagaggttttgttgaataaagtatgctttattctaaggttataaaggtatattcatgttagcagaaactgacttagaggtgtctgttgatctacaccagacttctaaaacatgtaggtaaagaacaatccatgtttgataaataaggtttatgaattctgaaagtctactcggagtaatggtaattgtcttaaaggtctatgtctagcctctgtctttgctaactctgttaagctttagatatttggataaactgaattataccagaaactatggtactttgtaatggtgtgctatgaaagagtcaagtaaagtaaggtgtgcagtctctttgtgaactttatttttggtctaagaaagctcccagtttccctgtgaactgaagtcatggacttattttgatgctaaaggatcttcaattaaatcttcaactcaaattttaaggctcagacttaacagggataaagctttaaagtactaattttataaaagcgactaacttgttgtaaaagcttaaagataattaagatatgcaagtcggtgctcaccttataaatgttccagttgacattcacacctgcagtcatgctgagtccaaatggcattcatttacagtcacaagctttctttagcttcttctttaggtttgcaaggctaagcctaaaacaagtaactaaagatgaagtttgtttaaaatcagctagacttaatagataacagtcttcaaactcttcagagatctcccgaaaatggcatttcaaatgtttaatgtaaaaaacttcccatgattgatagacagaaaggccagcgcttagtgtcagttctagggtctccaaagatgatggggtgcagtcaactctacttgggttgtggtcacatcagccactgcttcatgtctcacccgctgccagggtcctgcccaacctgtggaccctgttgcgttgactgctctgttttgcctcatcaatataggtcactgttttcaagttccttttccacaggaaaatctctgaccttctgggtttggcagcagcaggcctgtgctgtcctgtgtggcagctgtagaccaacccctgccaccctcctccaccctcaaccccagaaaaaacaaaaaaagcaaaacaaaaaccaaacaaaccaaaaaaccaaaaccaaaaccaaaaccatctgggaggctagggtagctagctggtaagtctctgtcattttaattgatacatagatcatttggattatacttcctgctacagtttatccgtctcagatctctgatggtgttgacggctcactagctacatcagtttaacagcatcaaagcaagacaactcctcccactaaggctgctgcagttgcccggactgttcatttcatattacctcaggtctcactttcctagagggtctaggtctcctgctgaaaaagacaggcaccgagacagtttaccttgctggaagccttcccacagataaaggtaaactcacaaagcaggtttcaatgtaacgttttactgtttctttatttaaaaaggcacttgctttgccatggctgctcctggtaatcaatcgccggtgcctcatggtaaatcaaagtcttattggtgttactcaccacagtattcactcgcaggggcatggggtattcaaaggcaggcactgaagtcccatcctagcctgggaatgactcttgggagtggaacctcggagttcccagcatctatactgcagtaccatactgtaccctatcctatagctggtgtactccaggcagaattccctcagctgtccttactgttgtagggaggaaggggtcttgtgaatccgttacatttccgggacttcctgagacccgggagttgtttaatatccccagtcttttggagcgtctccatagagcaggatgtttcacttcagatgtgctctttatacagtaggcccagcatctgcatgctgtctcagagggaagtccgtgagctcagccttaggacggtcctctttgtaatggttcagtactatactatgtggacagaaaaaatgtattgctgtaataacagatctcttaagtaaatcgagacaattgaatgtttgtcatgaatcatcaataggccgtggaacctcttgtttctgagacagggttttaggatgaagttgagatccatctcaaagttgtgatcttactgcctcggcctccttgtccaagtgtgtgctgccgagcacagccccggaatgagggacatcttactgattcttacaagagctatagtggatgaagacgtgtcacagtaaattcattgttagttgagatttatgctcaaatttttacttcattctttttggaaaattgactttattcaacgacacagcctggcaagttaatgcagatgatttacagtggactgtaaatatgggaacgatgcataagattgcatctaatacaaggtggggtagtagaagtctcagaacttctgattactccatccccccccttttaaggacattaatttatttttattcatgagcctgcatgtatgtctctgtgtactaagtgcattgcatgcccatgcaggtcagagtgggcatcagatctccaggaagtggagttatagatggttgtgggctacagtgtgggcgctaggaaccaaactagggccctctgcaaaagcagccggtgctctgaatagctatttcttcagccctggggaaaaaacctctccctcgccccccaagatcccctaaaattaactgtaagtactgtgcaaatgaacatgacagggaagaaattaagctgaagatggctctgcaaacaagtttaaagaaaactctctctctggagttaattccttcagcagatgcttgcgagcagctgtgtgtgaaacactgtactgggaagatgtaaaactgaaaaatcccaagcggtgctctccaagatcttatcgtttagtgatggaggaagcaggcgacataactgtctgcggtgacaaagaaaagaatgaagacgtatgagcatcagagaagcataacaagtatgaaactactcaaataaagaaaatatctaataaaataaaataaaaatcaataaaaagaagagaaactactcacgggacgagggaggaggtgacaccatggagtgggctttattcacagcttctggaaggagagagagagacagtgtcaggcaattgtggttggaagaacagaagagaaaaggaagacagggaaggctgtaaattcctcatgaagctggagcctggagagctgtcccgagtagctgagcagatgagtcggcaggggctatcacagtctctacctgacagcacatacgtgtgagtgatgccatgccagcacatacatgtgagtgatgccatgccagcacatatgtgtgagtgatgccatgccagcacatacgtgtgagtgatgccatgccagcacatatgtgagtgatgccatgccagcacatacgtgagagtgatgccatgctagcaatacatgtgccagcacatatgtgtgagtggtgctatgtcagcacgtatgtatgccagcacatatgtgtgagtgatgccatgccagcacatacttgagaatgatggtatgctttccacttccccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgtttgttcataggccatggacttgacaggcagtgaaagaggactagatcctggccgtgttaataacaaggctcatcctttagactgactccccctcccttcttcctttcttccctccccctcttcctccttcccataatgttggggataaaaccccagaggttctgtatatgcatggcaagtacctttcctgaagaacaccttagcttgactgctttgtttgtttctaaggggggagtaatacaaagatggagaatatttcttgtgctctctttggttttgaatggattcattatgaagtgaagtgattctgagtcggtttataatactccacgtgaagaacaggttagggtagtctctcaagtttgagtaagattaaggagggtgaagaacggcagtgaaggccttagcagggtgggacatgtgtagggatggggctttcttcacttgggggagtcacttggcctttcctcctagcagttgctctgcctcctccccaagactacaccatgctaggccatagaatggcaggcagcacacctcaggtggaagactggaggcagctccttgtgttggctgttgtgtggttgagacttcttcctgtgcactactgctgtgttcccttggctgtggtggtcagagcacccagcttgatgggctgcaacgagggcatttatcaggtatttgctgaactcttcgcggtagccataagatgtgaagatccaacttagagaccttacctgtttccggggcttatttcaatttatttcatgcagcactgaattataaataactgccttttgaaaccagttatgcattctggagggcagtgaagtgcttttcacagggcagagtgaagtggcttgcctagacacattccataaacgtgggtcgagtttaaccgtatggttgatctgtctttctcattacctgtccattataggtagggataatagaggccatgtcctgtgcttcctggaaagagacagagcagacagtggctaggacagcatgacagtcacgtctgtacatgctctggcagagttggcagtctccttcacccagctcacaaggacccctagaaggcacaaggatcacatgctctcttgagtagccacgcccacccaaggcttgcagccatttccccaacatctgtctgttgcccagtggcaatacatctcttattaaggatggttcaaatgcacccgtatggctccttactcttgtctttctcccttcttatctttttttctggattatttttttttcttttccacccaaggatcatctatttttcaggcttagttcaaatgactcctcttctttgaaatcttcttggggaccttcatttcttctgagctttgatgtaagaaggtagagctctctcaacccagttaccaggccatccacctatggacaacacagggtggcagtcttgggagatgcctgtgcaatgttgggggtgagtgtgacatggaggttgaactggactgttgtgttggatgcccacattgggaatgcgatatagcaggagaggtctcagtgctactccagcatccccagtaggcttctctagtagtgcctttagcacatcatgacttgtctttgcttagctctttcactgtacctcctttgggcaccacgtctgagccatcttggggtctttgctcttcctcatgcttgaacttactcttcatggtgcatgagtcaatgaaggttgttttgttgttgttgttgtttttaaatgaaatgggttccctgggtaaggtgggaatagtagattggttcactttttagcctttatagttttttttcaatcgtttttttccttatcacccatccgtggtaaacttatcacagcacagagttaatatgttcatgcgccttcccctccctgctccatctgttctccaaaagggattcatctacttccttattgattactaattaatagatatcgttatacacagcgtgttagggaagacacttgccactaaggactttgcacagtgataagcgtgccttcaagtccatggtgtgggtgttggtgttgttaggtgggaggggtcagaggaagaaagggttgggaaggtggaatggaggtggattacagtggccggggtgagactcttagtccacattgtggaactagtcaaatgtcctgaccaaggaggtgttggggacatctatctggccatccctgttcagggcaggggatagacttctgttccacgtatgcctccgggctctctgtggggagtctgcatttgtcttctctcattaggtagagctcaccctgtcctttgatgtctctttggagaaggagatcaatgcagtctcagaggagttctgcaggattcgattgagattttggttgatgggtgaggacggtagacatgcttacaggctctacgtgggcaacattcaaatctaggtgtgcttgacacccaacctgagctatttctaccgtgttaggttttagtaaggtaaaagaaggaaagtgctgtgggtttaaagaccgttgaagctttacttacttatcgtgggcacgctccacactgcatgtgcagaggtcaaaggacagcttgcgagagccaaatctctccttccgctatctgggtttcagggactgacctggggtcgtcaggcttggcaccacaaagtgccttccaccgaggcatcttgctggcctcattgaggttttgaaaggagtttgcttcagaggagaatttggcaactatgcagtgcacaccagtttcaacttttggcaactgtctggaaattgagaggcagtgagtatcgtttaaaagtatgctaaggcactcctcctgctaacagggagagacgtggccctttgtcaagagagattcttgtacctagaagagggagccatgttacttctttgctgttggatttcattggtgataatgatggtttctctcaagaatagactcaaagctctgaaaactcagtgcctaagtttatagttcacatttgtatcttggaaccaagctttatctgaatgtaaggcactgtgttagagatgatggtgatgacgatgatgacgacgatgatgatgatgacgatgatgatgatgatgaaattaacaacactaagcgggtgccctttattgagtgattactaggacaactggattttggcaagaaggaggtggtcatgaacttgggtgcaaattgaagaagggtatcatttattctcacagagagggcagtgcagcagcctttcctacagcaggtgtttttctgtgtctgagaagccatttgttttcactgcattctgtgagcaataggcatgaaacaagagcagtgaacaaattgaagctttttgcaaagttttggtaggtttcaatggctgctctaagtatcctgttccttggcttttctcaccaatgtactgaacatattagtgtcgaagattgctcccctcaaaatataccctcctccctctttatttctttctaatgtgggcaggtgtttggcctgcctgcatgtctctgcaccacatgcaagcctagtgccagagaaggttagaagggtgtgttgcatcctctggcactggaattacaagtggtggtgagtagccaagtgggttctgggaattgaacctgggccctttgcaagagcagacagtgctcttaacagctgagccatctctctagcccctgttagtcttgttttatctttatgatcccaggaactgaacccaaggcctcacggatgctaagcaattgttctacactgagctatagctggatccctgaacagaccttttttataggtctgttaaagtaaagaaggacatgcatccatgaacgtctcagatcatctagattctgcctatatactgctatcctgcctttctcagcttctgagacatgtctgcccatcctccttgtgtagccccacccttttctttaaaaccacatctctgaggactagcacccccccttccttccttatttctattttatatgtacaggtgttttgtatgcatgtgtgtctttgtacaacgcgcatgcctaggaaagaaggccaaagagtgttccagatctcctagagctggggttacagatggctctgagctgctacctggatgtcgagaacaggacctgggtcttctggatgagcagtcattgcttttgacttctgagccatctgtccaggcccgttatgttccatcttaatttatttttcccatatataacctgcccatgacttataatggtttggtttttggtttgttgacttaaaagtgatattcatcagtatattttctcatggtgttaggcagtgcagctagcctcagctcctatttagctagctacaggaccacaagaaggtctaccagcatgctgcagtatgctgtgtggctgaaactctgttggggaggttagcattacgctctgtggctgaactgtggtgcataaattaggtgtaacaatagagcactttaaacttgaccagaactctttggggtgcagcctccctgagagctgaagagcatcttgctatttttcgggtgtgcatgaagacaaagcagtcgtatctgagctggccgatgccagaacaccttcatctcagagaggacaagggatgtgttgagtggtcctccgctcaactcctagaacaagaagctgtggttcagaccttgttttcgttctcctgttctgtgagactcggagtgttcagaggagatgctgattctgggaaaaaagggatcccgttcgcctcattttccacgtagagagaagactcgagaaggcagcatgagctggaatccatatgtttggaaatctggctgtggcaattgctttgctgaattgcccaaactgttgtcatctagtgctggctctggggccatgcacatgtagttcccccagcatggtttcaactttcctcaaagccaggctagaattgttctagaaaacgattattctaaaaactgatggaataaaataaatatgttataatttagttgtatctggacaataatttatttgtccaaccccacacagtttttaaaaaaatctttttaggtttgcaaaattattacatttgtagctgcaacaaattcaatgataagcatagttttttttttttaaagaaaacaggtttcacacatgactaaatgacttgagaaacattcctggaatcacatcgctgagattcatttaaaaattttgatgcttattgctaagcttctatcaggaaaatttgaacctatttatagtccatagtgcatgcgaaatataaagtattctaatatttttctttgtgtgtgtgtgtgtgtgtgtagactggaggacaactttgaatgtcattgttcaggtgtccttcaacataattacaaagacttgtttatttttattttatgtctatgagtgtttaactgtgtgcatgcgtgtgaaccatgtgtgcacagtgcccatggagatcagagatggcaccagatgccctagaattagagttatagacagttgtgacttgccatgtgtgttctagggaacaaatctgagttcagaggtgtccttaatcttggagtcattagtccagaagagaggcttccctggttgggaaaggatttggattttgaatcagggtctctccttggctggctctttcattaggctagactggctggccagcaagccctaagtatcctcttgtgtgccttctaatgcacacaaatagtgcacacgtgcgcgcgcacacacacacacacacaatacacacactcataaaaatacatcccaaacaaaacaaagtaagccaaagccaaagccaaaaccaaaaccaaaaaaaaaaaaaaaaaaaaaaaaaggaaagtaatccaacaaacctctggttgtagggaaattgtaacttggagagcaagtccctggtcagtgtctcaaccttccctcttttctgctggccactaggccacgaaaggcaagggacagtgctatggcttccttccaggtcttgtcttcctgcctgttttgccacaaaagctcaagtggacaggatgcgtgttgggtcccgctgagctcacctcttggctccctgtgttctctagatggacgatgcagagggcacagtgggatttcaggctttaaagcccaactccctttgctgctggatttcttgtgatggattgcaaaaaaacaaattgtttttatctgcccaattctggagttatgtaaggttacaggacttcctcttttaggaaaagtcccagacagttcgcttatcttcttgttccatctgtgtttgtgggtattgtagctttcattgtccttccttcaatctaaacagagttaaatgtgttggacccaatgagtactgtggccttatgcgttcctgtgtgatccataagcttgggaagatgacacatttcaggttccagaccctgggagactcttgccagagcgagagcatggccagatagatactccatctcccagcctttgtgttcgagggtccaaaggcacatggagcgaaaacttgtcccgtggggatttcctattagcaacgttacctctgaggctgaagatccgctttggttacccagcgcctgtgcttatggaacttggtgtccatgcagtgggtgaaacatagactgagacacagtcagaaccttctgggaagaaaggtggcaatggtagcgacctcacagggtgacatcagtgagaagccatgatgaattgaatggcagatatgcagtgcctggccattgctgttgtgatcgtcccctaccccagggtcacctgaggaatatagaaagcatgtttttgaggaaagctttatataatataatatgtaatatataacattatataatatataacataatatataatatatatacacacgtatacatatatacgcatatatatatgtatttgtgtgtatatatatacatatacataaatatacacacatatatacatatatacacatatatgtatgtgtgtgtgtatatatacatatacatacatatatacacatacacacacacacacacacacacacacacacacatatatatatatatatatatatatatatatatatgcagttcagttcaggcatagctagcttaagcacttgagccctttcaggagtcttgagggctttccccttgactctctggtgttactgttcttctcccaccccgtgcggtgtgtgttcagggaggccacagaacgtaagtgcttgcatgggtcccattcattccacagtgctgtgatatccttctttccatcagaactgaatgataaaagccatgtgtccagaaagctctccaggcttctaaagaaatgctttacggcttactcatcctgctacccatgtttagttttagcgtcactccacggcacttgcatggtggtgagacttaccccagtagaagcatcgattccagtttccagacgtgatatagatctcctccaaatgtatacagaaacaaataataaaccccatctagtttgtcacacatagcacccaactatattatagattgcctttatgataacttttggaataaaacatttacgtttacttgtttgtttgcctggtgtgtgtgtgtgtgtgtgtgagtgtggctgtgtctggtgctttgagtaagtatggcctccacagactcatgtgtgtgaatgcttggcccatggggagtggcactattaggaggtgtggatttgttggagtatgtgtggccttattagaggaagtgtgtcactgtgggggcaggctttgaagtctcttttactttaagctccgcccaatgtggaattcagtctcctcctggctttctttgcatcaagatgtagaactctcagctcctccagtgccatgtctgcctgaacactgccatgcttcctgccttgaggataatgaactaaacttctgaactgtaagccagcccccaattaaatgctagttttataagagttgctgtggtcacagtgtctcttcacagcaataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacatttgtaatgtgagtacagtttaacaaccaggatgcccatttgcctgcacagcagggaaacatcaatatattccaaggatggaaataacttgagagatccactgaccttatttgtaattcaaagggtacagaatcctggaagttactatcgcaagtcttctggcagtacagcttgcctgaatcgatataaagctatccgtagctttctttggccctagtcagttcagacgtctaattttgctgcagaatattattgtactggattgtgaggaccctgtcctagacacagtgtgtgtgtgtgtgtgtatgtgtgtgggggtgtccatatgggatgtgtgccttatcatctttctaaatccaaactatggaatcctgaaacattcctagcccaaagatcttgaatgaaagcttgttccagcgcagtggtttttacagccagaggatcctcctattctggctttccaagaacggccccactttttctttccttagacaaaatctcacctatgtgacacaggctgacctcatttttgattctcttgaggaaagtccctcttaatatctgtttccaggatagccactgacctgtaccatcagagcctgatccgtactcaaaactgtcccatcttggccaataaatcacacggtcaccatgctgaccatcacaaactgttggttataggcaccgctagagagaatgattaagttcttggtgaattcctatatatggaatttaaaacaggcaatatcctgatatcttgtaagtaatataacattatttataagaagtaattaaaaaatatattccctactgccttcttcagcagaattttctatagcacatataggtaatagagaaaagatattttattgcctatgaatttctctttgttcaccatggtgcttgatgttcaagacacacccactgggggtactttgcaattgtggatagtaatatatgtgtgtgtgtgtgtgtgtgtgtgtgtatgtatattatgtgtatatatatatatatatatatatatatatatatatataatatgtataatataaatgtaagtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacacacacacacacacacacacacaaataaacaataaaaaacccaacatcaataataaaatagaacaattctaacaatatagcataagttactttacatgtatgaattgtttgtctctggaacttccatttaatattttcagacagtgtgtgaccttcagtaattaaaaccacggaaacaatggataagggagaaaactgtaataagttacatgttatttatttaaaaaatattgattaacctttggcttttgccacaggctatgaccgttgaagcacatagatttgtgggggctttccttggggagactgagaaatcttgctgagggagtaattttgaagctaaatcagaaaactcagtaagccaatgtattagtcacttttttactagacactatgttgctctagctggcctggaactaattttgtagaccaggctgaccttgaactcacaaagatccacttgcctctgtctgaggggttagaggcatgccccaccacacctggtcttagttacttttttgtgttgttgttgtgaccaaatccctggcaagaatcaagggaagaaagatttgttttgacagacatttggatacaatgtcgtatggatacactgaatttagatacaatggattcttcattgaggccaaagggcatcgtggtggaaatgactgtggcaacaataggagtaagaggctgctcattcacatctggatgcatcagcaagcattgaggggtcaggcggcaaggctggcctagaaaccccaaggtctgcagatagctgacttcctcctgctaagtgctccctcctaagcattccaaagagcaatcttctaagcctcccaaaactgcccagggaactggtaactaagtgctcacatacaggagctagtagcggagggcggagggcgctttctcagacagtagcagcaagtggaagagcacatacatgaggctgagcgacaacagctattgaagccttggcgtagacactccctgcccccgcccaagcagtttggggtgcaaagacagcacaggggctggaagtcagttactgtgacatcagtgggttttcagcagacggacagaatcttaactggtgtttttagagagagtgttctggctgctctgcccgggcaggcttgtgggaggtggagggcagtcgggatggctgcttggtccagtctttgtagaaggaagcaattgttcttgagccactggcttcactttccatgggcacagagtcttagctgttcctccctggacaatggttatatgtactctgcttggttctctgaggtcagtgcagtgagtgcagtttccagcctggctggaacaagtaggactgaaggttcattcagacttccttctgcaaatgaggaaaagttgcaaatgagaaacagagcgcagcccttcctcagggtgggccatcgtggagccaagtacccgaaaggctgtgggagtgaggatttcaatcatgctctaaatgaacggatactgggaaggacaattttaggggctggtggaaaatagagagcttttgggcaattggctactggggctcagtgtgtgtgtgcttctaagatccacaacctgtgatgcctgcccagcaaaagatggccgagatgtttttctttgttaccagattaacctatatgaagccacccagtgcttctgtgaaatcaatggtgttttaaaatgttaaaagccgccctttttctttattttagtataggaagctggctggaggtacgtcttggatgtctacatttgagagacttctctaagcaagcaggccacctcttcagtcatctttttaatttcccttgcaccgtaacagttttaagtgactgatgaagggggactgcccatctttcccaggcaatgaagctcagaggctcatggaccagatcgttgttgggtcatcccttaagccaggcagaatagatggtaatggtgttcagtgcctggaatagaaagaaatagaaagttaactgaggcaccacagaaagagttttctagaatttgttgtatttgcagaaatttgttttcttccttccttgtaaattatttacatactttgcaattgtctttcccgccaggtcctccccttttgaactaatttcagacttagactggcgttataagaatactacaaagaatcccttttttctctccaactgctccccccatccccagaatcctcagcaagtcacttgtaactctgatgtctcatctctcctgcatacttgagtgtgtctttcctacatcaaagacacatcaccacagcatgaccaccagcaccaggaaacgcactggtgcactggtaccattaatgcacaggcccattcaagtctgccagatgtctcaataatggcctttgtgttgcgtctgattcagggccaggcactgcattcaggaacccttcctttttaatctgtcctcagcttgcatgaacttgacattttttttttttttgacaattagaggccattatcctatagaatatctgccaatctgggctccttgggcatttcctcgtgatgttattcaggtcaggtactttcaaatcacatcctcacaagtgtgatgccttcatccagcgttcttgtgggtcacatacgactctgatgtgaccctttcccgatgatgttcatttcctcgcctgattaaggagttgttagccttttgttgttgttgttaagttattcccccctttgttgtaaaaatattttgtgagagatacttttaggcctatgcagaggccccatttatcagtcttttcccttacagcttagtatttaccaatctttctccacctgctcctcctatgttttaaaatttattagggggtatgtctaggatgggtgtgtggaaggcagagggcaacttgctgtgatccgttctgtttttctaccgtgcattctgggaattgaactcaggccattgggcttggcagtaggcatctctacctactgagccatctcaccagccctagttattgttccttgagacaggatctggtgacatagcccaggccagcttcagactcaatatggagcccttgtaggccttaaacttgtgatgctgctcctgcaccagccttccaggagctgggtaaacaggctgtgcctgccagcatgccccacttttcatgggtgctccttacctgaagaattatcgctttgctaggtaccaaatgttaatgtccggttcccattgttctgtttgttgattgacattcttctttatggaaaagcttactctctgtttacttattcctggatccctacatttttattattacttatttggtgctcatattctgtctgatttggctaccatgggccttttaagctgaagtttgacactatgttgtgttctgttctgttctgttctcttctcttctcttctcttttcttttcttttcttttcttttctttttttttttttttggatatattttgttatcctttgaagaccttttccttttttcccccaaataagtaagcaaacactttggttaaggcttgtcttttgtgttccctggcctgaccttggagtcagccattgttctaagaatctctggttctggttagtggtgtattcagaaactaagctttgaacagggcattgttcttgatgtttctgtggcttgtcccaggctctctgagaggacaaggatagagaacacatatacacatggacatacatgtatatttacaatatgtatatatacatacatacttacacgcacatgctttttcacatctacatttacttctgtatttttaaaaaagatttatttatttactttatgtatatgagtacaccattgctctcttcagacacaccagaagaggccatcagatcccattacagatggttgtgagccaccatgcggttgctgggaattacaggacctctggaagagcagctgtgctcttaactgctgagccatctctccatccctatttctgtattttaacatgtgaaaaaccatgaatccaaaccaattccctctccactgctagcccagggccctccatgaagctagccttctgccggtataacttccttccctgtattctgactgtatttattctgtacttgcctagctgtgtgcatgtgctactgtcaagtcctgtggttgccatccttgtcccctggctcctgttattgcgcctgcatgaggctgctgtcttctgtagaggcagcctgtcatctgtctcccagcttgtttccttccttcatctgtcctccctgcacctcccccccacaatggccttcctcctttcatatacaaggatgccgctgccttctctccccactgaagctcactctatgccagtccccatgctcaccacgttgaccttctctcttcatccacggctattctacttcacactctgatcaccacagacggtgccgttgaaagccacagagatggatcctcttagttctggaagccagaagcctgaaagcaaggtgttggccaagttacttcttactggaggctgagggagaagactggtggaannnnnnnnnnnnnnnnnnnnattctatggcttatagatgggactgtttccctctctctctctctcttttctctctctctctctctctctctctctctctctctctctctctgagtgtgtcagtgtctagatatcatctacatagcaagacattgatcatatgggacttaaagaattatataattatataattataagagcctgaatagaccaccccagatagacttcttcggtattttttcaagctgattactctgggaaactcaggcacaggagtaggtctgggaagctctgtaaaagcaacctaagacatacgtgcagtaaagagagagacaatgtattagagagagtgttagcatcagagagggttgctatgaccactcttattacctaagaccgtatctggccaacagtgctttaggccacatatgcacttcacatgcatgcaaccataaccccacataagcctcaaatgcttctgtagctgaagatgttgcttatactccaatcacctgcctccgtttgggtcttgcattcagtgggatgcctgtgtgtatggtttagatagggtttcagataggactttcctcttgttaatctgccttatgccatcttaatttgtatccccgccaaagaatctagaagggtagaaggaaaccccattcatttccttccctacaggaggtaggcctactttaattcaggatagcctccttttaatgtgggtacatcttcagagataccattctcaacaaaggagctgcattcacagtttttggtagatgagaatgtcgtgaggctggggtgtttgggggaagagttttcaagctcgtatctgtttgctcttctctgctgaatgctctcttggcttaagtcatttagataagatgagaagaaaggaagaaggcagggagataggacctctttccagtgggttcaggagggaatcctctatagatagattagacccatcgtctcatctaaagtccaggccttctgctgacatcagaacagtctaggaaactctggattcagagtgagcacaggctagcacccattttgaaggtattgggcttgtgccttgaagatattgtagccttcactttgttcaggaaacatttccaccttctgtgctggctactttagtgttagggtgtgacccccatcccaagctgtccattttgaagccaaacaactatgccattgttcaagatgccagccaagtgtgtgtcccaaggatataagtaccatttagctggagcatttgggaggggtcagccatgactgtcactaatgcagaaggagaagatggctttgttgtcccataacaaagttcctttccacagtgcccaagagaaagcctgctgtgtaacctgtggcacagggcatccagtagtttgtgcgtgagtcttaattaccttgacagctgaaaaacctgcttcttcgccctgatttcttctcattccaatgtcttaaacattcccatgcaaatcatacttccaaattctgtcttagtccaagggttttactgctgtgagcagacgccatgaccaaggcaactcttataaagacaacatttaattggggctggcttacaggttcagaggttcagttcatcatcatcaagtcaggaacatggcagtgtgcaggcaggcgtggtgcaggcagagcttctacatcttcatctgaaggctgctagcagaatactagcttccaggcagctaggatgggagtcttaaagcccccacacacggtgacacacctactccaacaaggccacaccctctaaaagtgccactccctgggccaaacatattcaaaccagtatacattcccagtatctcattattcagctctgccacattttatttaaacatcttccaggagtctagatatttttttttcaatcaactgaaatgctttaaaagtataaacagtgttccttaagcatctttggtttttcttttacagagttgagggctggacccaaggccttgtactttctagacaagtgctctatgactaagctacatccccaatcttcccttaaatatctttaaccatacattttgtatctgcagaaattatcggttattaactaaaagctatttatttatatgctcggaatttaatcatctcaaactccgaggaagtttcatttttcttttcaggagagaaaaatggaattataagatcttggcttctgctaccttctgcatttggttctggaagtagtgccctgggaagtggatgcagttgacagtggccacctaacagcttttaagttgtggagagagtagtagcagagagttttataatggcaggctgatttctcatttataaaatcccaattcttatctcatataaggtgtggcaataaagagatgcccaggctacaggttcaccctgcacacttaaaagacacataggaaccaaggaggtttcccctggtgcccattttgcctttgggtacttagaatatcctggaggcatagttgctaagacaccaaaaaaccatcttacatcctgcttaaaggcctctatcttattccatgataaggaaagacaatgctgggccctatggagatcatgactctttaagacatcccatattggggcaagagaaatgggtcagtggttaagagtgcttgtagaacaattttgaggacaagaattcctatcccagcccctacataacaaacctgtgcacccttggaaccccagctccaagtgggaaggagacaagaggctcttgcgatcctgctggcttctagcctagcaggaaggtgtgagccccgggtcgaggagagactttattttaaaatgaataggcaaagttggaagacacccgactattttttcctggactctgtgtgttacacataagcacatgcacctgcatacttgcacacacatgggtaacttagataataatagtctttttaaaaatctcgttaaacattagggctgaggatgcgggtcagaagctggtcgtgtgctgcatctgcaaggctactgggcatggtggcacacttttataatcttactgttcaaggagtaaaggcaggaggatcaatttaaagtccgttttgactacataatatgaaacttttcttcaacatcagtgacaacacccaacaacattccatgttgctgagtgttgagtgatcccctggagactgaggcaggaggatcaggtgtttgggactaatctgagttgtatggtgacatattgagaccctatttctaagcaaaaacacaagttgtcaaattaatcagctatgaaccaggcaagatgactttccattagcatccagatatttcatagtgttatcaaattagtaaggcccatggtaacagttggaactccacaggccttaaatctccttcttggaaggtgtgatggcttatgtatgcttggcccagggagtggcaccattagaagatatggccctattagagtaggtgtgaccttgttggagtaggtatgtcactgtgggcatgggctttaagacgctcatccttgctgtctggaagccactattctgctagtagccttcagatgaagatgtagaactctcagctcttcctgtaccatgcctgtctggatgctgccaagttcccgccttgatgataatggactgaacctctgaacctgtaaggagccccaattaaatgttgtccttataagagttgccttggtcaactcacaaaatatgtactcactgataagtgaatattagcccaaaacttaggatacccaagatataagatacaatttgctaaacgcatgaaactcaagaagaacgaagaccaaagtgtggacactgtgccccttcttagaattgggaacaaaacacccatggaaggaattacagagacaaagtttggagctgtgacgaaaggatggaccatctagagactgctatatccagggatccaccccataatcagcttccaaacgctgacaccattgcatacactagcaagattttgctgaaaggacccagatatagctgtctcaagtgagactatgcctagcaaacacagaggtggatgctcacagtcagctattggatggatcacagggcccccaatggaggagctagagaaagtacctaaggagctaaaggggtctgcaacccaataggtggaacaacattatgaactaaccagtaccccggagctctggactctagctgcatatgtatcaaaagatggcctagtcggccatcactggaaagagaggcccattggacacacaaactttatatgccccagtacaggggaacgccagggccaaaaaaatgggaatgggtgggtagggaagtggggggggagggtatgggggactttttgggatcgcactggaaatgtaatcgaggaaaatacgtaataaaatattaaaaaaaggaaaattaaagatatataaataaaatgcaagattttcacctaaaaaaaaaaaaagagttgccttggtcatggtgtctgttcacagcagtaaaaccctaactaagacaggaggggaagttcaagtcttcctcagaaagccttaggaagtctcttggtattgagaaatacaggtcaaacaaagtgctgagatatttaagtggctgaagtagttctctggcttgggaatctggcactcttgtgaaggagtcggaagcaacatggcctcttagcttcttgtgcttctcccagcaactggcaggaggtagagatgggcagataggaagggcgtgttagtggcttccaataccttcagtaagtgttaatgtgaaattagcatcagggtggtgggacattagctttctgtaggacttaggctcctgagatagctctccaggttaatcagaaacagggccaggcagggcgcctgcttctcctcctttgctttcggttcctttgcaaacctggaagcatgcgcactggccaggcggccctgctttaggaaggaagttacgttgctgaagcaactggagagagtacccaagtgacgtaattggggaagtctcctctggttcttcctcttccagtttcttaaggaaaggggtggaaagagggaaggcgcctgcttcttagcacacagagagtggggaaatactgttttccttggaaaactacaaaagcgaagctgtggctggacagggtgtgtggttatttatgttaatccctactttccgggaaggcaccagacgggggctggatcaaggaaattgaaaaatggcttcctcttcagtaccctcagtccctggagctgacactgagtttgttgtactgtatcctcctgccctacctgtggcctctgcagcacaggctcccagtgtggagaagggtcagatggtgacatccaggccttgtggatactccatgtttggcctgcaagtatgtgtgtttcttacccagaggggaaatgatttggatttaagatggctgttcaagtctcagctgtaatggtcaggagtgatgtagccttggtcaccctatttaacatcaagggcctgcttcagctgtagagtaggaatcacagcagcactttcatactggtgaatgcacagagctaatgctctttatgcctataacttgcacaatgccattaagcacttgggcatggtagctgttgataatagttttcgctgagtgtggggagatgctggacttgacagcctgtgctgtttgcaggagcttgcaggtctagacctggatcctttagttattcacactcaaggtcctccacttagcagtaggttgtgttctaagaggtgactaagcttgcagaatatgagctaggctgttttcaaaccaagcttctcaatatagtatccgctcaatggctagtggctagcctcctctggcacctccacaggggtgtccagggaagatactttgtttgcaccaggcatctgtgggtgaccctgacttggaaactgtcttttactcttaggtgaggtgttaggtgtatgtaagtgactagcaagtagcttattggactctgtagataaaggcgattgttgcaaaagtctgccgggtagaactgatctatacttcttaggtgtaatgtgtaatactgtggtcatatgtatttacacatatagcaacctcaacgcaggcttccggctccagagaacctttgtcttgatggattaaagcatagaaaaatgaagcagacactggaaggcagtgtgattatatgttaaataattgttagaggttgtgttacgagttcacaaggggatttttgagtcctatgttgtagggtagacattgtagaagagatagcattggaaaatatgcagagggttggttgactatttcgtgactggacctttcttagtgctccagcctcatgcatctaattgaccctccaacattgtttggactgtcccaaggagatctcaaacaataggtcagaagtcaaccttggcatgtcctcagaccacattgggttgcagcagctgaacgccaatggctcccacctcatcggaaaacagaggaaaggaggtcacattagtgcacagatgtttgaagagtttgaaggagagttagaaagttagaaggaagagcccgtcggtgtctgtattctccacgaagccaccttcacgatcatctgctgccattaaagatggggtgagtccatgaagctcgaaggaggcaaaggccgaaagggcttttgggagaactgagaggaggcactggcaaggaaagcagcagagacccgaggatcggtggaggcggagtcacggacccggcctatcatgacgttttgcagcaagagcgaatgaggcaggttggtgagatccattcgtagtgaggaaatggagctactgtgttgggatgtacatggggccaaagcacattccagggagcggaagcaagagagccaggtcgagacacagaaaagcacctggggaagctgtactcagtgggcagagctgcccaggaaactaaaatgattctggagaattttggagacctaggaaggacctttctttgtaggtcatggcaggaggtctggactttttagaaagatatcagatggaaagctctgaacacgggcatggccactgcagacttgtttctgaaattgccaagtagaatctggaaacagaccgatgtcagaatcggccactgcaggactgatgaagaaggtagtaccgctaatcgggctgccctcatgaagatggagagggtgtggtcacagggcagcccggtggaagcagatggctaagcgtggcagtaggtgggagggtgagggaagtggcaatgagtgacgtcaagtacaacggggccaatcaaactttaagaggtctagcggttttctgattagtgtacttaatctggactccttagcacttgtctcggagctgctcctgaaacccaatggggcctctgagcacaacacaggggcaagagcattgcaagttgcatacattggcgaggcttaccctggagcagaagaaccattcttgtgaggctgtaatgagaaccgctttctgggatgactgtgtcacctgtcataccccaaactggcgatatgttagtgtcttttgagcatacatatggagaccctaaggcagttttgctgtgtgtttatggtggtcacacaacactacacattatgatcagaggctaagtcaaactgcgttaggtaccacggtagtctgtgcccagagacaatttcgtttttttgtaaaattgctatggtagtatataatatctcccaaaaggacccagaactcacctaatcagaaaattctgtgtagaaagcaggtacactaaactctaatttgtgtgattctcggcgtgggaagcctgctttgtgataaaggcattttggaattttaatttcatgtgcatttgtttcgcattagtcatgaacttcattcaccagtagcctcctcctgtcccatgactcattcggagatgtttgtcagccatcagggatgcggaaggccattagattaatgggcactaagtggcagtggttccccccacttagtggcatatcgaaattactctaagataatgaaagtgaatcctgttccctgccctggagagtcttattaggctggggttagggaattttccttcaaagttctccaggtgataacattgcacaatattgttttagagactgggagagattcaaaccagaaaaggtggctgtggcttgtgctgcctctgcctctgcctctctgcctctgcctctgcctctctgcctctgcctctctgcctctctgcctctctgcctctctgcctctgcctctgcctctgcctctctgcctctgcctctctgcctctgcctctctgcctctgcctctctgcctctgcctctgcctctgcctctctgtgagtgtgtgtatgagtgtactcgcatgcaaggtgtgggtaagtgtgcaccagtgtgtatgtgcatgtggagaccagagtttgcccctggctttcttccttatctgctttatctttgagatagaatctttcactgaacttagagctggttcacctagactggctggcccactaatcctaggaatcctcctgtctctgtctccccggtgtgggggctacagaggagttataatgtctggcttttcacacagatgctggggactgggtcctcatactgttttggtaagcactgtacttgatcaagcttgaaacatggtctttgtatttattttctgtgcatttgtgtgtgccggagggtatgtatgtacaccacgtgtgtgcagtgcctgcagaggccaaagggggacatagatctcctggaactagagttatagatggctgttacacactgctcgttgcggctcttcacttccaagccatttctccagcccccctggagtgtattctttgatggaactgacatatatctttaaaaagttttataaaacagcaaatcagaaaacgaagatgaagtttaacaaaactttgaaaggatcagcactctattggtttagatagcaatagccatttttttctatgtccatccaaatgtcaaaccatctttctgttttcatgactggcagtgttgacttacttcgtcaggcttccaccagaatatgtggagtgatgtgtacaaatgccacagagacacaggaaacagccaaatgtgaaatctaacacctcctcctcaacacatcacggcgtattgtcttagctctgaaggtgatatccctgtgcatgcaaatgtcagcaagctcttgtacatctatctcttagtagcttacaggttactaaggatgcatatatttatttatttttgtcttcttttatcccttatacttgccaatatcctctttccctacctgcctacacacgtacgtacgtacgtacacacacacacacacacacacacacacacacacacacacacactgttaaagggtcaggtcagcctaaatgcaattctctttaaaccttatcagccacagtattagtatcaacgatgctacagcaccatatatgatgaggtctgaaataggaggaagttccttgcaattatgtcgactctatttgtagcaccttcttatattttctattctatactccagtccattaaaattaaattaaacttgctgatcataaaccaagaatgccaatctttttttcttcttcttcttcttttggttttccaggacagggtttctctgtgtagccctgactgtcctggaactcactttgtagaccaggctggcctcgaactcagaaatttgcctgtctctgcctcccgagtgctgggattaaaggcgtgtgccaccactgcccggcgagaataccaatcttaattaaaaaaaaaaaaccaaacaaacaataacaaaacccccaaacacattgcacagtgccttagcaagcttttaccagcggtttgagaaacactgggttttgctgtggcccttggaggcagaaaggtttggattggatcttgagccttgccgctcctctgaggtcaggctaagtaagtggctccatttcttccagtacaagatggagatgagacgctctgcccgggtggcttgttgggaggctaaatgacgctatgcacgggaagctctgagctcctcgtaagctccggaatgaatgtggtattggaaaccatggtggctgtcgttctcagctccgcttctccccgtctctgtgcttctgcatggacgtccttacacacatcagtcagggtgaggagtctagaatattctataagaagtgaatgtggattagggggagaattattgagtgctaaccaagaattactactggaagtttctgttacagtccttgaactttataataatttccccctttctgttttcagggggagcatcgcccctctttcctagtcttcctttcccctcacccccatacctcctcccttttggctttttatttttaacttatttatctcatcttttgggatgggtttccttttttcctttttttttttttagctatttttactcatctctaaaatggaaataacaatatctgatggctaaggcggttgtgtgtgctactactgaagattggtgttaaatacctaggatttgtttctgaagtggtgggtgactccggagcatcatctgtgatgctgcctgaggcggttcctctgtcctcatcagcaccacagccctgctttgaccctcttttatctcaccctgcttgtctgttgaactctctttggccaggcatttcctctgctccaatctgctcttcctctgacataaatgctttccttggaaatccaattaatagtgatttatggattccttatgaactagttaacttagttggcaattaagtacagactgctctctggtctccactgcatcattttattatgataattacagaattattagttagcgttatatgatttatgtctcacatcctcagcgaacttatgagttccctgagggtagcaaccatagcttacatatctccaagtacacctacccccactacagcaattagcacaggcagatccctgtaatcctgtgtgttaagagctatctgttgagggtaactggggacccagacagcatgtgcctgaagacaagagtgtccagtgggctggggacatggctgtgtgacatggtaagtggcaagaacacgcagaagcactcgatgatgaaggtgcagaagagcccgggtgtggcatgaccactgtcagcttctaggacagagattcaaacccagctttgtcctgagtgatttagtttgcatctttctttcattgtgtctcacttgtgcacctgtctaatatgactcctactaaactgtgtatagaaaattctggaaggttaatagttgagggacttcaatttttatctctctctgtctctgtctctgtctctgcctctctcaactctcctgccttggcttcctgagtgctggggttatagggtaccccaccatgtttaggctatggtgggaatctgtaagtatttctccaagtaaaaaaatgacttgatttcatctttactcttgaatgaaatattgtctgaacataaaaatccacaaggtggtctttttcctttaatgctttttctttaaaattatttttgacatcgtgtgcgtgcatgcgtgtttgtgcacatatgcagccacagtgcagtgtgggggtcagagaacaacttctaggagttggttctttccttccatcgtagtgttgtggggactgaactcaagtcatctggtttgctggcttgggcctttgtctgctaaattatgctggcccaggacttctttcaaaggtcttctggcttccattgtttctgtggagtactgaatttgagcttaaaggtttgggatattttgctgttggctttgttttttcaaaggtaacatgtcttttgccctctgttttttttctttctctttctcttttttttttcttttcttttcttttttttttttttctgttttgggcttgggtatggtttttatctgtgtttggccatttgtggttttcagtgacttttgatgtgtgattagaaaatgtcccgttgtggtcttctcaagaatttgcctcacactttgtcttgtctttgtagactttcaaattagccacagtttaaaccctgcagtgttcccctatggaatctatgctcgtcttacactgtctcatctttgtgactttcagcctcactctggaatttcctttgacctgttttctggttcacatatgccccccacccccatccaggtatcaaagctatttttaggcacaccccataagttcttaattttaatgatatccattaattctataatttaaaatttttaatggtttatctgacaaaatttttccacctttgccttttgttttcctatagctggttttagaactacccaagggctagggggtggttctggctttcagtcagaatttgggaggcagagacaggtggatctctgtgaatttgagcccagtttgatctacatagtgagaccctgtctaaaataaatgcctgaagatgtttggtctgtgtgcatccatgtacataccattatatctgcttaaggcctgtgtctgtggcctgtgggtctgtttccactgatgtttgtcgccattgatctttatgttcctaattatagttactgaatgtagcgactgcatcagaagaactccagacagagtggttaacctttgagagtgtcaccgtcttcagtgtaagagtgacatggaagctctaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctccctcactccctcgctccttccctcccttcccctttccttccttccattattattttatttcagcttcagggatccaactgtgctcctcatgtttacaactcaagcactctactgaccaaaccaccttccgaacctatccatttatttttacttactctcatttattttattttatttttcagttatgtgtgtgtgcatgtgtgtgtctgtgtgtgtgagtacatgtgagcgcaggtgcccttggcagctacaggcattgtcttgccctctgagctggagttacaggtggttggctggacaggtgtacccccaacctgggtgcctacaaacaagccctggtcttctgaaaaagcagcaagggctctcaactgctcagctacatctccagccccacttaggttattacttacaatgcttgggaaagttccagggcctccttttcctggctcagttttgattgccagttgtctccttggtcacctgaatgtgccccaaattctggtcagcttctgagccctgcaacctcctcccagaggttggcacatgcacttgggatgtttagacatctctagaaggacataaagtcaaaatgtttgaaatggtattttaggaggatgcacgtgctggtggtgtgtaagaaagagaaacgggtgcaaaagggcccatagaacagcagagaggccatgctaactgagggcgatctggagtaacaagtagagcccctggcttcccccatcatatagactctgtagaatctcagtttcccaacctttctgcttttctctaagctatctctctataggggtgcgggtatgtcctaaccaagcccctgtctcctagggccgagatatttaaataacagaactcaacaaaacttcagtactaatagttgcttcatcagaaaatcaatatccctattgtaagaaatatggtaaaattgtattgctatcccaataaccaaatctcagttatttagccagagattaaacatggctgccaatggcaccagtcaggaccgtggcgttgttaacttcgttgggaaccacttgtagtatgttgatcacaacaagtaccttgcctggctttctgcagtggcctccgcaacactgattaccgaacagtagtttcaccatctcattggttttgcttcctgtggtttctcttgccctgggtcagctgtgttctgaaaacattaagtgtaaaattccctaaaattccataaataaacacgaagtactgagtgatgtggtgagtcctcacacatttggccctaactcacctgggcagtaagtcacccacttgtcctgtgtgtccatgtcctacaaggttgtcctcagcatcctagttatcagatcagctgtcacagtcttggatggtccgagctcaagtaacatttatcttagttaagcagtgcccacggggccagggtagtgaagcttgttaccagtgaggtggccaaaaagaaatcacaaggtttcttcatattcaaagataagagtcggtgccatggtctgcatgtggtggtcagaggacaactctatggttgtcctgagtctgatctttctacatttttgtactttcctccactgaaccaaccccggatggaggaatttcacatttttttggtagataattataaaggcaagagtaaggtcaacacatttttaaaggtagttattataggtagtagggaattagaaatagagactcctgttagagtgtagagctaactgaatcctcagcagaaaaatcaagaggggcaagttgctctccccttcaactacagcacatgagagccttagtgtgtatgttgtatgcagcgggaaaaatagtgaaaataaatttcagaaaatccctaattgtttttttttttttttttttttttacatttttattcacatgtcttggtttattttgtgttcctgaaatgaaacactggagattgtgtttttatgaaagaaaggtttttagtcttagaggttcaggaacatgaaacctcatatagcagacatgacagggacagagacttttggaattagattttaggggaggtgcaaggcttgctgatgaaaagtcccccattgtttgcaagagtgattttctctgtgtgtgtgtgtgtgtgtgtttgcctgtctgcatgccatgcctcgagaggccagaaggaggcatcagcttccttggagttggaattacagatggttgtgagttgccacgtgggtgctaggaaccaagctcgggtcttctgcaagagtaactgtgctcttaaccattgagatatttctccagaactctaacgaccattcattccggaacaaatccagccccctgggacctatccttggacctactcatgacatcagggctccatagcctagcagtagatctacttcttgaagttccaccaggtcaccttgtacctcactaggtaaaaggtacctcacaagtttccagcttatgaacctttgagggacaaaccaaacaatcagctacagtattgtggctatcgacgagataaacgttgagtctgggttgcgttgaattcctgttcgtgatgggctaacagacagatggagcagtagggcctggaaattagatgaatggaaaagatctgtcagctggaaagaccagacgttgtaggatgccatagaacacccaagcaataaatatgtaaaaattaaagggtatctggatcctggcttctcagagcatacaagcttagttttctctctggcaattgagcagttgcacaatggccttccaggacttgtagggtcaggctggtctttcgagtacttcctgttgttacctggtgtctggttgctggtcttttcttcttcaaggtcgttgtgttttctccttcctgtattagttcttgtaggtgccgtaacaaagtaccagactgtgtggcttatcaccatggttctctatttgccacagttctaccacaagtagaaaatcagggtgcctgcttcatctgaaaactataggagagactccatcttgtttgattccagatactggaagccttagatattctttggtttggggggaagattcacccaggctctgttgctgcctttgtgtagctggcttctctccatatctatatccctagttcctctttgtctgtattttcagttccctcttacaatgacatcagcttctggtgaaatgctgctcaggacattgccatcagtagataaatacatagccttcatgttttaagataacttgtttaacacaccctgttgactaacactgaatttatgctgagcaaaggaatatttacctttaatctcagcctccaggaggcagagctgtgcagatttctgggagttcaaggctggtttggtgtacatagcaagttccagggaagccagagctacatagaaagaacctggctcaaaaataaaccgctacaataaaatgatcttacagccaaacacatatgacactgatatgacacatgcctgagtctcttgagtaagcttgtctgattacatatattttctgcatgaggcgcatcacagcctctgtgtgtatgtgtgtgtgtgatcttgaattgttttgtgttgttgtaatagcacagactgaataatttgtaaaagacagaaatccattcttccgtaagtctcacctggaaagtccaagaccaaagctgaagcatctagtatatacttggtgtatctttcacatgacagaaggcagaagggcaaaggtgacaaaacctgaatttccacatgtcaggagtgcataagaacaagagaacccaccttgaaaccacttttactgaaatttaaatgtgcttatatgaaggtataactcccactaaataaatacatcctcaaagacctcaatacccaacactgatatattagggtctgggtcttactatgaaagtttgagggggcaaaagtaatcaaactatagtgggtgggtgagtgtgcatatgtgcatgtttgagtatgttggtgtgaataactgtaagcatggaagtatgaatgtgtttgatgcatgtgtgtacattagagtgtggtatgtgtgtgtttgaattgtatgactttaagtatataggtggatggatgaatctgtagatgtgttggagtgtgagcgtgtgggtgcattttagcttatctgagtgtataggtgaggggctggcagggaagcctccacttgcccatcagggataagccctatcaactgcttgatgtactcacagctcggtaccttatacttttttttttgcgggggggaggtttaaatgagaagaagatcaacaaaaaaacacagggatgtgaaaaatgtcatccctaagtagaccacagaaaggactttagtttaaagtgggagagaggtggtgagaatatagagaattgctctgtttgacctcagctgggtgtgtttgccccaggcatccagcatttcccccttttgtgcgagtaggtaatgactatggaaacaatgtaaggatgtgtttcgcagttacaaatacatctttagtaagctattgcctatgcacagaacttggaaagaatgcacaccagctgtatctctccttatgaactgttgcttaaaggagggaaagcttcgtgaaatatttcaagtgattatcatttttttttcttaaataggttatcagtggaaaaagcatgggggggggaatatatactgagatgatctcgcactggaagcgtggctcctcacctgccccctcacctgccccctcacctgccccctcacatacccctcatcctgccctgcccctgagtttaggcatgccagcagcacttctgttacgtcacctcagaagtagcgtccattgctttctcttcatgactcctgaaactgtccccactttcgctcttctggccccattccatgtggtgaggtcttcctctaagggaagattggaggacattgtggtcactactcggcaaggcagaggctttatggtggcagcggtgtgtctagcttctcgcagagttcccagcatgctttggcaactccttacacccgtacacaggactcttcatgtttctaattcccatctttaaagagtcctgtaagaatcaagatgttttatcctgtccaattctcagaacctccttttcagtccaagatctttgaatggatagatgatgaatgactaagagattgaatgaatgtgagaatggaacaaatttgagattcataaaaaacagctgtcttggtgactgttcatcaccttcccatgtcctttgtaacgcctccaaggcttttcctactgcctcaaaagattggccacctggagcctgcaggtgttgcatgagaccacccttccatggcggctttgccttgctagctcagaacttacctggtccttgtgttggccatttactgtgtagaaggaggaacttgggttttttttttttttttttacaagattacacattgtcctctgagaggatgaagttcatgctctcagagagctcacagtttgcatgggaaagtgaggctgcacacagctgaaaactttataggcataacaggagatgagatgaaagccgggactgaaatagctgccctaaagcaatgtctgcttcttgaggaagatatgtgagtggtgtaggagttgggagaggaagggttgcttcaggctggagtgctctggaatgacctttgtgagaagtggagaggctaggtcttggagcctggtggaagagtgacaacgcccaggaggaaggaagagctgggtgtgatgaagacacaaagtggacttgagctttgtgtgggggcagtgtacggagaaaaggggggatggctcccaagtacaaaggtgaggcccttgttgattcatgtcatggtgcttgttttcttggcaccagtgggggacagatcatagaaactagagtgtagagcatagaggattgcttggcaagatggaagagagaattatgtggcatgaatcatctcgatccacatctatagagttttttttttctttcagttaagcttggagcaaaagagttaaggttgtaaggtcacattgccatggatgcctgagtcaacatcaccttgaattccaggtgtcagactgaatgtaaatgtacaaacatgagtaggaagatgtcaggcagagagtgggtagcagctttattagttattccacaggggccgagtttgggtgggaagaaaagagccgactgtatagtctggtaggtaggagtgtgtgtgtgtgtgtgtgtgtgtgtgtgtgtgtgtgtaggcagtgtgtgccctggtggagtgacaatattccagccatgcaaatgattgtcaaaggaaaaatgagcaaaggtgaaaggcatgcaagtgaggccaaggctgggaggctggacaggaagggaaatgctggatgcagtgactaagagattgtactaggggagatgaggaagtaaagaggaggacagggaagtcactgctgagctctgaacatagagtacgtctagaaggaatgactagacagtaacaaaccttaaacctttagtggactaaattaattagcattttagtgccagtattgagaggtcaaagtattgatacatccgaggtcctcaagggatatatcagttaccatagctctttgtctcaggactgtttacccggcatttgatttccttttggatggtaaaatattggtccttgaatgttggatatgctgacagtttcttctataagcacagcacagagaggaaggataaaggtttattcgagacaaagtcactgagaggcatctgggcctacagctagttgggtgcatggcataccatgcccataaaaacttctttcagctgagagtcagcacggaaaatgtctggtctggtccattttgacattcactgggagaacaggattgtggaaagagcagatggcaggggaactgaatatactcaactcctgcctaggaagaggctgctgggaaaaggtccgtgccagggggtagaactttgtggtgcagataagaccgtcagtcgcagaaataccaaacgctgtccttctcttctgccacagggtaccatgccggtggaacggatgcgaatgcgcccgtggctggaggagcagataaattccaatacgataccagggctaaagtggctgaacaaggtaggtgcgcagtgcgtgtgtgtgcatgtgtgtgtgcgtgagtgaatgaatgtgtgtgtgcatgtatgtgaatgtatgtgaatgtgtgcatgtgtgtatatgtgtgcatatatgtgtatgtgtgaatgtgtgtgtatgtgtgtgtatgtgtatgtatgtgtgtgtatatgtgtatgtgtggatgtgtgttcggggacatgagagacagagagacagaagaagacagagagacagagagagacagggagggaggaggagagaagagaaaagagaagagaaggtaggtgtctcttgatgaaagtgggcccagtggatcaccaaataaagttgtgttcaaaatcttatgctcattcctataggaaacagccagtgattataaaatgcaaattcatcatatcaaaaagggtttggccacatttactgaacgacagtggggcacagggcaagggtggatgttaagtgatgaggaaggatgnnnnnnnnnnnnnnnnnnnntttcctacacatatatcctgtaggcactgcctgtgttttcttatagacgtttcagttttacaggtctcactttaagatctttgatctacttggagttagttttcatgaaaggcgctaggtatcggtcttgttttctttcttctgtatgtggtcagtttcccagcaccaagttgttgaaagaagatgtgttctccattctgtatcctgccacatggctgaatctatcatttctagaagttgttcggtaaagttttgaggatctctaatggatagtatcatgttatctgcaaatagaggtagtgtgacttctttctctatttgtatccctttagtttccatctcctaccctgttgctctagctggtgctttgagcacagtactgaaagtgaatagggatagtggacatctctgtctcctttcaagcgtttcttcatttcggatgatattgtcttgactttctgacatacagcctttactatgttccagcctttattttgttgattattatgattgtgagattttggtctttatgtccacttatgtagtttattatatttattgacttggatatattgaatttcagggataaagcaaacttggctgtggtgtataatctttttgatgtgtgtctgtgtttggtttgcaagtttccttttaactatgagcagtaagtgccctgtttaccattcgttctgtcattgactggttggagaatccagtcttgttctgaatttatctgtatggttgcttgtaatttttgccaggccatttgtttaggaatgcaggaggcctctactgcatggttcatcatttctcttgtagctctgtgtgatttccattctggttgttggtattcacagtaaggatttgtttagaccaaggcactgcagctgctccttggaccaatgacctttctctttttctcactttcaaacaggcttgtgtttttgtaaatatcagactatctctgcagagggtaaaaagtccaaacagaaggaacaaactagttagaacatcttatcagtgtgttggggggggggtggtcggtggctggagcagatagcagaattggtttccatggtcaccaaagtgtgtgtgtgtgtgtgtgtgtgtgtgtgtgtgtgtggtgtgcctttcaccatgctcaagacagtctcagtagttctccctcagttgggcaggtctgttcatatgcacacatgggaggaatcagatgcattctttccattgggagtgtgtacagccactatgtgtgcaggaccttgaaggattgggtcactggactctgaagatgtctcagggtctatgtagacatgttgcaacacggttcctatcccttggaacataagaatctttgacaagaatccttgttaaaaatctcagtttaaaaatgaatcttggatctggagagattggtttagcagttaagggaatatactgatcttgaaggagactctagttcagttcccaacacccatgtcagagtgcctcacaaccaactgtaaccccagcttcttggggacccagtgccccctgtacatgcacacagagacacacatacatacatnnnnnnnnnnnnnnnnnnnnatatgtatgtatgtactttctttatatgaaacccctacttgtgtatctacctgccctaacaaagtagttgttaatcatttacatttccccaaatgcacatgtgtgtgcatttctaatgttttgattttttaaatacagttcctcatgttgtcgtgacccccaaccataaaattatttcattgctacttcataactgtattttgctactgttatgaaccgtaatgtaaatatctgatatgcaggatatctgatatgtgatgctcagaaaggtcttgatatacaggttaggaactactggtttagaggaacagctaagtatgccttctctgaggagacccaagggagattttttttctttcaccaagaacaccaagaattctgagcaaatctctgtttcctcttctttactctactctctctcttcattttttaatctaaaggacacggtgaataatttaatggggcaggctttatttttgcaccaggtgcaagagcttaaaaccagaaagcagattgtggccagcttttagtgagggaaaaagatattgtcaagaaaacaaaacaaaaccaaccaaaacttctggtttcattttatcttctcaggttcctcttaaacttttttctttcccttacctatttattttgaatttaagaagactgtaattgaatatctctgcttgagtcctttcttccagaaaggatgggacaccgaaaaatagaaataaataaactacatacttgctttacatgtcctgtcatgtactggaaggttttgtggcaagcttggaagctgaggctcaggtatatgctcagtctctgctaaaaacacaagcaagagctcaggtcacccttgatcgctcagtgagcaacaatcaaataggggaataaggagagagggatggtagttcagagacagtgtagggagatatagggtaacaggtaaaagcaatggcagttggtatttgttaagtagtttttgctacttactcatctaagcaagggattaattacatacatcaagtcacttaatccccactctgggaaagggctgttattttccatgttgcagaccaggaaactgaggtacagagaggtaaggaaggctccagtgtgagattgattttcaagaaaagcaaatggtttgtttccactttttcttttttggacactagcttcctattctctcttttgctcctcctgaaccatatctgtatgtggcgaacacaaagtgtcattgttccttttgtgtcagctaggcactggcaacctgtagttgggtggtttttacaggaggttgaccagtagtctctagctctaaagacctatcccaatctttataatcttggaatgtggccctatatgggggtttcagatgcagttaaggacttcaagatgggagcatctggattaatctgtctggactgtaagtccaaggacaggtgtctttagaagagactgaagactgaagaagacacacacagagaagctttgccaaggaggtgtggtgcagccacagcctatgaactcctggagctatcagaggctgagagaatctcttctagaagcttttaaaacaccgaaaccctgccaacaccttgactttggatttttgactttcagaactgtgataggatgtatttcacctttaagccacttagggtatggtcatcttttataactgctttagggaataagtgtcccctctaggttcttctcattcatgggggctccttgtatgctatccactactcccagtgttggggataaaaaggtcttgtacatattgggcacatcctttgccactgagatacattcccagccttgtctgaatttttctactgtagggtcagaggcaacaatttctctttgtataactaaatccttagtgtgctcaggggggcattccctgctgggtttttctgctctggcttttggtgccacctttctcttccaaaagaagactggagaaagggacaacctggtcatctcttgaacacttctactaggctggacctgaggccgtctagttgaaaggagcatgtcgttggctctaacttcctccacttctcaggacaatgttgacacaggaatgcctaggctgctctgtgtctgagggtccctgttaggcaggtagcccacagggctaagctacagtaggtgtgtgtctgtgcacataaacagtaggggcctcagatgggtcagggtattttctatccatacctaaacttctacgggcatctttttataggtttcctctaactgaggctttttgacattcatctgttgacacaaatacttcaccaagggcatgttgccttttctttactattcacaagtactctaaagaacccctgtctattttgagtggctgggtgtctttccaaaacctcatttcttgttgaagactgttgggattctagtaaaacagaagacccatccctaagactttgtgattctcttacacgacagttggtttctcagttcaccttgtgttttcatggttgcagaatgtgttaatctgcttaccatgaatttatctgaggactcacagtgcaggtggcaggagcttctgtacagcatggagcccaagtcctggtgagggctgctttacaacatggctgacagcagaagacgcaagtctgtaagctaagagaaaatttctgggcagggtccgagttgctgctaaaaaaaaaatagcagcagattccttaaggaatgagagcactcctatcagactcaatccacttctctaaacagcacctacccattcataagggcagagtctgtgatctaattactctacactggactctcatcacttaacccatccgtgctgcagacaaaggaagccttgcaagacacactcaggctgcatccagaccctagcagtggatgctcaggatacacttttatccacgcctatgagctgtcagtacagtacagtatagctgtcctgatggttactctatgtacagtgccagacctagtatctgatcagataggaggcttttcatatagcgtgcttatgaatctgtgaataaaggcaaggaacccaaattcatggctatttttattgttgttgttttacactaagataaccaagcttggtggtatacatctgtaaccttcatactcagcatggctgaaaatttgagtctaaatgggctatctatggaaaccctgccagcagcagcagaagaagaagaggaggaggaggaaagaaagagaagaaaaaagaaaggaaggaagtcaggcaggtaggcaagtaggcaggcaggaaggaaggaaggaagaaaaaaaagaaaggaaggaagaagagaaatcaatgctgggataatggcttgaccactatcatgtctgtctccaaggaagagtccagtcagtaattatttaagccttaatttgttttcatgtcctacttctaataaaattgaaggagacctgtcatgtagcagggcccagccacagtggaagagtccagatgagcatctaagaagttgccagagcagcatccgtaccacttgtttgtgaaagacaccgtggaagggccatctactctttacgacagtatttgcatgtggcatagtacggctgagtcatacatttagaatgagtagaagacccaatctacccacatccaggtttctcactatctatagctttaccttttctgtgtggctagaagggggttttatcttaaagccattggatgatgttgcatatctgtaaggtttaacggtatctccttattatctcctatatctttgtcatttggacaaagtcaataatttttttttttttagtatcactgtcccacttacattcagatgttttgtatattcccaagataccttctaaaaataatttatttttgagattataaatattaacctcacttcctccttttctttccaccttctgcactcttccatgcatcccctgccccccacactcttgtaaattcatggcctctttttcttccattgatatttattcttaaaccataaatataacctgttcagcctgtataatattacttctatgtgtgttctcaggttgaccatttggtcacatggtagatttatttttagcttccccacaatgatttatagactggtcggactagtttgcaagcctgccagcagtgagtgagagttctgatcttaccacatcccctctccagccttggctgtctattgtttattaatctttgacattctgactgcggtgcaattaaatctcagagttgttttgagctgggttttcctaattgctagggattgtgaacaatttttttttctgatatttcttagactcccccccccccccccttgagaactctgtgttcagattcaggtttgtcttttaaatgggtcttttgtttctttgtttgactctggttttttagttctttatatattctggatgttaattctctatctgatacatagctggcaatgattctcacccattctctgagcttacgctaatccttgttgactgtttcttcagctgtgtggaagacacactttttagtttcatgaaatctcccttgtcagttgttgactttaatgtgcaaaccaatgaagtcctactcagggagtcttttcctacacatatatcctgtaggcactgcctgtgttttcttatagacgtgtcagttttacaggtctcactttaagatctttgatctacttggagttagttttcatgaaaggcactaggtatcggtcttgttttctttcttctgtatgtggtcagtttcccagcaccaagttgttgaaagaagatgtgttctccattctgtatcctgccacatggctgaatttatcatttctagaagttgttcggtaaagttttgaggatctctaatggacagtatcatgttatttgcaaatagaggtagtctgacttctttctctatttgtatccctttagtttccatctcctaccctgttgctctagctggtgctttgagcacatactgaaagtgagtagggatagtggacatctctgtctccttcctgatttctgtcgtatcgattcaagcgtttcttcatttcggataatattgtcttgactttctgacatacagcctttactatgttccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtaattggtttccatggtcaccaaactgtgtgtgtgtgtgtgtgtgtgtgtgtgtgtgtgtgtgtgtgtgtgtgtgtggtgtgcctttcaccatgctcaagacagtctcagtagttctccctcagttgggcaggtctgttcatatgcacacatgggaggaatcagatgcattctttccattgggagtgtgtacagccactatgtgtgcaggaccttgaaggattgggtcactggactctgaagatgtctcagggtctatgtagacatgttgcaacacggttcctatcccttggaacataagaatctttgacaagaatccttgttaaaaatctcagtttaaaaatgaatcttggatctggagagattggcttagcagttaagggaatatactgatcttgaaggagactctagttcagttcccaacacccatgtcagagtgcctcacaaccaactgtaaccccagcttcttggggacccagtgccccctgtacatgcacacagagacacacatacatacatataagtacaaaataaagtgcaggcctacaatgaaacttatacttttccatgaaagtatttccaagctctggaatatatttattcagcagtgctttttatgcaatatgaaaaactggttaaaagctatgtgtggtttttaaaagcttaccactttaacttttttaaagtgtacatttcagacacattaggcacctgcagggcataccacagccacctaccaactccttccagaacttttctcaccccacccaaagaaaacacctcaccccttaagcaggcactgcctttttcttctttcctcagttcctggcaactgctgagccacctttagcctctaccaaagcttctacaggaagctttgggcttcctgggcattcggtataaacggggccattggatgtttgttccctttgtgttcctttggttgtgtctgggttatttttgttagaaccatctttaaaaagtccatccatatggttgtatgtgtcagtacctcgttcctgatctgtataaactaaatggaatgatatccaatgacatgcaagaagtttagtagagtgatagtcctctgtatgcacgcaccacacttggtttctgggtccatcagctggtgggcgtttggactgctttcatcatcgggctgtataagtatgtgtatatccacgttatcagtttttgctaagtacttataattctttgagtacacatccagacattaagcaaaactgtggcattgccagcgttgtgtgctcacctttctgaggagaggccagattgtttcccacagtggctttgctagtccacgtgtcccccnnnnnnnnnnnnnnnnnnnnnnnnnnnnnnnnnnnnnnnnnnnnnnnnnnnnnnnnnnnnnnnnnnnnnnnnnnnnnnnnnnnccgcagtgaaggtgttgttttagtttacaactccttagtgattggtaacaaccaacacattttcatgtatgtatacttttttaaattttattttatttttattttttcggttctttattcatgtatgcgcacaccccccgcaaacatgcaatgcttgaaaagatgttgcctggcgaattcaggttgtgttccgtcggaatttgtttcatctagaaaaccttctgtacttattctttgatggtttcatacatgtcaacagtatattttgatcacatccatccctcatatccctcccactcctcctggaccccacttcatgttcttcatgttcttcatgatcttcatgttcactctttttgtttaaaccattcacggagtttcattagtaccacccatgagtacacaggtatggggccgtcagctagagcatgagtgatatcttagcagccatacctccaaagaaagatggcactccttcctgagcagcagccaactgtcaaattgctcctcagcccgggtgagactttgtgagcctgtctcccctccgttctcaatgctgactggcttggttttgcatggcagacatagctggggctagttcacaggtctaacagtcatgacgtctctcgacacttctcttcactctcccagtgtcacagtctttctgcccctttgtccgtgccactgcctgagttttgaggcacttgatgtggataactcatttgggaccaagcactaaatagtcacttattcttagtggctctgaatagttacattggatgctgcccactgcacaaaggaacttctctagccaagactgggagcagcactattctgtggctataaacaaaaatatttagaaggcagtctggaaacacgtcaatttaggggaaaaaatgtcctgggtttccagccagggcttgcaacttttgcccaggtttacaatagcagacacaaatctgcacctgtggagcaggtctcaaatgcaagcagagagaagctggttacagacattgctgtcacactgcaccagtggacacgttccctggctggtctgcattatagcatacagagtccagtgctggaccactgacagtttaagacactgatgtgtttcctccctggcatctctgtagcaccttgcagcattctgaaatctaggcatcagggaaaccttcccatcaggtcatgtccttttcattcacattcattttcacatcaaaataagagacctcattaagtaattttgctctcggatttttcatgcacattaaaaatttaaaattccactcagcccccttcattggcccacctgtgggcaacacatgctgaacagtgaagaatatgaaaatagctgtaactttcagttcttctttattaactgcctgttataaatacagtcaatttcccctctctaataacagttatggaaactctccagcattttgaaatatcgtcagttcagtctctgtgagtggttttgtgtagagttctcaagtcccttggagacagctgggtccctttctagactcactgtgtgagatcaggtggtggaaattccctcctgaccttcgttttcttccccactggatgatgctggcatccctggtatttagaaattatctggagtccccaaaaacttgaaggaaggaaggaaggaaggaaggaaggaaggaaggaaggaaggaaggaaggaaaagaaaaaaaaaacacctctcccccaacctccatcacattcctgggctttaatcgccatagaatcccagtcaacaggacagagaatccaaatctaaaaagatgagagactgtgtgtggggtaatagggggtcacatgaccttggctttggttttagatacttcgacccccaagaattccttggtaaaataattgattcctttcttcagttcctcacttgtaagattgaaatcataagtttaactccttaggcaataacaagaaacaaaaatgagtctcatgtgcacgtgcacagtcagatgttcggtgtgcaggcatgttcggtctgcaggcatggtcagagggcaggcatggtcagagggcaggcatggtcagagggaaggcacggtcagagggaaggcatggtcagagggcaggcatggtcagagggcaggcatgatcagtgtgcaggcatggtcagaggccaggcctacccaccttcctttcacacatgggatttcacaatgagtaggacctttttcctggaacattagtttctgcatgtctttgctagattgatcgaagccattgtgagttgtggtcagaaaggtagagtctagtataaagtttatattgaaattattgccaagctggatatctttgcatttctttctactatgtccaagacagtacctagacctgagagggattagaacagtatatgcacgtgtgcacacacatacatgtgcacacacacacacacacacacacacacacacacacactgcaaaactgaagttacttgtttcctgaagcagtggtttccaatacactagacattcctttagcagcatgacaagaagaaatgataaaatgcttactagaagttccagccagaggctcgttgtcagtcgaaaggcaagggggacatagaagcatggaacaatacattgtagagaaaatcttcacctttggccttataatatacgtttttgttttgttttgttttctgtcaggccatgcaaaattctaaatttcctcctggtcagatcattagaattagggacccagtggggcagtgggattgttaaattttattttacttgcattttctttaagttgtgtgtgctgcatatgtacagcatgctcacggggttcctagtgtgcatgtataatggccgtcctcatcagtagctctgcaccttagattttgagacagtgtctctcactgaacctggagcctactgacggggcaagactgagcatgcgccaggagtcttctggtcttaactttagcaggactaggattacaggctgtgctggatagacttatgtcaacttgtgagaagctaaaaatcttctgagaagagggaacctcagataagaaaatgcctctggctctctggctatagacaaggctgtaggaatttttctcaattcgtgattgatatgggaggatccaacccattgtgggtggtgtcatgggtgggcttgtggtcttgggctcaataagaaattaggctgaacaaaccatgaggagtaagcctcactcctccatggcctctgtatcagctcttgcctacaggttctgccctgtttgagttcctgtcctgactctcttcaatgataaacattgatacggatgtgtaagccaaataaacttttttttcctactttggtcgtggtgttttatcacagcaatagtaacactaagacataggcacgcactgcacctagctttttatgtgggtgtttacacttgggtgttcatgtttgcatggtgagcacttagccaactgagccaacttcccagcccaggggcttgtctgacagtcgacttccctgcagacactcaacagactcagttttgcttagctgtgaagttgagcactagaactttagatgcagcccatgtgtcttcagtcaaagcccatgtcttgcttcagtgtggacctaactttttttttcccctttcatttcaggagaagaagattttccagatcccctggatgcatgcggctcggcacggatgggacgtggaaaaggatgctccgctcttcagaaactgggcgatccatacaggtgttaaaccttgccttgtttattcacacagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattacaaaaattctgcaaggagatatctttagatgtggaccttttatttcatattggaagctcgtctctgcttgttggcattctagtcttgtgtatagttggcatctcaattctaccattttattttccccctcaaactatatggtagagccagagtgaccatcttgtcacggcgtggcttccattgtctaggcttttaaaaataaaatgccagcaccttagaaatgtctcagcaaaatgggattgttccagcaaagcacttagaacagaaaggctttttgcacctcccctccttcccagcaggactggtagacatcccctccttgtctaatgtccctcccccttttccttatctttggctattttgctaggaaagcatcaaccaggaatagataaaccagatccaaaaacatggaaagcaaattttcgatgtgccatgaattccctgcccgacattgaggaagtgaaggacagaagcataaagaaaggaaacaacgccttcagagtctaccggatgctgcccttatccgaacgaccttccaagaaaggtaaagatgtttaccgactaaataaacgaaccctcagtgtccgtaacagtaccattttggttttctcatttctgcctctgtcatcactttccagggtagaatacttgtccactctagatgagacaatcctctctttactggccttggaaaaatgactttcaaggcaccaaaggcagaaaagaggcctttggtattttgatctcatatcaatgaggcagcgggtttcagaaagaatgtcatgtaagaacgtccatgtttctctgtccttccgtgaattgatccagaactacctttctgttgccacaggaaagaaaccaaagacagaaaaagaagagagagttaagcacatcaaggtaatctttggttgactagaaagcccctgttgtgaccgtattgtcatggtacctgttctgtctcatcaggaccttggcggaggctttggcctttctcctgctattgcgttttacatgcttttaacatctcctctgcatggacccacctgcagacacaagtccacagatactttgcctagtccagcgtcccagagcaaaaggtgtagatgatgccactgatccgcagagcttggcagtcccatgtctcagctccagacaccagcttgtatctaaggctgtgaaatatgactttagaaacatgtttgaaaatcagagaaaaaaatttttatctctaatagagatgtattagctctatatctgtcacaagccattaggttgggaacacagtagttcgtatactccattagcaagagtttcagtggttcattctctgctttgtgagcgataagtcccaggagttttccatggagacaggtctgtgggcttaaggttttcagttgactaggttggtctaaccacacccctatatttcaatgatcttagtgcatagaaggtgtagtagcccttgttaaatacggaggaaggtgtcagataatcccatgcccgactggggaggtccatcagttgttaagcaaagagcacacagcacagctagagacccaaagaccacccaagagatgatataagtgcctggcttctgtgtacagagtaagggactgaagaatgagttgactggcctttctgtaagatcccatggctccttagcactgaaattgaagtggatgtaggacattctgatttatcttaaaaaaaaaaaaccacgaagggacataatttaggtatctcattagacttcagaagggacagcatcctgtgtgtgccatgagggtacttggctgctctccaggattctccgcccctgccaggtaccttcatggaaaatgtagtagtgtctgtgtagaacctatccacatcttccatctactttaaattaccccttggttactttttatacctaatatgatatgaaagttgttgtgttttatcatttagataacaataagaggaacaggtctatatatgttttgtacagaccagtgattggttgaatatgtgggaaatatgtaggtctagaattgtgaatacatatggctgtctgttgttagacttttttttttttaatgtgtctaggctgcctacatgtatgtctgtgcactatgtacttgcctggtacctgcagaggcctcagatcccttggagctggagttaaggacagttgtgagcctccaggtagatgctgagaattgaacccgggtcctctcagagagtagcgagtgctagtaactctaaagccatttctccagctcctgtagttagagtctgagggaaatcttagctagctgttcaaggttgagaggtgcttatctctgtgatggaaaataaatattttaggtagactagcagtgacactttgtttcatttttgatgttttaaagtttctgatttattttaaaaatagcaccggactggggactggagaggcagctcagtggttaagactgtgtctaggggacctgagtttggtccccagcacctatgtcaggtggctcccaactacctttaacttcagcttcaagagatccaaagccctcttctggcctctacagacatacacctctctctctctctctttctctctcaatctctctctctctttcccccccccatatccctctctctctcacacacacatgcttaaataaataattcaataaatagcataggactaatgattaattttgttgtaatttttattgtggaaaatttttatacatgtaggaaggagtaagatttactgtagatcaccctctaattttaatatcaatcaattcttgaccagatttgcttcatcagtgcttccatcctttccctcactttcaatatcatcatagatatttgacccattttgactacagaaacaatttgtgatagttgtcaaaatattttcaggcaaatctcaaatatgatgtttcttctgtaagcatttcactatatatttttaaaagtacatgccctttaaaaataccatgctgtcattattttagctgatgaatttgacaggaatccctctgtatcgttaaatatctagccaatgctcagttttcctattatcacagaaatggtactacagttttatatacatatatatctgtaatatagttatacatatatacgtgtaatatatattttatatatgtctatttgtatctgtaatatatatgtatatattaccttaactaatacccacaccatcagctgggtgtggtagagagcacatatctgtaatcccagcatccaagaggctaagttagggagatcttgagggtgattgtcctgcaccatataatttgaagaaaactttgtttcggaaaagaaagagaaatttacctgagaaccccataggaactttttgctgtatctcaagaatttttcttttttaaaaataataccttttaatggtttatttttacttcctgtgcgttggtgtttggcgtaggtgttgtccgtgtgaggcagtcagatctggaactggagttgctgacagttgtgagctgccgtgtggttgctgggaattgagcccaggtcctctggaacccagaattttctttcttccttccttccttcctttctttcttccttccttcctctctttctttctttgtttctttctttgtttctttctttctttctttctttctttctttctttctttctttctttctttgcttgcttggttggtttttctttgagacacagtgtcactgtgtagcctaggctagccccagacttgcagcagctctctgccctcagcctgtctagtactggatcatggaccagagccaccacagccaccacgagtgaccttgctttcagtctagggacattttctatgtctctttttataaaacaaaacaaaacacagcattattttctccctatgattataaaaaaactaattattagccatactgttttccatggtgatatttttagacctgcattttgagtgtcccaaatatatctctacatctcagtaagagatgtataacttttttttcccaccacaaatacctagtttgaagaattcactgtactcttaggtgtgattgtctcatatttagtatgttcacagcattcagtgactagcatagagcaaactatacatatctgataactgagtgggagcatgaacatttattaaaaacgcagatatatttattctgtatggtgggagtcaggggctttacagtacagatttaatttcataattgcagcgagtagaaaaacaacagcagaataacatttacttttcactatattttccccacacgtaaccactatattccattcagtatcaaataccaaaggttatatggctggccgttacgttatgtctctttaagacagacacactacttccggtgaagcagtcaaggctgagacatgcagcatcccggggctgtaggaatgtaaggaaatgtgcttcctagggtgggtggcatgtgggggtcctcgtaagaaaagggtagctttggttacatcagcctcgtggggccactaaaatgtggtaggcacagccctggtgagacttagccatgttcatccaggaagtgagcggccttaaatgaagccacgtgggtggagctcctgctcaggagcatctgttatgaaatccttgtgtaacaaagctatgattaacactgtgttcctcaagggacattgttccttcagcggaaggctgatgaatcatacttagtgcagcctaacctttggatgtagctatcttttgcatttgtcttgcatgcagtgttatagtagaacgtgtatcaggccggtgggtttttcccaattctggggtttatagttgctaaaggcattgatcgatctgcagaatgattccaaagttaattccacaatggctttgggatcattacagttaaaagattgtctttaataaaggattaatagtctacttttttgttaaaagtctaagtatgtaagctgtgccaggtttgatggcatatgccctgtaatcctagcaactgggaagtggaggtagagggtcaggaattttaaggtaaacctaggctacataggaagtttgaagtcagcctgtgctacaataaatcctggttcataaaataaaacaaccaccagccatactgggccatggacacattcactgtatgttccttgctgtttcagaaaatagtttctccaaggatccgtggagggaggacgttgtcagagttaaaatggagtcactgggcatggtagtgttttcctgtcagtctggccttgacaaggctggagcagggggatattaagtttaagggaagtctgggcttcatgataaacccttatctcaaaccaagatgaagttggttgtgccagctcttcccaaagtcaaggggtttgaagaaaatgctttttatgcatggatagctgacaataaatatgttctaactttccttcattccaacctgtgttcatctaaacacagacaaattccacctcaaacagaaactggggtgttgtaactggcttggcagaaatgaaggtatttttgaagagaagtgaacagacaattcaaacagtggaccccaaagaaatgggacgtttccccagaaatctcttgcagggagaaggaaaagcccccaaccaatggggaaacttgtctcccagtgagatttcacaccatcctaataatttgttagaccacgctttcatctcgaagcctgttctgcaagccatgtttggtcgcccatcctcaatagccacttaaaagagccaaattaatagtagaaaactgaaaattgagattttttttcaatatgacaacattgtggagaagaacagaaagatccggtaaaccctcaggtccatctttaagaacctgaaaggccaccatcttcagggtcccgaaaggcaataaaagtttaaatagaagacagagaacatgaacatctatctacacagtgctggtcaaggtgtggtcctgcccaccactgacccatcatgttctgggcttcagttacattttgtaaggccatctaattggaagagctacacctctaaaatatcttcatttttatcactgtctatctgagagtatattctgtgtgctcagtgggccacacatcactaaaataaactacctctgtggcgctacctgtctgacctaagaaaattagaataagagaaacgttagtaagcagtctcagactgaacagtgaatgtatgcgtttcagaaaataccatggaacagattgccctggtacaacagattgctctgttccatataggcaagaccaaggacgataaggctaacagtaggcagggtggtaggtgttgacaatttttagttcctctaaatgatactattcccttatttagctcttcctgggatggtcagagttttccccttttccctatctaggaagtacaggcataggggatgagtcattttcccaagatggcatggctttctggagtttgagaactcttctgggagctgcagaacttgagcctgaccctggggagggaaatgtggcccagatcagataatgctcactccttaggaagggatgcttcatgagtgaaggcctagaggtcagcgttatttggtttcctctgaatgaatatggaaactggcttaatttaatcaggggcattgtgtggagaacaatggaaaataaagatgcccaggtaagatggatatgaacgagtgcttcctgcatcagggggagtgggggggggttggttgcagatgaaaacacaagcatttccaaatcaacgcatcagtgttcccatggaaaccgaatagaaaggggcgtaatgtcatttggtggaagtcactggtctgtgttcgttccgagggcagccatgtggttagaaattacagaatagctggtgtccattctgcagacctttctcacaagactgtttcctgcaacagtacattcctgattagacaggacgattggggcagcagcagctccttccttgcttgggaaaactcttcaggtttaagactatgatgaccagggaacctgtatcggagggcgacttgaaaacacatcagagctgctttggataaagccagctaggaagatgaagcaggttaggagctatccatcactggccattcccacccccctcccctgctggtggactaagtcacttctctggacacagaaagggatagctttcatcttagaggaaagaaaacatagtttattctagagctaaatttgagtgaccatggctctggaacaccgatttaggtcactccagattccatgttccaccgtggaaacagctttgtgaggttttatagttatgcagaatcaagaaagtcctgtcatggcaaatttaaaccacatcggtgggtgcctcagagaggctttctcggtgatcaggggaacctttcccataggcctcatatctgatggcattcttactttgggagttgttagaagctagtgttgtgctgtgaggcaacatagttcaaaaagtgtttattgactagtcccaccatgttggttctgacacagtgtgggcaaggatagctattaaggaagctaaagctagctcaagatgagctaattagtcctacaccatttcagtctccttatcttactgaagttctactcagtgtatcagtctctttagatgcagctccttgccaggaagtcttgttaacacttctttaggaaatcaagttgagctacttggggcaaaggtttggagcccagtggatcaaggtaaaaggaagaaaatggcagactgcacagtaacaaatatagacaaagatggtgaccgttgggatggagcccaggggacattgcttccgagtatggagcgtgaagacaggagtagttaaaagaggaagatacagagaaggaatactaggtctggagcttgtttgtgagtgaaatgacatctggcaagcagatgtcatgctgagtgtctgaggcccaaaggtgtgaccctttactccagaatgacattggaagtcttgaaaacaggcccttttccaagacagaaattctccgagatgtagggaaagaaaagggagtgaggaattagccatgggaagctggtcagttagagatgagtaaagatggccttccttcagggaaggaaaggtggaggcaggctggaggctgcttggcagcatttgttctccatgatgctatggctgctgaggtgacctctgcaccctctagagttctgtctctgcctttcttcatgaagctcagcctggcccttttcacagagacctggaggcactcttagatctgaggtcctcagattgactttgagagagtagtttgagataggaggtcgataggaatgggaaatatacttagtgccctgggccctgggaggatggatctagacacaatgctttagcacagggatgaggcagaagagacttagagcagaggggtaaggtgttccactcactggttcctctgttgctttctctcacaagcccagctagatggcaagcccatctagcaagccaaggccagagaccaaccaaagtgaccctgtgtcgggtgttaaggatagccatcagtcacccttaaaactctctgcagtacccatttccttttacttaaaaaaaatcttttaagctacaccaggtctagattttgtaattacagaagatgcctttgagcctaaatatttggcagggttaatttagcagtgcagagggaatctacctgagagtgggttacttgtttgtgtttgtttgtttgtttctttgtttgtttttgttggagtgaggccagaggcttagaaaccaatgtagccccaggtaagctgatttagaagagaacctctagcatgatgctcaggtctcaatgggctaggccccagtgcaggggtaaagtgagggagtattgagccaggcagaggtgggtccccagagataaccaggacaggccatccatcttttacactgcctctgcatgttcatagagaaccatcaccttttcccacagtttggaacccttgggtttttaatgttatttagggtttttgtaaagatgattgtattgccttatttagtatctgtttgtatgtctgtgcatgtgcccaaacatgtacagtgtgtagcgccatacacagtggaggtcagagaaccccgtgcctcttttattcttatttttcaacctcttagcttttgatatccccatttctaactgtttcaaaagtcttggctgagttcttgaggaagcttccacaccctggaaggagacttgtcagggagctagcacggcacataatgttctatatgtcaccatcttgtccactggagcactgcttctcagccttcataatgctttgaccctttagttcctcgtggtctggagacccccaacagtaagattattttcatggctacttcatagcttcaaatttgctacttttgtgaatcataatgtaaacatctgatatgcaggatatctgatatccaatgatgcgaagggatcattaacttccccaagcaggtcatgacccacaggttgagaacggattctctggggtgacagaaccaatgagagtcttcccagagtggttgtaggaggagtaagacattagttgagtgttctacctcaggcaggacaccaggtaggcagagagaagcagcagcccactccatccatcctgttctccatctggatgggtgcagaagatgaggctcctgcatcacaccaggctaaaagtatcatgatcttggaaaatgaacttagtgagtcctaattttgagaagtgacaaaagtgtcgtttgtcaccaatagctacactatagatcatgtgaaacacttagaggtctctgttgcaaagtcggaatagttctattttcagataaacgcaaacctggctgttctgttactttgataagaattctagaaatagaatcacgggtaagaaaggaaacaaaaggagaacgcacaaaagcagttcttccagccctttgtctagagtcctgtacttagttttcttggggaggaattgaggaaagggcgtgccataatggaacgtggaccatgattgcggagggaaaaatggagcagggaccattgggagccccaaagaaaagatggcgcccacggtgaggtgcgcatgtgcagggtctgcaggtgattcaggctgtcaagagggaggcaaagtcctcgctgtcctgtggatggagcttaggggaaggggcttgagaaaggacccttggatatgggaagaacagtttaactggtgaccttcgatggtagcgagtgttctttaagaataaatgtcttgtctatattcgtctcctttaagcttctcctcacccggtggcatggtacccattaccattctcagccgccatgtggctaaaatgactcaagaggaattaaagggttaaattcagcctgtgagaagcagaggagccaggcttggtcacctggtctgattccagagtcatcttctgggggcttcattctgcagctggaggcaggacaggactataggcctccccaagggtgtgcttgaggaggtggagggagccgaggcaggcatttgtctagatgtttgacaatcaaggaagggaaactggtaagatccctccccctcttcctgaaagaacaagccttctcttggaacttactaacaagggggaaatgcaagacgctgagagaaaggggtgaaatttctgttcagtggctctgcccttgggtgttctgggtatttgacctatggtatagtgggtaaaccctccagttagggctttttgtttgtttgtttgttttgttttgttttccttaagctgagctgagcatcgaggtgatgcccttcagataaaatcatcaagggagtttgccagaggatcgtgaggactatacagagtttgatctcaattccccagtgtgaccaattgataagaatgccctggatgccttagaatgcccagcactcctgactttactgctttacccacaacgctcctctgcttacagcccctatctccactttcttcctccagctatttcttccattttggattcctcgggagttgtccgactatgtggcttttgtctggcttattgctgtctctgaaacaaatgtagtcttaccggaaggaaataccctcatcaaagttctgagtctcaatcatactttagaactggttttctttggttggttggtcggtactctcaggagatggagggttcaagtacacttgaatgaagaacagatacagagttcaaacagggaaagaatgtattctcctttgtcctcgtcagtgtcattatgtagtagcctcttgggctgggcgggagttttaggcacaggaaggatgttgatgtgacggtgtggaggtgggattacctgtctggtgataggccagtgagaggagacttcagctaaggttgtggctcatgttaccatccagccaccagtgcagtgttgctcaagtggccgtagcacatgatgaagtgtgctcaagttctcacttccattttccttggagctccggtcactggctcatcacctaggcagagttcattttaaagaagtgattgcaaaagttagaagcatgccttctctgcaggaatccaggagtgggttctcctgagtactgcctcagagggggaggaggctcaggacccaggcaagggacgcacagaacagtgctacggctccgtccaaccacagaacagtcttctgtgtatctgcagctgcaggtatttcccgagggcaagccagatgtgctgagaacatttccttggaggaaaaatgaaagaaaccgaatagctagcttctttaatgtcaggctgatttaaagagacaggggatgcatttgggacatgacacgaatgactaaccccaggattcaaccaattagacagggggagaattgaagctaagaaaggggagaggaaggaggtgttctcaattcttttttcttttcttcttcctagcaagaaccagttgagtcatctttggggcttagtaatggagtaagtggcttttctcctgagtatgcggtcctgacttcagctataaaaaatgaagtggatagtacggtgaacatcataggtaaactgttttgacatcttctttttatactcacgagcagcctttgaggtttaaactctgtacaaaaaaaaaaaaaaaaaaaaaaaaaaaaaaaaaaaaaacccagtaatctcaaaataacacagtcagtaagaggaggtcttggaacgtgtccaaatcccagtgctagcccctaggtttcagagcttccacaatgagatatgaaggtttgtagaggagtgagaaccaagaaaagaaggccaggcatacaagcttcctctctggtggctagcggttagcagcacttcatcaatcatggccagccatgtggacaaaatgtcatttgtttaacttgggagccaaggagaggaaagaccatctctgtgggtccccttagcattgaccttatgcacatctgcccagaggtggcacacatttcataggccaagaaactgaggcacagaaaccctctgtcaaaggactgactggctcagtagatttgcagagacttttccaccctcgagatgcagttctgggaatgaagtaaacagggagcgatctgggctctattcctacttttgtggggagcgagtaaacaggcaaagccacaggtaagcaaaggatcctcatttgtagtctgtgatgcaaaggaagaaaagggaggtgactaggaattacctagaaactggatttgcatgggttgggagggtgtcctcagaagagtgaccttccgccatagtgcctgtgtgaggaggagcaggtgacatgcggaggcaggcaggatgctgacagaaaccctacaaaaaagcatctgaaggaacagaaagcagccagtgtcacatagtttcagaagtatggtgactgctcatgacatcccctcagagacagcggttctttgatggctgttgtcagcttgaccacatctggaattaactaaaacccaagcagctgggtccacctgtgagggatttttttccttaattaaatcctttaaaacaagaggacccacttttaatcccgattgtttgaggtgggacagtccacctttaatctgggccacaccttctgctggcagcctataaaaaggacatggaagaaggaggatctttagttttttgcctccttgccctcaccctcattggcaattccattccttcactggcattagagccactttttcgggattctggtacacactgaagaacagctgagatatccatgcttatggactgaacaaatgctagattcttggacttttcattggtagacagaccttatcgaactagctggaccacagtctataagccactctaaaatcctttatatgtgtgtatatacaaatatatgtctgcatatatatatacatacacacacatatatatacatgtatatgtgtgtatatatatataatttttttctgttggttctgttattctagagaactctgactaatacagattttagaatcagaaatcgctctagaacaacagaagtataatatgcatttttaaaatatctggaataggcttttcaatatggcaatacctacagttattgaggcctctcctgggaattcaaagaatattaaaaagatgtgaactgttttataaactgaaagagatgagtgcatttgggtatcctaattcaccagttgtgagaggcaacagatgtggtggcccaggatagaaaacgtttgacagtttatggaaaaataaggaacatgatgattgttgagtacccctagtctctctagatcatttaacagtggaaaataatgagctccgaaataaatctaaccaccggttagtgtctctgaatagtgtgcagaacaacagtgtaaagctgaccagctccaaatgcacagaaacagcctaaaggtttctaagtgtgccccggtagagaatcgtctctctggcagccacagagcacaagttgcagaaaaccaaaccaaaggcctcattgtaaggatgactgagtaacagtgaaaattcaagtcccagtcttggaggatgttggagtaaggacattaattggtcaagaaccggatcctgtaacttgggatggaaatatgtggggagactcaattgaagttgagaactttgagccctcaggttcttgagggtttatttttacctgaggtcttagtctctctaccctcagcagatagactcacactaccccctctgaaattttgccctttttacctttgaccaaggaaatgaatccctcattgtctgctaaaccagcagtaactttctctgaaagagatgccagccatgacaatactgttgtccctcagggcccaccaatacttacctctagacctataatcagacttaaggctaagcaggctcctagaagggagccggaatgtgtggatcacaaggaagtgcaccccatacactactaaagagtttaacaagtttgctgatcgtttatgcagaactctaggaaatatgtgtggggttttttgggtgtgggataacgcaggaggaacataagactgagtttattgatacggtccctctgaagggaggtcctaggtttaatacggaagtttgctcagttaaaaggactgtgaaaattttgtttgaatggttggtgaagcacttgtcaaaagatggcctatcaaggaggaattggagacggctgatcttccttggcttagtgttaatgaagggcttttacgactcagggaaattgcagtgctagagtggacatgccgtccttcacataggaaggcccggaagatgcgttcttcactagtcttatgtaagacaattaaattggtgagagggccctggcatagctgaagagctttgtttccctttttctcgtgtcagatcttagggttggaaacactactgctcagttggatgaattaaatgcagtaggtttaattggggcacaaaggggcaccgaatagccagaggtgaggtgattgtagttatcaccagcatagaccaagcaatattcatagtgtcctgagctataatgggcgatgcagataaagtaaattttataattagatgactcatgtggactttaggtgctggctaatcaatatggtgttcccaggcatgaagtagataaaaagcccactgcatttgtagttactatgtgtcagtggaaaaattctcaaacaaatgaaggaaaggttacaatggatagtggcaaaaggcaattccagcctataaaccagttttcaggcttcagcccgtttgcagacccagaacccttggaatgaagcgatggcccctaaggaaggatcttgataaaaggagttagtctttctccactccttccccccagaaggatatatggccttttaccagggtgactgtaacgatcagaaaggaaacagtcagaatttccagggtctattggatactggttctgaattgacactgagtctgggagatttcaagaaacatggtagccctcatgttaaagaaggggcttatggaagtcaggtgattaacagagttttggatgaagtacaactaacagacccaaggggtccctgaactcatcctgtagttcatttcccagatccagaatgtgtaattgggatagacatctaaatagacgttggtatgatcctacactggttccctgtggagtgagggatattatggttgaaaaggctaaatggaagccattggagttgtctcccccagggggaaataatgaatcaaaggcaatttcccattccagaaggaattgaagaaatgagtgccaccctccaggacttgaaatacacagggaccgggtggttcccaccgcatctccctttaactctcctatatggctagtgcaaaagacactgtatcatggagcatgactattgaaaacttaatcaagtagtgactcccaatttgtagcatctgtactagatgcggtgtccttccttgagcagattaatgcagcttcttgtacatggtatgcagctgttgatctagcaaatgcctttttcttggtacctgtccgtgaggaccatcagaagcagtttgccttcagttggcaaggccagcagtatacctttacggttttactcaaggacataagaactctacagccctgtgtcacaactttgttcaaagagatctggatcatatttctcttccaaaaaaatatcacattggtgcactatattgatgatgatatgctgactggactcaatgagcaagaggcaacaaccactttggatttttctgtaacacattctcatcaaaggatgagaaataaatccaaccaaaacttcaaggagtccaatggtgtgtgtcatgtaaaggtattctttcgtaggtgaggaataagttattgcactcggtccctgttaccaacaagaaagaagggctgaatgttatgacagttagtgggtctgtttggattcttaagacagcctattcctcatgtgggtatgttattccagcctgtattccaagtgatttggaaagctgctagctttgaatgaggtctgaaacaggagggggctcttcaacaggtccaggctgctttacccccttggaccatatgatccagcaggcttagtggtacttgaggtgtcaatactgtttggagcctttggcaggcccctagaggtgaatcacagaagagacctttgggattttggagcaaggctctaccatcatcggcagacaactcttctttctctgagagacagttctttgcctgctgttgggccttggtggaaactgaatgcttgacagttggccccaaagttaccatgcagtctgaacttcccgtcatgagctgagtgttctctgatgcaccaagttataaaacagggtgtgtacagcagaaatctgtcgtcaaatggaagtggtatatatgtgactagacctaggaagtcctaaaggcacaaataatttacaataaggaattgctcaaacacctatggtttctactcctgttacagtgtcatctcttcccaagcatccacatagagcctcatggggtgtgccctatgatcatccgagtgaaggaaagaagactagggcctgattctacacgctatgcagacgttgcccagaaatggacagctgtagcattacaactccctttctgagacaaccctgaatgacatcagtgaaggtacatcttcacagtaggcagagattagggtagtccccatggtcatacagtttgcttggaaggagaaatgaccagatgtgaattgtcactgattcatgggctgtagccaatggattggctggatggtcagggacttggaaaaggcaaggttggaaaattggtgagaaagacatttggggaagatgtggctagatctctccaaacggggaggctatgtgaagatacttgtgccccatgtaaatgatcttgaaaggtgactttggcagaggaagcttttagtaatcgagtacataggatgacccattctgtggacagtcagcctctttccctagctatccctatcattgcccagagaacccatgaataaagtggccctggtggcagagatggaggttatacacgggcttgacaaggacttctactctctaagtttcacctgactacagctgctactgagtttcatatctatcatcagaaaccaacacagagtcccagatactacaccatcccctggagtgaccagctaatgacctggtggcaggttgactacattgggccccttcctctgtggaaaagacaatgctctgcccttactagagtagctacttattatggtaatggatttgcctttccttcatgtaatgcttctgtcaaaactaccatccatggatttacagaatacatcacttttctaccaccacagtatttcacatagtattgctactgatcaaggaatttaactttacagccagagaaatgtgatagtggtaccacaattgtggtccactggtcttaccgtgtctcccaccattctgaagcagctagcctgatagttaaaatggcctttttaaaaacacagttgtagcattaattaggtggcagaagtctgaaggtctgggcaggattccccaaaggtgctatatgctttgaattaatgtctaagatatggtacaattttcccatagccaggattcagaaatcagagggtagacaaggtagttccactcactgtcaaccctagtgacccataaggaaaatctttactttctgttcccatggccttaaagtctgctggcttagaaatttgtgttgcagatgggagagagctcctgccaggagccacaacaaacatttcactgagctggactctcagactcccttctgcctacttagggcttctgatgcccttaaaccaaggctaagaaaggaataacattgttaggaggggtgattgatccagattaccatggggaaattggattgctcctccacaatggaggcaagaaggattatgtctggagtgtgggagatcctttagggcatctcttggtgcaaccacatcctgttattaaagtcaataggaagctacaacaacttaatccaggcaggatgacaaagggcacagacccttcagaaatgaaagtatggatcactcctccaggaaaaaagccaagacttggtgcaggtcttgccaagggtggaggaaatacagaatgggtagtagaggaaggtagttataaataccagccaaggtcatgtgcccagttgcagacatgaggatgataactgacaagagtatttctgtcatattttggtaagaaggcatttgtgcatatatctgagttttctgtccttgatttctttatcatgtaatttaacaccaattaagagcatatcagtggtcatagtatttaagttctgagatcccaaaagaatgttcgttaagacacattgccacctactgcaaaatactttaataaattttagtatgtaaatactcacttttctaacaatacttaacattttatttctaaaacaaagtattatttaccttttgttttagataagatataaatttttccttagtcggaattattttactatattttattattaaaataagttttaaatttaaatatattttatcatatttatctctttcccaagtctttttacatcccaagtttgtggttatataagggataattatatcataattatgacctggttaaatatataatacatttgtcattatatgtatgatagtcatatcatgttatgtataattatgagctggttattgttttcatttggaaattaagcacgacataagatacgatttcatgtcaagttaactaggggtgaacttttggtggttattcatggctttcaacttgactatatctgtaatgaaccaaaacccaagtgtctgggtacactgtgagggtttttttcttaatcaaataatttgaagtgggaagatccatttttaatctgaatctctgatatggaatgatgcacctaatctagctcttttgaggtgggtatgttcacctttaatctgggccacaccttctgctaccagcctatatcaaggattggaaaaagga

SEQ ID NO: 1266 - DNA, 2435 bp, Mus musculus
tctcaggcaagccggggactaacttttagttttgctcctgcgattattcaactgacgggctttcatttccattttacacaccctaacaacactcacaccttgcgggattgtattggtagcgtggaaaaaaaaaaagcacattgagagggtaccatgccggtggaacggatgcgaatgcgcccgtggctggaggagcagataaattccaatacgataccagggctaaagtggctgaacaaggagaagaagattttccagatcccctggatgcatgcggctcggcacggatgggacgtggaaaaggatgctccgctcttcagaaactgggcgatccatacaggaaagcatcaaccaggaatagataaaccagatccaaaaacatggaaagcaaattttcgatgtgccatgaattccctgcccgacattgaggaagtgaaggacagaagcataaagaaaggaaacaacgccttcagagtctaccggatgctgcccttatccgaacgaccttccaagaaaggaaagaaaccaaagacagaaaaagaagagagagttaagcacatcaagcaagaaccagttgagtcatctttggggcttagtaatggagtaagtggcttttctcctgagtatgcggtcctgacttcagctataaaaaatgaagtggatagtacggtgaacatcatagttgtaggacagtcccatctggacagcaacattgaagatcaagagatcgtcactaacccgccagacatctgccaggttgtagaagtgaccactgagagtgatgaccagccagtcagcatgagtgagctctaccctctacagatttctcctgtgtcttcctacgcagaaagcgaaactaccgacagtgtggccagtgatgaagagaacgcagaggggagaccacactggaggaagaggagcatcgaaggcaagcagtacctcagcaacatggggacacggaacacctatctgctgcccagcatggcgacctttgtcacctccaacaagccagatctgcaggtcaccatcaaagaggatagctgtccgatgccttacaacagctcctggcccccatttacagaccttccccttcctgccccagtgacccccacgcccagcagcagtcggccagaccgggagacccgggccagtgtcatcaagaagacatctgatatcacccaggcccgtgtcaagagctgttaagcctttgactctccctggtggttgttgggatttcttagctttgtgttgttctttgtttgtattatattattttttttctctatgatacctatcttagacacatctaagggagaaagccttgacgatagattattgattgctgtgtccaactccagagctggagcttcttcttaactcaggactccagccccccccccccctcggtagatgcgtatctctagaacctgctggatctgccagggctactccctcaagttcaaggaccaacagccacacgggcagtggaggtgctgcgttgcctacggtcaaggccagcatggtggagtggatgcctcagaacggaggagaaaatgtgaactagctggaatttttttattcttgtgaatatgtacataggcagtacgagcaatgtcgcgggctgcttctgcaccttatcttgaagcacttacaataggccttcttgtaatcttgctctccttcacagcacactcggcgaccccttctgtgtccactaccccactacccacccctccctcctcaacccctccatcccggtcctctatgcgccccttccccccaaccaatcccatcacaacctcttacctatcctttccctcccaaccccttctatcccagcccaccacctaccccactcctccccaactcctccattctagcccattacccacgcctctctcctcagcccagcctaccccatcccaccctgttcctttcctccagtttcctctcctcaaaggcaaggctctacatcttggaggaggaggaggagaagaaaatgagtttcttcaccgctgtcccattttaagactgcttgaataataaaaaaaaatctttctaatctgctatgcttgaatggcacgcggtacaaaggaaaactgtcatggaaatattatgcaaattcccagatctgaagacggaaaatactctaattctaaccagagcaagcttttttatttttttatacaaggggaatattttattcaaggtaaaaaaattctaaataaaatataattgttttttatcttttctacagcaaatttataattttaagattccttttcctgttcatcagcagttgttattacatcccttgtggcacattttttttttaattttgtaaaggtgaaaaaaaaacttttatgagctcatgtagcaatcaaattatcctgtggattgataataaatgaatatggtatatagttaaagatttt

SEQ ID NO: 1267 - DNA, 1050 bp, Mus musculus
atgccggtggaacggatgcgaatgcgcccgtggctggaggagcagataaattccaatacgataccagggctaaagtggctgaacaaggagaagaagattttccagatcccctggatgcatgcggctcggcacggatgggacgtggaaaaggatgctccgctcttcagaaactgggcgatccatacaggaaagcatcaaccaggaatagataaaccagatccaaaaacatggaaagcaaattttcgatgtgccatgaattccctgcccgacattgaggaagtgaaggacagaagcataaagaaaggaaacaacgccttcagagtctaccggatgctgcccttatccgaacgaccttccaagaaaggaaagaaaccaaagacagaaaaagaagagagagttaagcacatcaagcaagaaccagttgagtcatctttggggcttagtaatggagtaagtggcttttctcctgagtatgcggtcctgacttcagctataaaaaatgaagtggatagtacggtgaacatcatagttgtaggacagtcccatctggacagcaacattgaagatcaagagatcgtcactaacccgccagacatctgccaggttgtagaagtgaccactgagagtgatgaccagccagtcagcatgagtgagctctaccctctacagatttctcctgtgtcttcctacgcagaaagcgaaactaccgacagtgtggccagtgatgaagagaacgcagaggggagaccacactggaggaagaggagcatcgaaggcaagcagtacctcagcaacatggggacacggaacacctatctgctgcccagcatggcgacctttgtcacctccaacaagccagatctgcaggtcaccatcaaagaggatagctgtccgatgccttacaacagctcctggcccccatttacagaccttccccttcctgccccagtgacccccacgcccagcagcagtcggccagaccgggagacccgggccagtgtcatcaagaagacatctgatatcacccaggcccgtgtcaagagctgttaa

SEQ ID NO: 1268 - DNA, 96593 bp, Homo sapiens
agttgaatatacttcttcttcttttttttgagacaaggtcttgctctgttgcccaggctagagtactgtgacaccactgaaaccgacccaatagttccatagacagtttttttcttggaaaaccgtatcaattgatccttctggtcttaaagcttgaaatttacatttgttttatctgagcttcttcctcaggaaaggacctccaggtctggcaaaaagtacctaagaactgaaacttaccagctaatcatatccagacaatgagatgccaggccctcattcatcatgattgcttccttgcccctccctagttcctgctttcttacacattattacacatcttccctgctacataaacccctaattttagtggccagggagatggatttaagactgatctcccatctccttggctgcaacacccgatgaaagccttcttccttggcaataattgttgcttagtgattggtgattggctttctgtgaggtgagcagcgggacctagactgaacccctggcattttggggacatggtcacggctcactgcagctttgaactcctgggctcaataaatcctcccatctaagcctcccatgtagctgagaccacaggctcgagccaccacgcccagctgatttttgtaatttttttgtagagacggggtctatctgtgttgctcaggctggtctcgaactcctggtctcaagcaatcctcttgccttggcctcccaagtgctgggattatacacgcgaaccatcacacacacctggcctggcctagcttgttttttttttttctttttaaagttgttgtgtatttgtgtgggcgtgtttggtaaaagaacattaattaattttatttatttgtggaaatggaaattggagagaaagttaaaggggaataaatattttgacttaggaattcaaaaatagaattaaaaagactgaattgttttagagtgttacaaatgtgtcatgcaatagactgagagggcaataaagaacagttgaaaattcctctaagaaatcaacgacttggcaggtgcagtggctcacacctgtaatcccaacatcttgggaggctgaggtaggaggatcatttaaggccagaagtctgaaaccagcctggacaacatagtgagactctgtccctacaaaaaataagaaaattatccaggcatggtggtgcacacctctggttccatctactcaggtggttgaggcaggaggattgcttgaacccaggagttaaaggctgcagtgagctgtgattgtgccattgcactccagcctgggtgacagggaaagaccctgactctaaaaaacttttaaaaaaatcaacaactgaagaaattcttgcatttcattgatgttgcagagacaactgggaaatgtatagtgtcagtttttaaaaccacaagtcgatcttatttagaaccctttaaagtcttcctattgctcttaaaataaaatgcaaaccccttattctggtgtctcccacctgttcaccacatccctgtcctctttctgtcacacaactctgaaatcagtcatttcctgtctgttcccagaatattgccagaccctcttgcttcccagacctctggccccactctttcctctgcttcggtgaagttggtacctgtggagggtcgaattgtgttctcctcctgcaaattcatatgctgaagtcccaactcccagtacctcagaacatggtcttatttggacataggttagttggagatataattagttaaaatgaggtcctatgggaatagggtgggctccttatccaatacgatcaatataagtgtccttatcaaaaaaggaaatgtgggccgggcgcggtggctcacgcctataattctggcactctgggaggccgaggtggagggatcatgaggtcaggggatcgagaccatccttgctaacacggtgaaaccccgtctctactaaaaatagaaaaaattagctggacgtggtggcgggctcctgtagtcccagctacttgggaggctgaggcaggagaatggcgtgaacctgggaggcagagcttgcagtgagccaagatcgggccactgcattccagcctgggcgacagagcaagattcagtctcaaaaaaaaaaaaaaaaaaaaaaaaaaaggaaatgtggacacagacacatgtgcagggagaacaccacataaccatcaagacagagattggggtgatgcatttacaagccaaagaatgcccaagcatgctggcaaaccaccagaagccaggaggtgtggaagtctcccccacagccttgagaaggaaccaactctgtagatgccttgttctcagacttccagcctccataactataagacaataaattttggttatttaggccactcagttgtgggactttcttatggcagccttgacaaactaatacaggactacatcattcttcacgtcttggcttaaatctcatttcctcagagcaagcttcttgaccacctagttgacacagcattttctaccaaagcgcctgttgatttccttcagagcactgagacaaacctgtgactattgtgttggtttgcttgtttatttgtctgttgccttcaccttcactagagcatcaggggcatgggcgcaggggtcttgtctggctcttgctttcttcacagcagctctcagagtgcctggagcatcccagtgctcaataaacatggagggtaaatgacgccaagatgcatcaaaggttaaggagaatgcgccaagagctgtgtacgtgaattgccatgcacatttggtatttagcagagataaagttttttaaggaagtgagaacatttctaaatgttctcaatcctttgttttatgacactctgctgtctttctgactggcgaatttccaaacattttcaaatagaataaaggtgtattattcagaatgctatgaagtttgggaaggaagagaacacactgaacatcatcatgcttcatacgctgagaccaaaggcttacagagaaatggtgaaagttgcagcaaatgagcaaagaacctgaatagacattttccatacaagacatacaaatggccaacaggtgtatgcaaaagtgctcgacatcatgaatcatcagagaaatgcaaatcaaaatcacaatgagatatatctccctcctgttagaagggctataaaagggaacctttgcacacttggtgggaatatagactgttgcagccattatggaaaacagtatggaggtgcctccaaaaattaaaatggaattaccattagaatgagactaccaaatggaaccaccatgcgatccagcaatcccacttctgggtacatatcaaaaggaaataaaatcaatatcctgaggagatgtctgctcccttatattcactgcggcgttatttccaatagccaagacgtggaaacagcccaagtgtccaccaatagatgaacagataaagaaactgtggttcatatatacaatggaatattattcaaccataaaaagagaaagaaatcctatctcattggcaacatggatgaacttgggagacattatgctaagtaaaataagccagacacagaaagacaaatattgtgtggtttcacttacatgtggaatctataaatgttaaactcagagaagcagaaagtaaaatggtggttgccagtgactggaagtggaatggagagatgttagtcaaaagatacaaaacgtttagttatgtataatatcaatatgttgtgggagctgatcatagcagggcgagtggcggatgttttaattcatttgtggtaattgttacacaatatatgtgtatcaaataatcatgttgtttactttgaatatgttcaatctttatttgacaattacatattttatttttacttactttaaataaatttctttatttatttatttacagatagggcctccttctgtcacccagtctggagttcagtggcatgattatagctcactgcagacttgaacacctggtctcaagggaacctcctgcctcagcctttcaagtagctaggactataggtgcacgctaccacaccctcttaatttttttttttttttttgtgtgtgtgtgtgtagacagtctcgctatatttcccaggctggttttgaaatcctgtcctcaagtgatcctcctgccttgaccttccaaagctctgagattacaggaatgagccaccatgcctggctgacaattaaatattttaaaataagaaaacaaatataacaatattaaaaatttcttcaaatatacagatgaccagtgaaccaagtagtctcctaaatttaggttacaaatttgaaatttattctttaaaatatcttcaatacctgaaactattatagtaattgctctgcagaacgtcaaggcaaagctatagacaccatgtccctctgtctttaaaggtaaaaggactactttatagtttgtcaccatagagaaataaggaatatttcacatattccacagccatttgggaaattatgccaaaaaacacttcatgaagttttcaaagttgaaagccttcctttgggaaaggaaaaacacacgcacgcacgcacacacacacgcacacacacagacacacaaacacacagagatgcacacacacacagacatagacacacacacacacacacacacacacagacacacacagaaatccaggcaattttagagaatgtgttttcccttcagaacagggcagaatgagtatcacccaaaactgagcaatgtattactcaatgtaaactcatgattttcagaaaatagttgcaacaaaatgacccccacttcctagtttcttgtaaaatggaaggaaccattacataaagtaacagtcaaacatgctcaagaatttttcaacttgaggccaatgacctttgaactttgactgatggttttttcaatcccattgctgttctattgccgcaaaaaatttaacttggctgtgtgtttattcaacttggacttcacaataatgttctttgcaactcaggactgttaatctgtggcttttgtattggcaactgttctggcaagggtggaaccctcgttttccatgactttctaacctcctgaattgcagcaccttggaggggagctccagtggccaagacagaagtggtcccagtgattctggggagaaaactgagcatctgcttgcagacctggggctcctgattaaatcatagctataaatacttaggttttcatttatatgccttcatgttacacattcctaagttgcatgtacagttctgaaggctgtgattacaggtggagatgatgtcggtgccattactgggatgccacagtggaaatcaacatgtcaacctacaagactgtaagaaaacgtcttagaaggctggcactttcattcatttggttcactgctgtatccctagtgctgggaaatgttcctgagcactcaacagattttatttgaatgatcattttatgaaactttgtttcaattttaggaaactaagttaaaaacccatttgaaaggggtcaactttgaatgtgtctttacatttcttccttagttaagatccactcaaggagagatccggcactattgtgctcaagtaatattgtctgcacccgactcccctgaaaagaaatgagtcctgaggcagccaggcagatcttttaggatattccatcccacaggtgaaatacaaacatgcttcatccaggagatgactctagtttcactataaaagacccttcaacttttttcacgttagactgaagtgtttggtcagatttcctcagtatgacaaaggttactctttttttttttttttttttttgagatggagtctcgctctggctctgtcgcccaggctggagtgcagtggtgtgatctcggctcactgcaagctccacctcccgggttcatgtcgttctcctgcctcagcttcccgagtagctgggactacaggcgcccaccaccacgcccggctaatttttgtatttttagtagagacgggttttcaccgtgttagccaggatgttctcgatctcctgacctcatgatccacccgcttcggcctcccaaagtgctgggattacaggcgtgagccactgagcctactttcttacccaggcttccaaaaaggctggagtttccacagagatttattactatatgcatctcatcaaagggctaagatacttcttgactgtgtatatcagtaccatgtggctgttttggttcatttgtacatttttggtttgcagtgacatgtcatcaagggcctaagaacagaaattcattctgtctatgttttatgagtttaggggcctggaaaattgcaagcaacacccatgcttcagggaggccccaggactcaggaaagggggcagtctgtgagtcctcccagtttcccagctaatcaatgaagtgaacagtgcaaggctgtggaaaagatgttctctctgacttgggacatgtataatttgttgcacctgagacatgtgtaggagttaatgtggtcagagctcagaagttacagattttggagtcatcagcaaatagtgatatctgaagccctgggcgtggaggagaacacccaaagataaagcatgtagaatgagaaaataagagggttgaggatagaatgcctggaaacaccataatttagggggctggcagcagacgaggaaccggccaagaactagaataggacagcaggctgtcacatgggcatcgtggagagcagcctgcacagtcagcattcttaaatcctacacacagacagaggagatgcggattggaaacggtcccttagaaagatcactagaaggaaatacataaaaatatccacaggtctattcctgactagtgagatgtcaggtggcttatgttcttctctcaccattcttgcatcttccaaattctgtacaagaaacattaattacatttatattaaaaagctattaaaatataaaacaaggctctgatcaagtctaaaatattttatgagagcctgatgaaaagagcaagtaattattaattcacaagtatttcagtgcctgtgtgctgggcaccatgctaaagataaaacaatgaacaagaggacagctctgttgtttgacaaaaaggagcggaggctggtttggcaagggagggatgtagggcttgtgggacacaatggcaggagatgaggctggaaaggtcgtttggtgccagattacaatggactttatgtgtcttgtcaaataatatggtctttattctgaaggctacagagaggcttttgaggggggcagtgttaggtttggaattgtgctttacctgaagttaattttcgactggattttggcagtagtgtggctgctggcctgggggagtccaagcaggagaccaggagcacaggcagcaggcaagtgcagtaactgaatgaaggcagtgccctgagcacgggccaggcccagagatatttaggggtagcgtcaataggatatgactgattggatgtatgttgcacgaagtagggcattaagaaaaaaaaggaacaacaaacttcttcctgcttatcaaagaccataatgagggcaatggcctttcctgaaacacgttccttgggaagtcaagcatgagcatcacaatagtttggaagctatctgcacccagcaagtgagtttccagttagcctcacgcatggcaataggtgcttaggatgcaggatgcaggttcgtggccccggccctgtctggctcccctgaaatcacaccacagaggcagctgcctttcgtaaacacaaggcaggcagtgttagctggtccaactagacctcattctttctttcacctggggcctgtgcacggaggctgctgacatgagtggactcccacgtgtgtggtgaacgagaagttcaaagtgacactttgcattcttcccttcttctccactctcctcttcccgctccaggaaaaataaaggaagatgattgttttggtacaggaaaaaaaaaatgaatactaggtttttaacttgtgtcccgggttgggtaaagaatgacaactattctatagtttgtatagactttcccttagtggtcattgctatatgacataagaaagtcagtgcctgggccaggcactgtcacaggcctgtagtcccagctacttgggaggttgaagcaggaggatcgcttaaggccaggagttcaaggttacagtaagctatgatagcacaacctgagtgacagagcaagaccctctctttttttttttttttttttttgagacagagtttcgctcttgttgcccaggctggagtgcaatggcacaatctcggctcaccacaacctgcgcctcctgggttcaagcaattctcctgcctcagcctcccaagtagctgggattagaggcatgcgccaccaaacctggctaattttgtatttttagtagagatggagtttctccatgttggtcaggctggtcacaaactcccgacctcaggtgatcctcctgccttggcctcccaaaatgctgggattacaggcatgagccactgcacccggcctaccctgtctcttaaaaaaaaaaaaagtgagtattataatagaggggataaggaataatgtgtatgtgaggtctatttctgagaccagagccacaaaacagaatcctgcaccttagccattttcttaccacacgcgttttcttggatacttccatttttccagtctatataattcaatacttctgtgacagagaggtgttggagttttttgttttgtttttgttttttcgcaactctttacatacaaacagctatggtctcccaggaaggaacttcctctgttgagtacagaagtctgggaaaagactggtgaaattgcatgcgaggaagaaacaggtctaactaaatgtgaatctatacttttaaagcaagggaccacaaagggtaggtcccaaggaagttgcattgcttgctgcacttgtcacacgggctgtactttcttctctcatttatttccatttacagcgttgaaaactgaggccttaggctttggttgaaaaccgaggccaagggtgaccagccagtgagttaaggaggccccagccgaactttgctggaagtgctccagcataaagcctctctccagaaccagccgccactgagacgtcttgaagtcaaagtaactcacacccttgtccacctcgccctgcggtgaagaaacttcggtcgcacaggctccagaactcatcttggcgtgggctgtgacttactgggggatgggcctccttttcgttctagctcctaaatggagcggagcgccaggtggtgtcagagggggcggcggcccctccaatggtggcaccctcagccacggataaggttccaattaggtaaggacgcaagtaatgctgtcgtttcggctgactgctcctttcattccttggaggtggtcggtgtcacaaaacgaattttcatttactctcaacagtcacaccagccctgctaactggatggtcgcagccccgtgccttcgccggacgccctcctggaaccttcaggccaccctgaggatggagactcgggtgcccgctctcctcccctaccgccgcgggcctgcgccccccgccccggaccccgactcggacgttctagccgcacgtgcgggcgcccctgggtgcgagccgcggactcacgagccgctgcttgttgctcccgccgccgcgacctggggaagcgaaaatgaaattgacttttccgagaaatgatgaaagcggcgctgcccgccaatgagctgctgcggcgaacttccgcacctcccggccgggccgctcgcgccctccctccgcctccacctcccggttgcacaagcttgaaacaaacactggggaggaagggcggagggaggagggcggagaggggaggcgagggagggagcgcggccggaggagggcggggggtggggggatttccagccgcggctcttcgcagtttcctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagaggtaacatttttcaaataatagttgtgactgtgtgtgtttctctcgagggcatgtttctggggactgtggggggccgtgtgtgtatgcgtgtcctgatgccttgacacgatgttttgcagacggaaaatgccggggttcataaatattaatactgatttttggaggaacagtcggcgcaattatggatcatctgattttaggggaagcaggttctgctgctgttgctgctgctactggggctgctgaggctgcgaggaggaggaggaggaggaggtagagagggaggaggaggaggaggttggtggaggtttaatttcacttttggatttgcagatgcggagaggtggctccatggacacagacctgctgtgtgtgcttctgcgccccaggtgttgtgtgtgggggtgcaggtcagctggagtcgggcctcatttaaaacaaaattgtgtgtatgtgcgtgtttgtgtgtgcgcgcgtgtgtgtgtgtgcagccaccgccgccaccggatccgaaggaggggagcgggtccttctcggtgcccgcggcggcgcctctccaggctgcctccagcgtaaataagcaggcaccgctccccggccgggaggagcgcctccagccacggccagaggaaacttgctggggcgccccgcggcggtccaggggctcgcctgcctgccgggctcggggtcgggtcgcgggcgtcgggtgccagcggccggggcgggagggcgggctcggagccgggccgggcgccgggcctggccgacgcgccctgcttcctgggggctgggccgccgccgccgccgctcagaagggacgccgcgtcctccttcccgccggccagcgcccggtcgggccctggggctttgtcattgcacttgtcccagcgcgccaggggctcgggcggcgcgtcccaggaaggcaccgtgccgaggggtcagccgcccgggccgcggcctagcgccgtgcgcccccgggtccccgcaggcgcccccggccggcctcgcgcgctgggcctgacccgcctcggctacggagcgggcgaggtgggggcggggagcctccggggaccgagcggcgcagtgggggccggcgtcccctcggggtcccggggcgcgggccgcggcggggtggggacgcgagtgcccgccccgtgccctccgacccggctccgggcgccgggtgacattcgcccgctggccgaacatggttggtgcaaagccgcggcggccgccacttcctttccgcctcgccggtagggctcgcccaccgagtgaagccggccgcggccaatcgcggcgcccgcctgctcccagtggcacggcctgggggccggcgtccgccggggctggggaagccgttccaagttccaagggtcgcgggtgtaactcatgcccctcccagcacgcgccggcgtctccccttggcccccggtctgggtgcgtttgccaccctctcctccttgttccctaagaagcgggggaggggaaggaggcgggcagcctgggcagggcgccagagccgtggtcgggcaccaggtgaaacgcccgggtcagtctgtgtaggccggacccttggcgctcggctgcggatgtgatcccggggactggcggccgaggtagctcagaagagcgaggtggctttcgctcgtttctgacccgctactgtctgaaacttggggacatattgcccgccccctccctcttcaacctcctccctccggtggctccttgtccttggttatggaaggaaaaaactcagttgttctaaatgaggaaaagtggtgctggcattcgtcttcagccaccggcctccttatggctgtgactcggtctgcttttgatgaatggccaggaggtatggaggatagttagatttcctgttgtggattttcaggcatcaccgagactgctgtcaagcctgcagtcatttactagttttcatatcgactgcaggttctctttgagcagttcagtttttggtgcttaagggcaggtgcacaacggggtctggggttagaccaggcggtggatagtcttgatgctaggcagatgcagttatccctaccaggcccagagggtgactctgtttaacttcaccacgcacgcagattcaggattctctgatttccccaactttcctttattcttcttttagtgggagaaggggcaaaagtagaaacctaaaaaatcctgggaaaaggagccttttctgaggaaacttcagcagatgaaatatttaagacttgaactgggatctctagggggaacgttggaacatctattgattgatgtgtcaaagtccggaatttcactgtaattagtgaacgattataacttgtaactttgtctgttatgtaagaaattacattttggtctcttagatccaagagttcttgtctgttacgatttgtaactgcttgttaaaattaaacatttacatatttcattctcagtgagttgtcatttttttgttagagaaagttccagttatttcagatttacttacctgtaaaaatgtcagcataatcaaaagtaaggatctgtagtcaaactggaagcaaattatggcaaacacatgcgtgccatgaagttctgacagccttatgaacaatggtcccacttttatcccactttctgaaacactttattaggcaaatagtgcaccagagcaaaagatgtttaaacttactggaaaaatagacactttggatgctccacatttgatgtgcatcaattttctcatgttaccaacgatgttatatttttattcttaacatcatctcgtacaaaactgttgtttttagagcattttcacataatatccttttgatagtgaaaaaccactgtactctatctaaatggagtatctgggttatagttcccttatctgccttataccaaaaagggcttaacgcagacaagagaatttatgtacacactcaataaatatccttagaacatctattataagccagacacagtgctagcctctgtatactcaactgacagcgagaaagacagcatctttacactaggttgtgttctggtgagtgagctgaccattaacaacaaaaaatatagttattaccttttggggttagctgtaaggaggataataataatttttaactatatctcgtaagtgttgctttcatgaacaattgagatactgtatatgaaagaacattgcataaattatggcagtctacaaatgtgtaaggcattaactttcaaaattatatcagattattcttagtgtaaaaaggccagataatcatgactggattagacactatctttctcatagaatttccagcaaggagggattttacttctgagcatatataaataatgataaaagattaaacatggaataacttttatataaagtatcaaaaaaatttcacagtggaatccgatattgtcagtgaattttttcctgtcagaaggaaagttaggtggtatccatggagaccaaatgatatggaaataacagtgattggaccaatgtattttccctctttatgtcagataagaaaatcttcccaagcctctctgtgctttagtctgaatcttcttcactctcgtgtcaacttcttcattatctgtcattgcaggtgtgcactgggctgattgtagtattttgcttttaccaccttttttttcttttctttttttttttttgaggcagagtcttgctctgttgcccagactggtgtacagtggcacactttcagctcaccgcaacctctgcttccaggttcaagcaattcctgtgcttcagcttcccgagtagttgggactacaggtgtgcgcaggcgtgcgctaccatgcctggctaatttttgtatttttagtagagacggggtttcagcatgctggccaggcttgtctcgaactcctgacctcaggtgatctgcccacctcagccttctgaagttctgggattacaggcatgagccactgcgccggcctgctttaccatcttggctcatgtgcatttattgaatgcttactgtgtgcccaacactgtatatgtgacaacatacatgaaagtaaatattaactgatagcatatatttataacatatattacaatacgtaatatatgcaaataaatgaaactgcggtgaaatgtcagttattattagtaaaaattagttcttcttttcatctgtatgagacatgatgttccttcctgcacaggggtaggaggtcaggaccttcggtctctgcctgccccgtcggccccctgtgtttggcctgagtgtaatcagtggtcggtgcacgatgccagcttcatgcacagtgtgctgaattgaggagtggctctggtggcgggagtgactgatggaaaagtgggtgaggaagttccatcaaactttaatttatcaacaaagaacaaagaatgatgaataacatatagggtccagatttgaacatgaagacagtattttttatagagtaccaaggaaaacacacaagcaggaaacacagctcacaggtcccctttgtccctgggactccgtctgaggctcgttggattcagagcaagcagcaggcctgaagtcttggcattgaccttcaaagatcccctaaaaataattttccccctcagaagctccatcttatgacaaactgtctctgaaacaaattgtgtttatttaagtagacttcatgtatcctttttcttttattagagtcaaagtctcactctgtccaccaggctggagtgcggtggctcgatcatagctcactacaggctcaaactcctgggcacaagtgatcctcctgcctcagtctcctgagtagctgggacaacaggcatgtgccaccccaaagcccgacatacatttttgtgtagagacggggtctcgctatgttgcccagactggtctcaaacccttggcctcaaatgatcctccctcctcagcatcccaaagtgctgggattataggcgtgagccactgcacccggccctagtgcccatttttattcctcagaaacacatatgacttccagtcagaactcctgattgccttgagaaaactggtatcatcaaatctcactgatctcattatagccaaaggtagagacccgtggtgtgttggacaggctggccggctccgtgtgagagaaactcaccatcccgttaggctttctgaggcactgaaactagccgggaccctccatcaataacttggtctgcttggggatccagggaccccatgcaattattttaaatgaataattgattttgttaaatgtagtaacacatgcaatggttttcttaaatgcacacattgtgttattatttcatttgtttattaaatatttcttgacagccagctgtgtacaaggctctgcggtggaaggtgcatgaactcagatgcctagagtggccttttagttctccaatcacttcctcctttggaagttttcactgtaaaatgtggctggataattctgtcatcctcaggagacagaacctgtgtgtgttgtgaaaatcacctggggaggggacttttagaaattacacgggaccttttagatttgagactatctgtagccccctttcccttccttccccttcctgccttgatagcgagcctcttattcaccattggatccctgctccccagcctccctcaggtgtgtggccagagtagaaatggaaagccactgaatcgaggatctcttcccagggccaaatagttgatcttttccttggctcagatgaaacctctttccacattttaaaaagcacttcggacaggggcctgtggtcactctgttggctctgcccacttgcccttgcttgccatacagaaatgggactcatgttaagtttgtgatacattgaattttccttttttttttcttttttgagaaagagtctcgatcttgtctcctgggctggagggcagtggtgtgatctcggctcactgcaacctccgcctcctgggttaaagtgattcttctgcctcagcctcccgagtagctgggattacaggcatatgccaccacgccgggctaatttttgtatttttagtagagatgaggtttcgccatgttggccggctggtctcgaactcctgacctcaggtgatctgcccgcctcagcctcccaaagtattcggattacaggtgtgagccaccgcgcccagcccagttttccattttgaagaggcaagaaggactttattttattttatgtatttgtctctttgtccaggaaggccatggagaattaggcgtttggttttgttttgtttctattttggtttataactcctttatcagtttagtattcccttctgataagcaagaaagagcggagttgacaaagaatggctgcagatgagaagcaggtgtgtgaggttccttctgatgatggattctaagtatttttatcccaaaggcaagactaatttagttcagcaaaataccttaatttaggattttgtgtgataaaagcctgtcctgttttcattaaatgacgatttttgagaattaactacttgctgtgtgattttcataaataatttcatttgggcatacttaacactgttgctatctgctgaaggcatttgatactcgcacacctaatgccatcaaaggagagatgagtatacactttaatttgttcttattgagtgtacattttaattgttcttatgaatgtcagattttgggaagatccaaagaagtactctgtagacagaatacgctgtcctggccccctaagcttagaatcctaccaattttcccatttcatgagattgacctttcagatgaggagggactgcatacaaattgctttatttcaagtaatatctaccatgttatttttgaaagaattcttttgtcctttttaccctagatctattggaaaagatgagaaaaattacagtggtgataagagtgtcttaacacctagatatgatgggtgtgtcgggtgaaaggatagcaatgggaggctggtggaaagtgagagttgggggatggggtgatgagaaggaaaataggtgactagtgactcctggattcttgaatgggagagagtgaagagacaatcaggcagggagattttctgtctttgcataaatgtcactgaaagagttttagagatcggaggggtgaggtgaagttggttaggcaattagtgataactcaaggaccagttgaaagactggaggaccctccactgctgactgtgggatcagatccttttatcctggggatgagaaaggctgatgggaaaactgctaggcagctgctgacattataccaccaggaaacatgaagttgtgagtagttgtcacttggacatggctgaagtcaccttagggtacagtgatgttgctgcatcacaacgtttaggtcatcaatgggccatacacatgactgtggccccataagatgataatatcatacttttaccttttgctatgtttagatacacagatacttgccattgtgctacagtggcctacggtcctcagtacagtaacctgcagtacatgtttgcagcctggaagccataggccataccataaacctgggtgtgtaggaggttataccatgtaggtttgtgtaagtacactctgtgatgttcacacaatgacaaaattgcttaatggtgcatttctcagaatgtataagtgtgctgatgttgatgcattgtttggggatggggaaactgatactcactatgtgaggccccaaactcaatctaaaattgcctttggaggcaaccacggaaatacggtaatagctctcttaggccttctccccccgtactgatcttccttggtactgttttattttatttttaaactcttgaaataatacataatagatgtatgtattttcagggcacatgtaataatttaatgcattcatatttgtaatttgtaatgataaatcaatgtaattgtgctattgagattgtgggaggtaaatatggaatcagggaaatagaatgggctgataatgtgttttcctaaagaacagatgggattggccgtgcgcggtggctcacgcctgtaatcccagcactttgggaggccgaggcgggcggatttcctgaggtcaggagttcaagatcagcctggccaacatggtgaaaccccgtctctactaaaaatacaaaaattagctgggcatggtggcgggcacctgtagtcccagctactcgggaggctgaggcaggagaatcgcttgaacccaggcggcggaggttgcagtgagccgagatcgcaccagcttgggtgacaagcgtgagacttcatctcaaaaaaaaacaaaaaacaaaaaacaaccagatgggacaagttaaaactgaactatgaattccataagtgggtagtgtgggtcactgagtggggcactgagtactccacagtgactgtagtcaggattctacattgaaataaactttctggaatttaccttggtgctatatacttaaagtcttaaaaatgttaagctctctgttccagaaattctgcttcttggaacctacttacgtgaagtaaccagagatgggaacaaagatgtatgtacacggatgtttattgaattagcttttgttatgtaaaaacttggaaacaagctaaatatccaacaatagagacacatttgaacgaattacggcacatccagacagactataggtagcttataaagctcgtgttttcgagcagcgtttagtgatgggaaaatatttatgatctatgctgattgggtggggaaaaaaggatatgaaattgtgcttctagttttatttttaaaacatatgtgtatattggggtatttttaaaaacctggaagaaaacatatctttttgatggtgaaattgtgggtgtttggcttttttttttccttcttgaaacatttttgtattttccaaatttaaaacagcaagcacaattaccaattacccttttaaccagaaaaatattctcaagagagtgctaatatgtcatctctgccctcacctctggtccacgtaaggttaggaaaaacacactgggtgctgccgaggaggaggctgtgcatggacggggccattctcgagcctttctgcctccatgtgtggagcaggctctagagccagggctttcctggccaggctcttggaagcctttgtcctcagacagctgtggctacttggagacacttagattggtggctttttggtgaggttgggacataatgttttgtcagtaactgtgaagggcttgagatatgatttcacttcacagttaacattctttatacatatgaatactgcagaaacacaaaacccctgggtaggagaaaagagttccttgttgatatttacaactggggcaacagcctgagtgacactattgtgtcaggcccctaaaccttgacccttaggtgacactgaaaactaatggaatgtacatgtgggctacactttgttgacagggacagagcagctgtccctctcccgtcccaaaaggagagagagagaaaaaaaaaagaagaagaaaaaggaaaaccaaacagacaaacaccttagctcccctgacatgggatgaaaaggttccaggggtcttatcctaacctttcagaatgtgagacacttgtaacctggggatgtctccaaggtctgtttttcatgctttttgaaatacacatgcctagggagatacgtcttcccagcaccttgggaaccaaggtgaaattatttggtcctcttgaggagattagaggttttattatccttttggaaaagagcatttaatgtacacaaatggctacagatctaattctcatggtaagtgaagtataaaatgtttgtaggggaagtgagagtgaacattccctgtcttcatgtcctgtatagtccctatcttcatgtcctgtacattccctatcttcatatgctatacagtcgctattttcatatcctatatggctcctatattcatatcccatacattccctatcctatacattccctaccttcatgtcatatatggtcctatcttcagaccttttatggtccccatcttcataccctatacattccttatcttcatgtcctgaacagtctccatcttcatatcctatacattccctatcttcatttcttaacagtccccatcttcatatcctatatagtccccatcttcatgtcctgtacattccctatcttcatatcttcctatcctatacattccctatcatcatgtcctaaatggtcgctgtcttcatatgctgtacattgtctatcttcatgtccaatacattccctatcttcatgtcctatacggtccctatcttcatgtcataaacggtccctatcttcgcatcatatgcattccctatcttcgtgtcctatacattttttccctttatattctattcatttctgtgtgttaggaggtgaaggcattttataggagtctggaaagaagcctgagaagttgtattttcccctcacacctgcctttaccagacccctgttggagaatgacagtagagcttaatcagagtgtgacctctgacttttcaaactgaagacctcaaatctccaatttttatctgaaaaaatattagaatagtttcactctctttatgaacatggagacgtttttggattgctacggaagtaggattgggcatgaccattatgagttcagaggctgaatgccgtaccacagcccatcaaaaaaaatatatatatatatgcacgatattgtccaatacaaatataatgtgagccacatgtatagttttaattttctagtagccacttagaaaagtaaaaagaagtaggtaaaattaattgtaataatatatctcatttaactaattttatctaaaatatttcagtatgtcgttaatgtaaaaatactaatgagatattttgtatccatttttcatactgagtatttaaaatccaatgtgtcctttgcacctatagcacgtcttaattcagcccagccacattccaagggcatggtagacccatgtggctggtggctaccatcttggttggtgcagcataaggaaatcaatcaaggtgtgaagacaatacaggggaaagttgtagtacagtcctgaaaggactgaaggaaagtagagttggagtggttattttggtcataactgtatgaatctccctgtggctctccccacaaaccatacctgatctcttcagcctaaaacaatgaaatgctctgaatttctatagaagcagcatactctacatcccattcctagggtagttagctatctgcatcttgatgagatgaatgtttcattctagactcttgaactgttatgaaaatcttagattatttgaatttttccatttgtatcacctatgtggtaagttatttgagagccaggatccagtccgatttatttgcattcctcaccggtgtttgacacctttaagacctagataaatattagtttatttgattttcagctgtaaagcaaaggttagcttgaaaggctgaattccagctcaggaagggtggcacagatctagtttgtactagaaacctaatggtatatgaattgaacacataaacattaggatttgtcactttgcattaggatttgttactttgtattaggggttccacacccagaaggtgaaaaattgttcggtttttctcctttgtatccagacctttaaaaaatattatcagtttcttcttttgatgtttaagttccaatgatgatcctaatactttcttgtagggataaataagctatatttggtgatgacctggagataaacatttggaagctgctactttttccatgggttctttgttaacaataactttgttattaacaaacacagcccacaacatctaggcgatgaaattcttttgaaatcaagtatagtattttacagttgccttcatttgttctctttgactgtaattgttgggttgaagcaacagacttatccagagagccaaggcaatttatttttactgaagactacctaagaactgcttaggtagcttttctctgcaagattaaatgcgaccttcatggaatcatgttagcagggccagcagctagaaaaataaagactaaaccaaaccttcagcagcgaaattcccagctgctcagtggctcagagctttcctgattgctttcttccaatgaaaacactgtagattagttttaagtgaattctagtaggtttggggatttgcaactgacagaagaacagcaaagtgtaatctcactttaaaataatagtcctgaaggtaaatctctattggctctttcttaggatgctgggatttttgttcatatgggaaaacttaactcatacacactgtttagctgacctttgaaggtaaggccctagaaggcagacggaggctggacacctggggatgtggggcaggactgctgctcctctttcttctctccattgtaggcgggtggaaacttgggaagcctgcgaggaaggtccctgtagggaatgtagctgacccgttttttccacttttgggtgtggtcatcctgactattggtgaagtcagggtgaattgaaaatgttacaggagaggatttacttaacttacaggtgcttttaatgcattgcgatttttgtttttcttgaaagtcctcgcagtttgggagatgggggttgggggttggggggcggtgggggggcgggtagaggagagtgctcagctgaaaccgttgactattttgatcattcatccattcagtcatttatttagcaggtgtttattcagtgctaacgatatgtagagggaggtataaaacgaaagaaaattatcttcgatttgaggtagccaggtaggtagatggtctgcattccttacagttaggagcctaattcttccagatagagaaaacacaattaggcaagtaagatgacagttccagaaacgattttacttatctgtgaatcccttttatagttcttccatgggccctgtggggttgtttcagattgtaggggaagccgcagtgctaatgtgacagatttttttgccaagtgtatacattttattttttttaaaacagactcttaatagattgtaaaataggcatagaacaacatattgttttgttgttctttctgtttttccacaattctcccacatttagtttggaacatggaactatggtctggtgtcattaaggaaaactgatggggttaaatcctgataattatctcccctctctacttccccttcccttgtggggagacactgtaaccagcagagctgcagaatcagtactcctgccccccgcggtaaagtgaaggaagctgatgaaagatatccaggaactcttggcactatttttgaaatttttatgtggattggaaataatttcaaaataaaaaggtttttttaaggcttcccattagtgctctagagttactgttgcttatttaaaataacagcctaatagagtatatttgtaagttcctttgtttgcttccccacgtcgatctaaaagggattttatgtagctctttttctacgtaggtcctactttagatatcatttagtaccctctcctcacagggcttgagaagacattgccttgaaggggaaactggtccttacttcattttgaaaatgcttccttttctctcttcgcgtgtgtgtgtgtgcgtgtgcatgtgtgtgtgtgcgtgcatgtgtgtgtgtgtgcgcgtgcatgtgtgtgtgtgtgtgcgtgcatgcgtgtgtgtgtgtttggctatagtgaatactttaagttgcctgaaattaaggaataattatcatccataaaagcactgaaggaaacagtggcagcaagtagggaattcataaatgcatgttgaagcattctttttaaaactgtggtaaaatttacaaaacaaaatttaccattacaatcatcttaaagtgtataatttggtgacattaattacattcacaaggttgcctaagcatcaccaccatccatctccagaactttttcagtatctggatcagaatctctatacccattaaacaataactgcttcccgcagcccctggcagccagcattctactttctgtctgtgaatctgaccactcgagatgtctcatgtaagtggaatcatacagtctttgtctttttgtgtctggcttattttgcttagcagaatgttttccaggtccacccatgttgtagcatgcatcagagcttcattcctctgtaagactgagtaatattcctagattgtgttcgtccattcatctgttggtagatactgggattcttattaatttggctattgtgaataaggctgctgtgatcattggtataaaagtatctgtttgagtccctgctttcagttatttcaattctgtagaatggctgggtcatacggtaatcctatgtttaacatttgaagaaccaccaaattgttttccatagctgtaccattttgcatccccatcagcaatgcacaccggttccagcttctccacaccttttaccaacatttgttattattatctttttgttttgatagggccaccctaataggtatgaagtggtagctcacgatggttttgatttgcatttccctggtaattaatgatgctgagcatcacttcatgtgctcctagccatttgtatatcttcttaggaggaatgtctattcaagggctttcttcatttttgattttgttgttgttgagctgtaggtttgagtcattcattttgtggttttgaaaatgacacactagtaagtctgaaaaactaagcttctccccattacagtatatgtagcatgtggcaaaaagttctgttttagaattttgagatgctgtgaagctgatgaagcacactttgaggaattaacttaggctggagtgaagtaaatcagagcgcatgggtaagtgagaatcagatagaatctcgcaccatgctggaattgggagtttctgtagcaacgattgcctgccccttcccttcattttttcagctggagaaatcaagtaacctgctcagtgtattgtagccaggttaagtacttagtatgttttgttgaactgtgcagtaaataattattttttttctgttgtattttgaatccagaaatgtcttgtgagaggagaaatagcagtgcttgaatatggtagtggatttatcctcgcggctgcccttgtggtagcctctctgcttgggactcggatatggtagtgaatttatcattgcggctgctctgtctgcttgggactcatgaaaaaagccttagagttcttcacttctgtggtatttcaggataaagattagtaaaaacagcctcagagtaacatttggggacttaagaatttaaatataatccattcaatcatggttcaatagtattactgagtggatgaaaaaaaaatattgccgtaataacagatctgttaagtaaaatggataaaagcatttgtgtatttattgtgaattgttgacagcaggagaagccattcatttgttcttacaagagccatagtagataaagaaattcagtgaaatatcacaactgtatggaagcaaattcattgttggtttagttttatgtcctgcggaaatttttcgttttgctcaatccttttgaagagttgaactttattgaaaactatagcctggcaaggtcatgtgtggattataactgagttgtaaataattggaagaagatgcataatatatgtgagaaacagagaaataatatatgtgttgtgaagcagagtggtaagaggagttgcaaaaatttttattctcttcaggcttggggcaacgattttaaaaatccttaaaattagttttaagtactgtgaaaacaaacatgataatgatgaaattaaattgaagactctcttctacaaacaaatatcttaaataaaaccctcagaggaagtcattccttcagcagacaattttgaacagctgtgtgtgaagccctatgctgcgaagatgtaaggttgaaaatttcagatccatgctctcaaagagcttatcatttggttagagagacaagcaggtaaataaccattcctggtcatgaaaagaacgaaagatgggcttcatggaagcacagcaagccaaaggctaagggagagaagaggaagaagcagtatcttctttttattctttttaatttactggagctacccatcatgaactaagaattacgtctttgaccagagaaactggggcgtgcctcaccactgacttctgactggccggaaggagggaggcaatgtcatctggtggccagtgggtgagcagggcatttttggttgaaagaacagcaagagcaaagacatgaagggttgacagtttcttccgttcctggtgcatggaccactctccagggtggctggaacaaacagatgaaggagggagtgtcagagccagttcctggtggccacaaatatctcactcagtgcatgtgttcctgtttcccagtaaggaagggttttgttccgaggatacagccagcttttttcttttttttttggaaggtttttgaggatttggaacattttcccctgtgcatttcagaaaatgatagctaatgactgttagcagcagggcgtgtcgcagctgtgcacctgcagcgttggagaggagctctgaggcgtgtgcatttgtagtctgcggtccattgcgggaaggactgggttgtgcctttgataatagccaggcctgtctttgaggtgcttttatataagtttctaagaggaaatgatgaataggtacaaaaatattttttgtactctcttttgtttgttttgaattggtttgtaaagagagtgattatagtaagtttataatcctcaagtgaggaggaattaaagacagttggctcaaattcaggtaagaaacccaagttagagaatcaaggataatggcaagacccccagaaacaatgccttcatagggcagaagttaggacagggcttcctatccgcccagagtgtccccaggtcttccgagtgacgtcacgccgggccacagaagggctgggcgaacacctcaggtgcaaaccttagccagtgggactcaggaactggagggagccccagagctgcccgtgccatattgaggcttcttccctgcattgggaccacatggatgatccaggaaaattcccctctgtcaaggtcaacagacaacctttaaatcacctgcctccttaattcccatttgtcacataacacagtctattcacaggtcgcagaggctagcgtgtgggatacttgggaggcattattccacctgtatcatgtgttaacccaaccacctcacactcttcatccgacgcagctacagagtgtttggggagatgtggccatcaggggccgaggccctcacagctggggtgaccggctgccttgatggcattgactggatgtttgccggactcttcacttccctggggcgataaattggaagatgttattcaaaggcctagatattcctgtggtttatttcagtatttcaccgtctccactgtattatcactaactgccgtgtttgaaccggttgtatgttgtggagggccgagccacaggactcgcgtagactcggtaccctcagtacgtgttggctgaattcagttgcagtgactgacttggtcctccaattgttatttgctgtccagacacagaggcgcctgcaggacattggtgcccctgggctcaggcacccggtttcccggtagggagggcggaccgggccgcaggaaagcgcgtcagccgggtgtgtgccctggctggaccgaggggtttcctccgctcagtcggcagggaccctcgctgaggtgcgaggacacatggctgactctgaactcgcagcttcagggaaaccttccagcagtttctccaccgcggctctcacgttccccgtggcgcagcttcttcgtatcaccaatggctcggacacgcgggcgccacccctctcttgcccttgtcgttgttcttccttttgttgggaatgttctttcttcccttccacctgaggatccctcggcttccaggcccagttcagatgccccctcttctaggaagccttccagagtcctctcttctgggtttttacataaaatattaaaacttccccataggcctttgaaaaaaattcatctatttgaagtgcagagtcacatttttgtgaggcgaatgaactaatgggggtgagtctgatgcagagagggaactcgaacccagtgtgtcagacgcccgtgatcagtgtgatcagtgatggtgggtgtgcggccgcagggcaggcacccactcgggtgtgctcttcctggcaggcttcgagtctcacctccgggacaccacgtcttgcttgaaagcttgctttaacactgacgtgcccaccttcgtctttgcagggtaagtcctttgaggccagagatcatgtcttcatcatctttgtatactccacagagctttagataatgcttggcacacagcgattttcatgcggttggctcggggtaaggtttttggaatgaaaagttgaaccaacgtaattcaaaagtgtattaacatccttagccggattcacccggaaaatggcatgtaaatagtaaaatttttttttaggttgcatgctttttgtagtcattttatttcctttgcttatcatttgttcataagtttatccatcacaacgtatagttaatatcatccgccttatcctcctcagcccttgccctcagtgagttttccaggagggattcatccactttcttatcaatgagtgattactacatgtcattatgtgcaagctactgtgctcggtattttgggatgagtgagatgggactcctcctcacaggactttatacagagataagcccgttgccaagtacctgaagctgtaagctttggttgcatcagaaggtggaaggaggctgagtgcggtggctcatgcctgtaatcccagcgctttgggaggctgagatgggaggatcacttgaggccaggaggttgagaccagcctgggcaacatggggagacgcctttctctacaaaaaaaaaaaaaaaaaaaaaaagaagaagaaggaagggagggggaggggagggagagggagggaagggggaggggaggggaggaagaagaaaggaatcagtgggataagaggttagaagaagaaggtggagggaatcagtgggaacaagaggttagaaaggtgggatggggatgaattatggtggccaggagtccagattttattcaatgggcgttgtggaaccatggaaggattttctgcaaggtcaggagccatttggggagattaatctggccaagaatgtgcagggtggagaatatgcttctattacagaaggtggaccctggacatcgtcttgctccttgtggaacactgacttagtcactgcagttaggtggagcacgggccctactgtttggaatttctttggggaagtcttaggggagaccaaggaaatctcacctcatacttttcctcctaacataaactagcctttatctgtttcttctcacggtagctctgctaagttgctattaagatctctgtttagtgatgaggaaactatggcttggcgaagttgaaggttgtgagtggtgaggttccagttcaggtgtgcttgatgccaaatctgagctcccactaccatattatgctttaacaaggagagggaaagaaaagaaatcattgtggtcctgggaggggttggcagagaggggaaatagtgaccatccaatggatgccagatccgaccctcccacctctggctaccattcggaaactggtgagaggcagtaggtatcttccaaaaatatttgaagacagttctgcagcttgcagaggagacatggattcttgcttcggaggtattcctgtacttagagtggtagcaattttggctctttttccagttggaattcattggtaattgggatggtttatcccaggaatagaatcaaactagcggaaactgtagtgcgtaagtttatagtttgtgtgctggagcttgaccagatttgaacataaagagttaaattggatgtctccataataattaataataataacaccaagaatagctggtaacctttatggagagctccctggcagaggggacagcttaaaggaaatcctcaaaggaaaagtggcagcaagaagcagatcctgagggccagcctgtggatgtggagtgtgggaggaaatcatttactctcatccaggggaaaagatagtgcccttcaaatcaacctttcagaacaggttattttcaggcaactggtttttgggaaggcgttggttttcaaggtagtctgctagtgatgtgattgaagtcagaaagcagcaattttgttgctctatgcaaataggttttcttaggttccagttccagtatgctggctctttgagtttctgttatttgacttttcacaaatactgaccacattgacatctcctctctcttgtccccttgtcttttctgtgttcctgaaggggcaaaacacaccttttgaggtctgtggagctcaaaaatgaagtcaaaggtgactgggtgacacaaacagctcaggtaattcaggtcctgccgtttctgccacgctcctcctcctcaagccagcatggctcagttatccactctgatgtctacccttttcccacgtgcctcctcttattgaacttgttctctatactgttacgtctccagtgtctgcatcagaggactgagaggtcttttccggcttgcatactgcaggctgacacagtcttaaaggaacttcctactgcactctgaggaggaggagctgtgccttctcgaggtcatgttacttctcctgtactgcaaaggcagtgctcagaggacgtgctgattaagggaaatataggatcacttcttttcccattttccatatggaaagaagctttgaaaatgcagtatgtgctcgagtccatatgctttgaaatctgtgcatgattcttgctttgctgaattgcagaggctgatgccatctagatgctgcgacccagggccaaacacacctaagggtcccagcatgagtttcaatttataaaatacttttaaaagtcagtctacccttttaggtcttaatggccttgcataaatttttctagaaaatgctctttaaaaaaatgatggagtaaaaaatactcttagattttcataatttaaatgtatctggaaggtaatttatctgcaattcacagttttctcatgttgtctgttttttacagaaaagaatattacatgtgtatctgcatcagatttcaagatcattgtagttttttctttttttaattttaagacagcatgtttcacacatgattagattacttgggaagcattcctagaagtgacatggctgggtccaagggtgtagttttaaaatttttaataccttggccaagctgctgtttggaaattttgtacctattttatactcccatagtgcatgtaagatgcaaaacactattctagatattttacatgtttatttgcttttttcttctctctctatttcttctttctttctttccctttttttttttttttttttttgagacagggtcctgctctgttgctcatgctggagtgtagtggcatgatcatagctcactgcagcctctacctcctgggctcaaatgaacctcctgcttcggcctcccaaagtgctgggattacaggtgtgagccaccgcattgccttattttacatgcttcttcatttaatcctcacaaagcctgatgagaacagagaaggtcagtaacctgcccaaagtcacagctaaatgatagagctgggggcgaaagcaggcagtgccgcagagctccacggtccatgttgttgctgcgcccggtctgcacttccatggcagccggcatgagaacatgagcaaagagaggctgtgatgagactccttccttctgggagcctctggatatggctatggcctcgtctttcactctgcttcttgattcatcaggtaggacaggtgcagaatgcttttcctgggccgaagcctatggtcttcgcattctttgtgcagcggtataatttggaaagaagcaatggtcactttggagagccagcccctttgctcagctctcctgtgcccctgtgctgctgtcgttgcccctgtcacctctgccagcatcatttcccatgactgcagtgctggggggacttgggcctggcctgggtccctacatcacctgaggagggtctccaaatagaggtgtgaaggttttacagagattgtgtagggatttcaggctttaaacccttgcttgtctttgctgctgcatttggtgtgagagattgcaaaaaatgtgtatgtttttatcggtgcaaccctagggtcatacagggtcaaaaggcttcctcttttaggaagagtcccagacagctgctaacttatcttcttgttccatccctgtttatgggggatttgtatttttaattgcctttcactctgaacaaagactgagcaagcagaaagtgttgggaagggccccagggaacattctggcttgtgttttctttctgatctgtgggcctgggggacttcaatgttcactttcctgacaggaggagacaaccataggaactagtgtggtgtccagtgccagctggggaaggaaaccagtttcctagcatttatgtttcaggatcaatggcacatgtagaaaaatactatatcccaggggttctatattaccaagaatacccctgaagatgaagcccatttttggatcctcagttctcatgataatggagtttgatgacctagagtcagctttggcatgggctaagccagagcacccttttaaaatgaggatagtaatgagaacgaccccatggggttactgtgagggttaaatgagataatgtatagagtttaatgctgagtgcatcatgggtgcccagtgaatagtcattgctctcacaatccccaccaccactattatctccctagacatcaggagaacaattttgtgaagcaactttggacttttgcatgtatatatttataaacaattcagtgcctgcaaatgtagaagctgatttaagtaccttggcccttatggtaggaaggtctctggggccccttcaccttgaccctctttacctttagagtttcttctttcttcacactttcatgaggaagtatgtgcctctttgaactgaatttctacccaagtaccatggaatctaaacagttcagtgcttttcaacttctcacgttgcataatatttgccatttgattcaaaattacgtgataaaagaaatggaggaggtaaacttgccagacaattcctgtgtctgtttttgcatttgtgcctctgggtatttagtcttttcggtttgcaccagggcttccgtggaggaggagggcatgtgaaatggagcagttgcttacgtactggtctcagtggacggtgtggatgtcattcatagggcatgcacagcaacaaacaaacaaacaaacaaatgccatttaacgtgatccttggaaaggtatttttataataactttagtttttaaatcaaatatttagaatgtcatggagaaagaacaatgatattacaaatgccatcataaaggaaccttagggagactattttaaagaaattttgaatctaaatatttaaagcttttcttattttataagtattttatgtatttgattggtaaggtaaagcacatacgtattgttaggtaaactcgacttaaaggaaataatacttttaaatggctacttaagatttcaaattttataaaaatatttaggaaaagtatttttccactttctaataagcagaaatagtttgcattacattttttcatttcagaactaaacagtgctattattcactacattaagcctagtgtgtgccagattaatgtgtaatataaatacagtttaaggaaaatgatgctgatttttcgtgtagcgtgataacaataatatattccaaagattgaaataacttgaaatctactgcaagccccaaatcccttatttgcaatccaaaatgctctgaaactgaaagttattatcatgactcatttggcaggatagtctgccctgaattgacatgaagctattcatagcttttatttatcccaatcagtgtgaatgttcgtgtttcactgcagaaatattaactgtgttggattaaggggttctgccctaattactttccggggtgttttgttccttgtggtatatggtatgtgtaccgcattatcttgctaacatccacacacttttgaattctgaagactttatctggccccaagattttgaatagaagacggtgagcctgcgtcagtatacctagcccctacaaccagaggcttctcacatcctggtgtttccaggaacagtcgctctttatatctgtttcaggtgtcagtattaatgagaccccattcacattcagaagtgctccattttggcttggtcaccatactaaccacataccatagttcttggtaacggccagcgcagtgttggtgaacatcagtacatttctagtgaattcccatgtataaaataaacaagatctacataaacaacattccagattgtatcttgaaaacctaaagtcatttaaagcattattggtaaggtatccccgactgcctgtctagatggcatttcccacgcattggtgcacgcttcttttgatggcagttcatccttctcctcactgtgattgcctgtgtccctgtcttctctttctaggctgcaagctccttccgtcattgcgtatcactgtgctgggcgtatatagcaagttcattatttagtcaactaatatttattgagcgttggcctctgccgtactctgggccctgggaatagcatggtgaacaaaacagaattgactttggtcctcatggagattcttgtctacagatttgggggcctggcctggtgaaatggagaaggtttgctgtcaagtgactttgaagccaaatctgaaaaatgagtaagagttagcttgtgagaggggatgctcttgaggctgaggggtgacagacgcagagacttgggacggacccctcgctggaggcttgtggggtaaggacaggctttaggcagtggaatgatgagagtctgtttgtgcttttggaagggtgttctggctgtagggcagagctgggttggggttgggggccgaggagagcagtctgaatggctgcctggtccaggctttgtggaaggaaggatcggttcttcacccctggtttcggtttctgttctcagtgtgggagctgttcttggacagtgctgtgtgctcttctccggagtccgaggccaggggagtaactgcagtgttcagccaagtacgagcaagtggaactgacagttgttcaggcttccgtcttgcacacgtcgaggaaacgttgtaaacaagaaacaaaaagcaaagcccttactcctagtgggtcttccctgagccaagtgcttgaaaagctgtgggagtgggaactgttgtcatgatcgaaaatgaaactattctgggaatgccagatttggggcgctgggaaccctgaagtgtcctgcagagaactggtggtggaggggcctctggaggacaaacatctacaatttgcaaatctatcagtgacccagcgatggcacttctggcggtttttcttccaccttaactttgaggtgaggcagagtgacttggaaaccaattctgtgctttaaaatataaaacataaataacttctattgaattagcacagaagtttggctggaggtaaatctttggcgcctaaatctgagcgcttttctctcaaatacgcacgagagctctttggccgtcttatttctcctcttctacacaactgaacaatttaaatgaattatggaccatcactcctcatctcccccaggaaatgaagcttagagcctccttgttcagctaattgttgcttgattaagctgccccttatggatggatagataaagtgattgatgcatgtgcttattaataccatcctggtgcatggaggacgaataaaccgccagcagcttcatttaagcaccacaaagggggtttcctagagtttgttgtatttgcagaaaggctgtcgtcgtctttccctctgtactggaaattacttacctacttggtattgtctttctggccaagtcgttttcttttgagctaatttcagacttccaccacagtttaacaatagtacaaagaattatttttctacatctttggagagtaacttgccaatactgatatcccatcactcctgagtacttgaatgtgtctttgctgtaacgaagatagtctccattgagaccctggcacggccatcagaatcaggaaactagcaccgctgtgtgagtcgcctcccaccggcagaccctgttcctgttggaatgtctcagtcatgtcccttgcagcaggagaatctgatgcagggctaggtgttgaatttcggtgccctgcctccttcattattccttgacttccatgaacttgacacttttgacaatgacaaggcaattttcttagagaatgtgtatccgtttgggcttgttgacgtttctggttatgcatttcttacaagaatatcacggcggtgagactttcttcttcttgcatccttacaggtgatacatgcttttgacttgccccttaattcgtaacgttcatttgatcttttaattaaggagccatcagtcagccttctccatgataaagttagtctttttccctttgtcataaaaaatattttgtgggaggtatttttgaggctatgtaagtatcccatttttcaccagccttttactcactggttagcatccattggtatttcttggctgagtactactttgatagctaccaaatgtcgatcttctaagtccatcattcttcctacatttatttgtttgcattctacattatgggaaagctttttcattcccctatttatttattcgtagattccaattttgttcaatgacagaaatacatttcagtcatgtatttgggtgctcagattgtcttagatgtggccagtgggagctccatcaggttgggttctgtgacttttttttgacatgttgctattatcttttgagcccttccttatttcctttcccaggcttatcttttgctttccctgccccagctctggagtcagccatttctccaaggagccctgattccttttggtggaggatggtgtttggaaaccaagatttgggcactgcctgtgctcattgctgttggggtcttgctgttcccaggcccttttagtgtcaaggttagagaatatgtgtattagttgcatatatacttacacatatgcatgctttttttgttttttttgagacggagtcttgctctgtcacccaggctggagtgcaatggcgcgatcttggctcactgcaagctccacttcctgggttcaagcaattctccctgcctcagcctcccgagtagctgggactacaggtgcccgtcaccacgcctggctaattttttttttatttttagtagagacggggtttcaccgtgttagccggggtggtctcgatctcctgacctcgtgatccgtccgcctcctatgcatgcttttttacctctgtatttatttctgtgtttatcgagatatatgaaaaagcacaaattcaaatcaagtcctcctattctagtgccacagcctgggttattgtagttttctttctttctgtatctgtaacttccttctccagtagtcaaaagcctcacttccattaccctggtatataatataatttactcagttgcctgtgtgtatgtggtcttatgtccccacggttgccccaccacaatgacgatgccctcctcacctccctgttctggctcccagcccctgcacagggctgtggtctccctcctgtgtctatcctcactgcccacatgggcttttgtattctgtgtgccaggtggctgctgccccagccaccctaacaggtgctctctttctgccaatacctaccctggctgcacctgcccctctacccctagtgtctactctattagtttcctgtggctgccataacaaattaccgcaaactgggaagcatgaaacaacagaaatttattccctcacagttttgaaggccaaaagttggcaattaaggtatgggcagggttggttcctattggggaccctgagcgggaatctgcaccatgcctctctcctaccttctggtggctgctagcaatccttggctttctttggcttatggaggagtcactctaatgcctgcctctgtcttcatacaacattctcctttcttctatgtgtgtctgtgtccaagtttccctcttcttaaaaggacaccagtcatattggatttagggcccattctaatctggtatgacctcgtttaacttgattatatctgcacagactccatatgcagaaaaggtcacattcacaggctccaggtggacacgaatgttggggggccactgttcaacccagtacatcttctttgctgcgttgcatcaaatgggcttttggagtaaatcattcataaaggaagggtggaggaaggaagggaagaaggaaactcagttgttttgagaagaatgttctctattactgtattgttcttcttcttcttcttttttttttttttgtgatggagtctcactctgtcgcccaggttggagtgcagtggcatgatctcaattcactgtaacctctgcctccagggttcaagcgattctcctgactcagcctcttgagtagctgagattacaggcacacaccaccatgcccagctaatttatataaattttagtagagatgggctttcaccatgttgaccaggctggtgttgatctcttgagctcacgtaatccgcctgccttggcctcccaaagtgctgggattacaggtgtgagccactgtgcctggcctattgttcttattttctcatctaaaattagggcaccctgctgacatcaggacagtcttggaaaactcaggacttaagagtgagcacaggatggcacttagtgtgatgacactgggctgttcaggaaacacgttcaccttctgttctgtgccaacccggggttggggcacacccccgccccccagaggcccagttccaggtcaaacaactgtctcttggtgcatgttgtcagcccggcgcatgctctgagttctgtaagggtgagtgaacggggaactctgactgtcattggtgctgtgggggaagagagcagcgtgtcagcacgtggactcagctggggactcatggggaagccaccatggtacggcagggcctggaagtttgcgcgtggtccttgattgccctgatggttaaaaccacctgctccccgacttttttcacattatgctctgtgcattcctgcacaaattaaatattctagacagtagttctcccttatctgtggttttgcttttagtggttacagttacccatggtcaactgaggtctgaaaatattaaatgggaaattccagaaataaacaattcataagttttaaattgtgcactgttgcaagtagcatgatggaatgtaacatcccacctcttcctgcccaggacataaatcatccctttgttgagatgagggaatctgctgtagtcccaatactctattatttgactctattacattttctttaaacatcttcccactgtctggtatttgggttagttttgctatataaataatgctctttgaacaatgttgaccataaatttgtgtctgcagaaactattatttgttaaatatcaactattgatggatcaggtactaggctaggcatgttacacatcttatttaatccttaccgcaaaccatgcggaagttatcccattttacagaggagaaaactgaggcatagggtcttgggttctgttaccttctgcgtttggttcctgaagcagtgccctgggaagtggctatagttgccggatggagacctgaatggcttctacagttgtggagatggtgaccagcaccaggggatttctgaatttttggggcaatggcttgttgatttctcatttaaggtctcatttttatcactatactgtatatgagataaggttcctctcctcatctcatatacagtatagtgataaaaaagcgtcactagccaaggctggctcctgcccacttgtcatggatatgggagccgccgaggtcttccctggtctctgccctgcccttagggggctgtgctgtcctggagtcatgtggctgtcagacctcgggtgtcatcctgagtcctgcattgcagctgccatcctactccatgatgaataagggtaggcctatgaagggcctaatcacttattaggaatttgcatgttgccaaattaataagctaagggtcagacatgattgatcaccattaatacccaaaccatttcctagggctgtcatctcagcaggagttgtggtcatagatgagcttacactggctagggaaagctttctgggatgggtggatttaaaactgtctcctggatttctcaaagaactaaaaatagaactgccattcaacccagcaattccattactgggtatatactgaaaggaaaagaaatcattctagcaaaagatacctgtacttttatgtttattgcaacactattcacaatagcaaagatatggacttaacctaggtcctcatcagcagtggaccggataaagaaaatatggtatatatacactatggaatactatgcagccataaaaacaatgaaatcattcacaataagaagcatggagctggaggtcattatcttaaatgaattaacacagaatcagaaaaccaaatactaccacatgttctcacttataagacggagctaaacactgagtacacatggacatgaggatgggaacaagaaacagtgaggattccagaaggggagagagaggaagtagggcaagggttgaaaaactacctattgggtactatgttcactacttggacagcaggatcattaggagcccaaaccccagtatcattgcaatatacccatgtaacaaacctgcacaggtacccctgaatttaaaactgaaagcaaaaacaaaaacaacctgtaatcccagcactttgagaagctgaggtgggtggatcagctgaggtcaggagtttgagaccagcctggccaacatggtgaaaccccatctctactaaaaatgcaaaaattcaccgggcaaggtggcacgtgcctgtaatcccagctacacaggaggctgaggcaggagaatcgcttgaacctgggaggcggagggtgcagtgagcagagatcgtgccattgcactccagcctgggtgacaagagtgagactctgtctcaaacaaaacaaaacaacccctcccaccccgctgcccccaccacccccacccccacccccacaaagttatcttctgaagaccaagagagaagtacttggtatcaagtggtaaaaaacaaacagggctgagagatttaagtaggttggagaaaggagttttggggcacggggtttttgtacttcttggaggtcctgatactaaaaatgaggtcatttttagagtgggaagcaaaacggccccataacgaagtgtttgctcttcatatgcactgaaacggcaggaggtggaaactgacaaatattgaggatgcttactacttcactggttttcagcaccttaaataaatgttaatgtgaaattaacattaagatagtggcgcgtttgccttctatgggacttacttgtgcttctgaaatagttcttcaggttaatcggttatgggctgggcagggcacactttcctccccttctgccttcaaaagaccctggaagcacccaggtggccctgctttatggcagaagcagcaactaaaatgaaacaactgattcatctgcatccaggtgatgcaaagccaggaaaaagcccctctggttctctcttgtttccttaaagagagcatggaggtgaaggggtggagagagggcgagtatctttattttggagtatgggagtgttttcctagtccggactacaaaaggaaagctcgggttggccaggaaacgcagcatgttttgttgatgcccactcgctgggaaagtattaaatggggcaggaagtgtgactttggaaggggctgcataaaggaggctgggaaactgcttcctgtgcacccgggccagctcaggagctggaacgatgtttggcaggctgtggggatcttgctgccctggctgtgtccccttccacacaggctcccagtgcagatgccaggtcagacggaggtgtggggccctctctacctcttgatgtgaaccccagtttggcctgcctgtgcgagcctcatatccaaatgctaagtcagggcctaagactccagttcaaatatgagttctaccactcagtagctctgtgaccttgggaagttacttaaccttacgtgcctcagtttcttcatctataaaatggggaccacagtagtacccacgttcttgggatgctgtgaatcaggtgagcttatcctcttaacgtgcttagaacttgcctaacactgctaagcgcttaatactccttagctattgttaataccctcatggtggaggatattgacaacatcctggtaagtgggacactccctgctggccagctggtatcattttcaagggtttgcaggtctagatctggatgaggcagttactcacagaaaagctcccttgcttaccaacaggttgtgttccaaaggtgattaagtttgcagagtgtgcatcaggctttttaaaactaagcttttcccaaaacaaagctgtttcagtagcaggaacattacaggggtgtcacgagcaggtattttctttccaccagacacctgaccactcactgtgatttggaaagattagaaccggccgggaaacgatgtttccatctttgatgacaaagctttcctcattcatggtagccacatttcaggtattcaggagccaccttgttgactgccctgataaataacaagttaatagttgcaaaatgtctactggatagtgctggtctacattcattgggtgtttgctgggtgcagagtacaaggcctatttaggcctaaggagcgttggtctcagtggattaaagcacatcacaatgaaccagtgactttaggacagtgtaagatgcgtgctaactcactgttagaggcagtgagttttatgacttcaagggaagggggcatgtatgtgtcttgtgttggccaggccaagtattgtggaaaagagacatttgaacaatctttcaaggtatggcgagacgtttccaggctaggcctttctcctgagctccagcctcgcacagctagtagcccagccatcacctctttttgggtatcccagagatctccaaccctgtaggccccaaaccactctcagtatctctcctcaaacatcccacatcttctgttgcagagtggcactcccacccatctagtctaagaaagggaaaaaggtcacacccaagtgagtatgaagagggaggcgaggtagacattcagaaagaagagcctcgcagatctcttttctctgtgaagctggaggcagggagggatctgaaattgcacctgtggaaaatgggaacaggacctggggagaagaaagcaaaaaagatctgcagaggcagagactctgagagctcagatgaggcgatcagccgcccatctgctgcgaggttctccagcctctcacaaatgtttgcagtgtgagcaaacaagacggaggcatgaaggcccgtttgtagtgggaaagtggccaggccactgtgtgggaaggagaatggggccggggaggcccctggagctggaatcccatgttaacgttgctgcccacgttaatatataagcctacgtagtcttgtactctcacccagcagacacgcagtaagtataggcctccgctgtgtggaatgtggaagtggattgaagggagggtggccgggacagggacgctgcagcagctcggggcagagcggagagcccctgaacaggctgccgcgggagcatggaaggaggccgtgggtaatggggatggtctgacagatggagactgcaccccttggtggctgacatggcaatgggtgggagggccagggaagtggctactgagccagggaaagtcaagaaaatgtcagcagagaggtctagctgctttcccattcgtgttcttgcactgtgtttcttacatctgcctagggaactgccctttgagagtttgtggggacctttctcagaaaagtacacatctgggtgaacgttaacacactgcatgtatttttaaggcttgatctctggacgaagagctgctgttcttgttaggctgcattgagaactgttttctagagtgaccactgggtcatctgcagaaccaagaaccagtgatagacaggtgacttttgtgcacacacacataggggccccaagtcagtttgctcgattatggttcggatgcagcacacatttcaggtaccagaggagtctgtggtcagagacaaggtaaattttataaagcagctatgggaatagcttccgaaaggatatagaaaacgtgcctaataggaaaattgtgcatagaatggcaaatatgtaaaactgtaatctggatgattttcagcctggaaaactagttttgtggtatttaaaagcattttagacttttgatttcatatacgtttctattccattaatgatgaaatctattcaccactggcctcctgttttcccatgactcaactggagatgtttattaaacatctggaatctggaagtccattgggttaatggatactaaataacagtgattttcatacttaattgcttatcaaaattattctaggataataaaaaaaattcccggttcttattagagtggggccagggaccttttttttttttttaagtacccccgctccgccccgcttttttttttttttttttaaagttttaaggtaatagcattgcaaggcagttttgggatagtggcatgaacagaacagaaaagaataaaggtgggttatgatgtatttggagtagcagtcctgcctcatcattcatcctgaaaaatctacgtagtaggagaattggtggttgaattgcttgaaaccttatgaggaagactggctggagactcccattcttaaatgaacctatgactttctaaagttcaacaaaacataaaaatcagttttgcattggtgcagataatatgtacactgagaggcatggttttttccgtatctagccctccatccaaacgttaaacgtctttctgatttcaggactggcaatggctgacttcagccgtcagggtcccatgagagtctggagagtgatttgaatgtcgcaggcagagcaggaggaagcgtggccgcataggaaggtctcaggccatgcttcctctctcatatagggggtcctgttatctttgctccgaacatactattttcatgccatgaagttcttgtacattttatttctacctcttagcagtcagtacagctcttagggtatgcttctccttgtttccctgtttctacaaaaatgttaaaaatattaggccaggcgcggggctcacgcctgtaatcccaggactttgggaggccaaggcaggcgaatcacatatcctcttctgcattctacttcccacagtgccccctccctctctctgccgtccacatgctcgcacacacctgcacacacactgtcgggaggcagtccagcctagtgcaatgtttttataccccttcaaccccaggaccagtataatataatgtgacattaaatggaagcaaacgtttcataaaacaatgcttacctcactttgttcggggtgctccctcattttccattctatcatattgtaaattaaaattaagttaaaagtgctgatcttaatgcaacaaatgatcccacgaccctctggtgggttgttagcagagacttgcaaaacacaggtctagaggtttctggcatattctttggagtcagacggatgtagatttgaatgtttgctttaccacttaatggctgtaagtggagctttgtaagtagcttcatttcctcatctgtagaatggagagtagctactctgcctcatgtggcttgttggaagattaagtgaaataacgcatgaaaggcatttgggctgagggtcaggctctagttagggctggaatggtattaatgatggggatgatgatgatgatgttcaacttctaactccagctttcaatttacataactttcatggaaattcttacttttgctgaaaaagcacacagaagtcgttgtgaggaacttgcaggaggaacttgcatttgggaaaagactattgtgtgcccaggaaaaattactactaaacactgctgttagattcctatacgcgtgtcatcgtgtgtgtgggtttttttttttttttttgtacgttccaatagccactgtcctgacccagagcagtagttctagctcacctccttccctccatttggctctgtatagagtgctgcatgactcgtgaaactgaagcatggcttttcccaagtcgtgcactcagaagtcattatagcagcctgcgtaaacaagctcagactctagctgggcatctgagaccctcctgaggttcaagtcctgcctcctcatctagaggcgtgggtgacttagacattttcttttctttcttatttcttcttcttattttttgtgggggctgcctttttggctatgcttttcctaatctctaaaatgatgataataggctgggcacggtgacttatgcctctaaccttagcagtttgggaggttgaagtaggaggatcacttgaggccaggagttcaaaccaacccgggcaacataggtagtgaaacccctgtttctacaaaaatattttaaaaaattaggccaggcgcggtggctcatgcctgtaatcccaggactttgggaggccaaagcaggtggatcatcaggtcaagagttcaagaccagcctgaccaacatggtgaaaccccgtctcgactaaaaatacaaaaaaattagctgggcgtggtggcgcatgcctgtaatctcagctactcaggagactgaggcaggagaattgcttgaacccgggaggcagaggttgcagtgagccaagattgcacgactatactctagcctgggtgacagagcgagactccatctcaaaaaacccgaaaaacaaaaaattagctgggtgtagtggatgcacctgtagtcctgggtacttgagaggctgaggtgagaggctctcttgaacccaggaagtcaggactgtagtgagctaggattgcaccactgcactctagtctgggtgacagagtgagacctgtctcaaaaataaaatgaaaaaataaaatggggatactagtatttaactggttagagctgttatgagagttaaagatgattgatgtgaaatacccagtgcttgcttctcacacaccagtgactcttatgaagacacccctgttggtgcataagacagttgctctgctcacatcagcaaacacatcttcagtcctgctttggccgccgataccaaccttttacctcccctggcttgcctgccaccttctccctgcctagacagcacctccccatccattaaggtcttcctttaccataaagctttcctttgccataaagctttctcttatatgcccatttaacaatgatttatgtattccttatgaactacctaacttagttggcaattaataatacactaccttctgatctttattgcatagtcttttattattataattataggattattagttagctttatgtgatttatctctcacatcctcagttaacttatttgttccttgagggtagtgatcatgtcttaccgtctttgaatcccccacagcactcagcacagttccttgtaacaatgtgtgtttaatgaatttttgctgatccattgggtgactgggtaataagaaaaggcgttccatggccgggcgcagtggctcacgcctgtaatcccagcactttgggaggccaaagtgggcggatcacgaggtcaagagattgagatcatcctggccaacatgatgaaaccctgtctctactgagaatacaaaaattagctgggcatggtggcgggcacctgtagtcccagctactccggaggctgaggcaggagaattgcttgaacctgggaggcagaggttgcagtgagtcgagttcgagccactgcactccagcccaacgacagagcgagactctgtctcaaaaaaaaaaaagaaaaaagaaaaagaaaaagaaaaaagaaaagctccagagataatatgaatcctagggtaatgttatgttcctcaagatctgatttctatttacttttggtagttccaggtcattttcattagatcagggattgagatgattcaaagctgggcttcagcctttgatattagtttatttctacttagttgtattacttacaaagcttgtgagggtgtttccaggaaccccttttcctagctgcgtcctgatgttcaatttttgtctcctcagtcacctgagtgtgtcaaaagctctgctttcaaagccccacagcctcctcttcagaaaggagcagctgtccctgcgctaggacgacagcagccctaaatgtcaggttcaccttcctgggtttctttttctcctagatcttgcccccctaatttttaactaccttgttagctctctgatgcatttaaatggattttaaaaatatattttgtccatgtttcttagttattcagcctgggagtcaggtctgaattacctactgtaccattaccagaagcaccacccccctctcagctaaggaatttattaccttaaatccagcaggcacatttagaagtctctggaacagagaattaacatgattaaatggtattttaggaagatgactgtcagtggtttgcaagacggagaggagtttggaaagtctcagtaagtagaacaattaagaggtcttcataactcagtgctttctaaagtacgatgaaggcagaggttagagtggataagcctgggtgtttcacgttagataggcctgaatttaaatgagagtcttggctctccacttactagcaggtaataaaggataataaagtccctatgtcctagggttgtaagggttaaatggcaaaacttgtagaaaaccctaggttttttattttctatttttagagaggggctgtctttctgccacccaggctagaatgcagtggtgtgatcatggctcactgcagcctcgaactcctggcttcaagtgattgtcccacctcagcctcccaaggagctgaaaagacaggtgtgtcccaccacacctagcaagaaaaccctagttttaatgcccagcacatagtaggtgctctgtaaatggtaaccgttgctcttactattccaagaaccaaaattcagttatttgggtgaaaattcaacctcactgttaatagcactaatcatggatagtactgtcaacttcatgggggatcattcgtgacttacgaatcacaatgaatagcttgcatgccttatatagcaggcttggcaccagtgatattctcagtacccaccatgggctgaattgacttatggccagatgccacagttttgaagccagtcccagcctcaaatctcaaaggtgtaaaggtagatgattttacaacgtgcctttcgtcaggctccagggtagatgcttcaactcttttacttactttgaagtacaggttgctcatatattaggtttgcagaaccataaaattttagcattttacttctaaaaacaacctgatgtgcaagaagagaagcttacagaaaaaaaaacatcagattatgattcatcgtatcatggataaccccaggaatcatctgtttaaaacgtcccatttttctagatgatcaaagtgtgggccgggaagatggagggattagcccaaggacacacaccagcaatggcagagtcaaggtcgcgacacaatgtcctgatttctgtgcattttggttcttagacaaacatagccgctctgtgtcatctccactgagctacctgccttctctaactctgttcgaggttcacgtggcctgactgttagcgcctgtgggaggcttgccttacagaaagaccagcgtgtcaccttgactttcgataatggaagctagacgatacataccgagtaagcatctttctttccagtcctcagtcctctgaccctctgtgcctgtcatctcagtcttttaatctccggaaacataattaatctgtttttagtgtccaactaaatgatccgtttctggtgctaggcttgaggtagattctgcctttgctgtttttcacagaagtaaagatgtacgctcaccctcggctagtcgtgagaaacctgtgtcaaatggcaaactttgtaccgtgtcgcgaggcaagcgcactggtaatgcactacctgcccagggcgtgggagatgggtcaggggagaaaaatcaagtcacaaaggagaagggccttcatgtgactgggttagcttttcattgagtctcattggagatgtcctagctacaaacaaaccaaccaaccaaccaacccaagcaaacaaaacctgaaataagtgtagccctttttaagtttattttttactctgatgaaatacttgttcgattttttgctttttctaaaagttacctataattagtaacagtcctgattgaagattgtgaacttttctaataagtttgcggtttggctgagctgcatccttactagacaggcatgttgcgtaagtgaggaatgcacccagccggtggatgacaagcccggcacgccgaccagtggaggagtctatcagaatggccaaaatgaccacacggcaggagcatgggagagccaggccattgagcatgaacaataaggggactctagagctttgcttctcagagtgtgacccaaggacctaggggcttgtcagagatgcagaccacagcggtcgcctggaatccactgacttgggattcctgtgcacgttcaagttggcgaagcgctggatttcaggatttcacactcagctcttccctttacgttggccaaactgaccctatcattcttttgctaaaatccttcggtttcctcttcagtcttagatcgtggtcatgaccaaaatcctaggcatggtcttctgggtgagccgggtctctgggccctccctgtcactgactgctgtccacaggggccaccttgcctcagggcctttgcagctctcccttctctgttagttgctcagggctgccgtaacagatggctctcacacaacagaaatgtattccatcacaattctggaggtcagaagtctcagatcaaggcatcagtagggccctgctctgcctcaagggtcttggggagaatccttccttgcctcttccagcttctggtggctccaggcatggttagctgcagcagcctcactgcagtctctgcctttggcttcacgtgcccatcctccctctgtgtctgtgtcttcacgcggcattcttctctgtgtctgtgtccacacttccctcttcttataaggacatcgggttcctgcgagctactggtcacaatattttgtcagctgatcattgtataaccttgtcttatgtgtttctgtttgaagacaccctctgtaatatttattgttgattgatgagcattgaactcacagcactataatgcatgcctgagcaaagcttatctaatatacgtattttccctgtaaggcgcatcatagccttctggttcttaggaacccgggaaggcacttcagcacaatgcctgggggccattttaaacagcaaagtcaccaaaaaaagcacaacgatgtgacaaatgtcgcactctgtagcctgtgaaaagaacacttgtctgccataggagagcaagagcgggaaggcagagtgtggccttgtccagcctcagctgggaacacgtgcatcagatgacttgaattcagcacacgtccccgagtgaccaccaacgcatctgagtattgatttgggggttgtggatatgtttcagtgagtaggcaaattcacagatacagaatctgcgaacagtgtggatcgaatgtgtcttcacacacaggctttagttttaaagacagaaagttgggttttttgtcttggtgctttgctttacctgacaattgactttttcaactactgtttccgtttaaaactgatcttcgctgtctttcagagagatgcctgtctgtgagaactttaaaagccatcactaatataagaacgggaaccactgtgggctggagggggtcacctgaataggaaccataccatatggctttttgaactatttcagatgtgaccattgtttttttttttttttcccccaactggttatttgtgagaaacataatggaggaaatattatattctgagtactagctggaggcagggccacttccacacgcctctcgtgtttccatattgccaggctcaggctcagctgcagcgccagggaccacgcacagcacttctgcacgtcaggctgtcaggagaactggcgtctgttgctctctactcgtgaccactatacctacccctatcctgtaactactcttccctcgctcttccctctattttcttgaccgctctggatttagtggtctccaatctgtgtcttgaggtcttttccagagggaagatcaggctgggctggtggtcaccaccctggcgggcagagctcttgcagggtgagcctttgaggggtcaccagtgcactcctctgtgcacagcttttcccagcactccctagtcttttctgaaactctttatcatcttcatggggcatggtacctcccttctttccagtgtcctgttaggttgggagttcctagatggcagggaatgtcatctttccctgttcctggagcatcattctcaatacatgacctttgaatgggtggatgaacaaatgaatgaatggaacaaatgaatgaatgagaccaagagcagcagtatctgcaactccttgtggccattccgtgttcttgtgaaatatctctaaggttcccgtttgtgtctcaaagaatggtggctggagcctccatatgagtggaggaggccaacctctgacggcaccccacctaggccctcagagccgtcttcagagctggcctgggcctggcagtgagtgtttcctatgtggaaggcaacatttgcgctttgtaggactagcaaaagacctagaagagggcggagcatgggagctcatgtctgtaatctcagcactttgggaggtcaaggtgggaggactgcttgagcccaggaatttgagaccagcctgggtagcatagggagaccccagctctacaaaaaataaaaaaaaatagctgggcgtggtggctcacacctgtggtcccagctactgggaggctgaggtgggaaaatcgcttgagcccaggaggttgaggctgcagtgagctgtgatcatgtcactgcactcccgtctgggtgacagagtgagaccctgcctccagaaaaaaaaggtgatgctcttcctgcggtagaacttaaatttggttaggaaaagagagtggactatacacagctgagaggtgtataggtaaggcaagggataagatgaaagactttacttaaaacaactgccctaaagcaatgtttggtttttcaaaggagcagtgtaagatcagtgagtaacataggagctggaggcagagggactactttaggcgggagtggtctgggaagcccttgtggaggaggaggctaggtcttagagggcggataaggacctgcaaggccagggaatgaagagcagagggcacgggatgagcacggagcaggaggtgtctgcagcagtcagtgggccagactgcaggaggcatacaaggaaaaggctgggccagactgcaggaggcatacaaggaaaaggctgggccagacagcaggaggcatacaggcccagggtgaggcccaggggctgggggtcacggaaggatgcttgtaactctggcatgttctgggcgcagggaatagaggagagaggaagtccatggcaagctgggaaggagagttattgagacatcagcccaaatgccaaggaatagaattttcagagctcaattttggaggaaatgaacaaaagaaggaagggaccaatcaggattgagaagaggattacagtgtcacactgtctgtgaggtcctatagaatggaggcttgcacctgacccatctttgcttttggagcccagattagatgtgaatgcaggcatagatagggtgaagatgagtgggggacagtgtggaaggtactttgttagtgattcccctctggatctattccgatggaccaggagaagtctatcttagaaaggaatctggaagcagcagggaggcattgtgtggactggcggaggaagggtggtcagactatgaaaatgatttccaaagggaaagtaagttaaaggaaaagggggtgatgtcaggtcagcggggaggctggcattgaagaaagacacttgggtgagagactgcattcgggtaaaagcaaaagcaaaggagatacctgtgcagggttccaggggctctggaagtaaagtcaggagggacgggtagttggtggaaaactttgggaaagccaaattaactgattcctttcgagctttaaatgttaatattgggggttgaaagcgtttgtataacccagattctcaaaaggaatggcttggctatcataattttttcccacaactgctttgctctgcccaccccttggctcttggaaggatcatccccaaaggcgttggggcctctgagcaacggaagcctcaaaacacggccagtgcagtggggataaagcctccctctaggcaaattcctggggaggagtgtgggtcctggtctccaatgtccataggaccctcccagcggagggcaggcctggaccatcctgtgtccccagatagccccctggccggtgcgagggctgggcttgcacaggtggcacagcccctgagtacaccgaccccccagccccctggtccccagccccaggaaaggagagaaggaaagagtcaggcggggtgtagaactctgcagtgcagacaccacactgagtggcaccaacgcctgacgctgtgtttctctccctcaagggcaccatgccggtggaaaggatgcgcatgcgcccgtggctggaggagcagataaactccaacacgatcccggggctcaagtggcttaacaaggtgagtgggtcagggtgggtgtatgtgtgagagaggtcctggctgaaacacgcccatgcggactgctgaaagtaaaatcgtgtgtattcaaaatcttaggcttattcatgacaaaaaccagccaacccaaaatgatcataaaacatcaagttatcatctcaaaggctttttttcttttagagacagggtctcactatatggcccacgctggagtgcagtggtgcagtcataactcactgcagcctcgacctcttgggttcaagtgatcctcccacctcagcctccagagtagctggaactacaggtaaacgtcaccacacctggccaatttttgtatttttttgtagagctgggatctcgccatgttgcccaggctggtcttgaactcctgggctgaagtgatcctcccacctcagcctcccaaagtgtggggattacaggcatgagccactgaacccggtcacaaaaggatttgtatcctgtacgactgtagcctcagcctggagtctccaatgtctgctcacctttggtgttttggctgactgcctctcgaaagctccttgctttttttggaaagctccttgcttctttgaggattcttaccctcttccttctccaaattccttttttttgcttctcctggccttttaggactagaggacatggaaactccagggttttatattaggaatggagcatttccttttccatgttctctgtttaaagaaagcttgtttttgtctttaaaaaaagccttctttttacctctgtaatgaagccctatctgtgtgtccacctttcctaagaaagcagccagtcatttacaacctgccccttccaggcacaaacactcccttactttgttaacctaaaaactcttaatttaattgatcctagctgttaggggtgaatcagaaagagataatgtcggcaaaaatgaaaaacttctagaactatataatctagaaaagcaactaaatatatatcatgccttctttaaggaggcccaggagagaagttcctctcctaccagaacagttctgagtcaatgcctttttcctcttctccactccctccccttttcttttttaatcttaaggacacaatgaataatttagctggccaggctttatctttgtatcaggtacaagagcttagagccagattgcagattgtagcctgcttccaacaagggaacaggatattgcagtataattttttttaactaatatcattcctggccttattgggtcttttcagatatctttcaaatcttatttctttttactattttccttttatccacttattttgattttttttttgttttctttagacaaggtctccctctgtcacccaggctggagtgcagtggcacgatctcagctcactgtaacctctgcctctgtgctgaagcgatcctcccacctttgtctcccaagtagctgggaccacaggtgcgctcctggataatttttatattttttgtagagatggggtttcactatgttgcccagactggtctggaacttcaggactcaagtgctgcccgccttggccttccaaagtgctgggattacaggcatgagccgcagtgcccagcctgattttgaatttaatgttactgtgttgaatatgtctgtctgagcctttctgaaacaaggtgaggcactaagtaaatagaaatgaagaaaccatctgcttatttcctgtgacctgtcccatatctcaaggtcttaccacaatgtatttttctagggttgctctatctatagtgttttagatttacatatgtaatcagcttcttccaaagaaacaaacaagaaatggagttgctccttggtcagctcagttagcaggggtgccgtggaggtataaggaaggggggaccagagtaaaggggagctggagagccagggtagcaaatgacactgaatgaaagctgacttgtactcagcacttactgtgtgccaggcacccttctaagcaaggtacatgcattagctcacgttccgccaccatggggtaggtacagttaatattttccattttacagacaaggaaaccaaggcacagagaggttaagtaagattctgttttgaggaacaaggtagcattactgtttgatgtggagtgggagaggaaagcaaatgctcctgtgttctaaagagaagcaagtggtctgcttctgcttttcctttttcaaaaatacctccactagttttggttggcaggatgcagtggagaagagacagtgtctcacacctctcctgttgagcaggtgcctgatatgttgaccgctgtggttggtttagactaaccattagtcccttcttggtgctgtagtagatggaactgtggctcccggagaagatatgtccacatcctaacctccagaacctgtggatgtcacctcatttggaaaaagggtttttgcagatatagtgaaggaccttgagatgaaatcatcctggattttctgggtgggccctgatgccaatgaggagtgtctttataagagacagaagaggagaaggcacacacagaggagaggggcatgtgaggactgaggcagagactggaaataggcagccgcagccgagggactccaagaagaggcgaggaaggatccttcccagagccttggaaaggagtgagccctggctgggcgcagtggctcacgcctgtaatccccgcactttgggaggctgagttgggcagatcacctgaggtcaggagtttgagaccagcctggccaacatggtgaaactccatctccactaaaaacacaaaaattagctgggtgtggtggcaggtgcctgtaatcccagctacttgggaggctgaggcaagagaatcacttgaacctgggaggttgaggttgcagtggtggaggttgcgtgagctgagattgcaccactgcactccagcctgggtgacagagcaagactccatctcaaaaacaaacaaacaaacaaacaaacaaacaaaaaaaaaccggagtgagccctgcagagaccttgattttggacttctggccttcaggactgtgatggaatacatttctgttgctgtgagccacccagtttgtgtaatttttcatgacagtcttaggagattgatgcaccctctaagggtcacttcctttctgggactctcagttgagatgccttttcttccatctattttgtccatgtttttctgatacaggaccagaaggcaaatggatttccctttgtgcaaatgaacacttggcccctttcaggcagtccttacctgctgagcgtcactcatctggctcttggctcgagagttctcttcccgaggcatggaaggaaaggagacctctgtgtcatctcacagggctcctccgctacagctggacctgagccaggctgatgaaggagagcgtgcccgtggctgccggcccgtgccgcctctcagcaccgccctggaacagaggccgaggcctgcactgtggccccgaggccctgtcaagctgcatcctgctgaggcctagccagagtgggcacgtggcattgctcgtgcacatgggcactgccatcactgtcactgcaggcctcggctggggtcaggatctcttctctccatacctacactcccacagggcatttttttataggtttccgttaacttaggcttgttggcattcatctgtccatataaatacttaactgagagcctaatgttcttccctcccattcacaagcattctgcctgggaatccttgtttatattttgagtggtttgaggtcattccaagatctcttttgccactgaagattgttgtaactcttagaatacactgtccatggggctgtgggactcacttctgcttcagtcggcattcaggatgtgttcatgtttattgtgaagtgctccaggctgggagccccatgcaccggtgccttggctatcttcttcatgtctgcatgctcagggccaggcctagtgcctggtaagtgggaggccctctgtcaaaattgttctgggaatacacagatgaatgtcatggacttgaaggggagcaacattggtggtgtttttgttctgttaagataatcagatttatggacactggcttggcagttgtcacatggctctcagaaagtccattcaacctactccattcttagtaagagagaaagagttggttaattaatgccttaaatttgtttccatcctctattgtcttagtctgttccctgttgcttctaacagaatacctgactctggataatttgtaaagaagaggaatttatttcttatagttatggaggctgagaagtccaaggttgaggggctgcatctggtgagggccttcttgctggtggggaccctctgcaaagtcctgaggcagtgcaggatatcacccggtgcggggaaagagcatgctcacgtgctagcacaggtctctcttcctcttaaaaagccacaatcctacccctcatgacaactcattaatccattaatccctgaatggattaatccattcatgagggcagggccctcatgactcaatcacctcttaaaggcctcacctctcagtactgccacattggggattaaatgtcaatataagtgtcatagggggcaaatattcaaaccatagcacctacttttaataagtttgaaggagggtgggaatggaatgggtcccttggattcctctgaaggaacagcgaggaagtttggaaaagtgcattataaccagctcatgaatgagaccttggctggggcaatttacctttggttatgggtatttgcaaatgtgcatagcatgtttgagtagcccaatgacaaaaagaaataggatagcaaattttcatatgcctgtatctagatgtatgaatattttgccttatctttgtgtgtgtgtgtgtgtgtatctgtgtgtatctggtatattaaagcagctccctgacagcatacattgtaagacataagggcattttcttatatatccacaatataccattgttaattggacaaaattagtactgtttaatatcatcactgctccattcatattaagaatgccttgagtattcccaaataatctttttacagttgatttgttcaaatcagaattcaaagactgtccacaggttgtgtttggtgtttatgactctaagtctctgctgactgtgggcctctgtttttttccttctcgccattgacttgttgagaccaggttagttttgggtttgtccacatgcttgcttgtggttccctgggccatttcttgaggaaggaaggaggcagtcacatccggggtcctggtttctctcgtggctccatgtgacccccaactctggtggggttattgatgttcttagttcttcctggatccatgcactaaggcaggggaatcatcagatctttccctttttttcactttgagagtagacttgtgtttgtgtaaacatcaggctatctctgaccacggtaaggagtccagacaaaaatagcacactaattggaacgtcttgcaaatgttggggggaagaagaggcagaggagataacagaactagtttccatgtggggccaaggaacattgttctacattgctcaaaataatgtcagatgcttttctgaagtcaagcagcgctcatctctcctgccttccttcagatgggcagagttgtgcacacacgtacaaatggtgggccctggcatggcgcgtctgtctatacacagcatgtaccaccaccacgtgtgcaggactggtcactcggggatgagacacctggcacatactgacgtcacggggtctacacacacatagcaacaccgtcatgtcccatggaacacacaacttgtgaccagaatgtttactggtcagaatctctttcagttttaaaatgaatcttgctttctcttaccttttcatatggtcttcttcaaaaaaagaatctgtgatacaattttaaagatatttctgataagtttattagtcttttcttttttttcctgaagtatgaaaaactaggtaaaggtgacatgtagtttaaaaaatatttaccattttaaagtgacattcacgatgtcatgcagccatcaccactgtccagttccagaactttttatccctccaaaaggaaatgctgtacccattaatcagtcacttcccatttccctcccccctagcttgtggcaaccagtaatctgctctctgtctctatggatctctgctctctgtctgctctctgctctctgtcttttctggaatatttcatgtaaatggaatcattcaatttttggccttttgtgtctggcttctttcatccagcataatgttttcaaggttcgtccacatggtagcatgtgtcaatactctattcctttttgtggctgaataatattccattgtatggatataccacattttgtttacccattcatcagctgatggacactcgggttgtttccatcttttggcttttgaaagtagtgctgctatgaacatttatgttttggtttgaatgttggcttagaattctttgggtatatatccaggtgtaaaattcctggatcatcaggtaattctgtgtttcactttcttgaggaatggccaaactttttctccagagtggctgtaccattttgcatttccacagcgatgtgtgaggattccagtttctccacatcctcaccaacgtttgttatttgtgtatctttttttggagacatgtctgtgggttagtctgtttcatgttgctacaaaggactacctggggctgggtaatttataaaaaaacgaggcttctttgggtcagggttctaggctgtacaagaagcatgaccttggcatctgcctctgttaaggcctcaggatgggaggcaaagggcattacatggcaagagagggaggaagagagaatggtgcaggcgacaggctgttttgaataatcagctctcaccggagctaatggagtgagagcttactcattaccacgagaacgacaccaagccattcttgagggatcctgccccatgacccaaacaccgtccaccagaccccacctgcaacactagcgatcaaattttaacacgagattttgaggggacaaacacctgaactattccagtctactcaggcctgttgcacatttcaagagggtccatagtgtatgttgctgggtttggtcagcgcttttgtagttgcatggcttttgcggtttctgtgggactaggtttggttgtgtgtgtgtgtatgtgtatgcatgcatgcgtgcagatgcttaaaaagatctactttatctgtatcaattttgtgtcttgcaagttagatttcagattgtgtcaccctagaactcctttgatctagaaaaaagtgcaacagcaaattcttaagaatctcggtgtttaagcataaagctttagattctgggcatgcacttcaggaaaagctctttcacgaaatgaattttcacttgtattcattttcatgtgaacatcaataaatggcattaagtgattttgctgtcgattttcatctacattaaagcataaaatgtcactcagcccctttctgatcactgtccttttgaaattggctaacccgaagccctctctgtggatgatacagaatgaacaccgaggaatttatgaaaaagtctctcactttcagttctcctttaataactgactttttagaagatggtagaattttccttttaacaggttttgggaaactctccaatgttctgaaatagtctttgttctggctttgtgattggttctgtggagaggcgctgaatctctttggggacagctgggaccctttctgtgtttcactatgtgagactgaagtggtggaaactccctgctgacatttcctctccttcctcagcatctagtgcagggatccgcatacctagcaattaccagaactgccttgagagctttgaaagagtacaacctcctgggctttaatctccacagaatccaggtctcaactggtctgtcataggacagggactcttccaaatctaaaagctgggagacaatgagtgggtgattaagtaatagcatatggagtcgcatgacctgggttttgaacttagacacttattatcctgcaagttccttgactaaatagttaaaatctgcttcttggtttcctcagctataaaatggaaatcgtaacatatacctcactcagtaggctgtgggaggaagacaaaactgaggtccctgtggatgtgggtagtcagatgcacagtgccaatgggaccttagtacctgccggtaccgccacaagagctgcttgggccaggttcctcatctgtagctttactaagagtacggctttgttactaaaccatgggtttccaatcatgtgtttttcagggttgcttgaggcggttttgagttacagacctcaacactgagagagatgtagagatagtctgatataaggattgtattgagggatgtttctccagaaaaatgtgtcatttcataacctctacctctttgtttgcacttcttgctatttcttgcaggcagtagacccacagggattcgaacattactttctatttctgttggatgcacaagcaaatggagatatttggtttctgtgacagtggcctcagatgtacccgacttttctttagtagcatcaagggttttggaaacttgtctaatttttaatttacctaagatagctggagttactatttaccaaacgacgagaataaattataagagtaagcattagaagtttcggtaggtggccatttttctgtggttttataaaaaaaagaggcacagggccgggtgtggtggctcacacctgtaatctcagcagtttggaagcctgaggtgggcagatcacttgaggtcaggagttcgagaccagcctggccagcatggcaaaaccccatctctaccaaaaatacaaaacttggccaggcgtggtggcacatgccagtaatcctagctactcaggaggctgaggtgggagaatctcttgaacccaggaggtggaggttgtagtgagccgatatcgcgccactacactgcagcctgggcaacagagcgagactctgtctccaaaaaaatatattgaaaactagaaaagaggcacaaataatggaacacacaaggtcaaatcatcacctttgaccttggaaaacattcctgctctgcaagacttcacgagactgactgtcactcggggtagtctatcaagatttgggatccagcgggggaagtgggtttggtttacagtagattttcttgtcagcagtcaacacattcagcgatgcttgctggggaatcttgctggctagaccttcacaaccttttgcaatggtgggccaaaacccatgactccagttctttaccttttttttttttttttttttcaggaaaagaagatttttcagatcccctggatgcatgcggctagacatgggtgggatgtggaaaaagatgcaccactctttagaaactgggcaatccatacaggtactaaaactccctgcggcgtttatagaggaaggcactcttgcttagttttgtttttattacacataaaatagcctggcttatgacctcatgaagatggctctgaaaaacctgtgacttgtccctaggcacatccaggacacatggggtacaaactgcagccctcagaagtaatgctcccctcatcccatacactcttagtccttcaatttcctataaatgtggtattctaagaagttccctaggtgttaccggggaatagaaactcagttgttctgatgctataaactttggtcaaatttatctcccccccaaaaaggtagtcagaaatacctgtatttattacaacctttacgtagggagctgtttacaggaatggactttgttggagcgtcagatgaaaaagaggcactcagcttccctctgcctgttgactttgcagcctctcagtcttctgtatttttcttacgctgatgctccattcttccagcatttatagtttcctcaagctgttcagtagaaccagggtgaccaacttgtcccagtttgactggaactgttcaggttttaaaaacaaaattcccacatcccaagaactttctcacccccaggtacaccaggacgattggtcactggaggtatagcatggagtgaaaaggtttccttatactgcctgaccagcaatactgtgtttccagaaattccttcctctgtatctaatgttttctctctttttcttaatctttgtctcttttgttaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggtaaaggcatttacagactaaaataaggtaaatcaatttgtgtcatcgtgccttcgtgatctcttcatttctacatctgcagtcagtttgcaggtagaatagcctgttcatgctgtaggggatcattccgcccctacctggcttggaaacaagactttcgattcaccaaaggcagtgaaagatacatgtggaattttgaccatgtacagattaaagcaacaggttcattgagagtttcagaaagaatttaatttgagggaaatgtttctctggaggcccttcgtgaattaatccaaaactacatttttgttgccacaggaaagaaaccaaagacagaaaaagaagacaaagttaagcacatcaaggtaatcttgggtgattcagagagaaagccaaagttgggatcctattaatgactcatattctgccttgtaaagatgagtcacaggacctcagtgtgtcctctttcttcctttgcttgtgtcttctgtgctttacatgtttgctcttcagcatgtatccacttgcagacatggaggtacacagggccctgcctcatcccgtttctctgggaaatttatgaatgaagtcacagattctcactgtgctcggcaggctgaggcctccatctggccaccacagccgttgccagtggtcattttgtgccagctaaactccacaacagcttatgtctcatactattaagtatattttcaggctattaagtatactttaatatgtattaaatgttatagacctctatacgatgtatgaactctatgttacagacattccgtcacaggcccttcggtgggggacagagtggtcaatgtcagcactctatcagcacagctctcaatggctgccttctgtccactgtagaatcatctctcacaccccacaagggttttccatgggatgtgcatgtgtgtgtcagcttctcactaggctgtgtcgtctgaactcccctacagtctgaggatctttatgcatagattaggtggcccttgttaaatagtaagagaagagccgaatatgccctgcaaaactggggacgagcttcagtggctgagcagagagcatacactgcggtcacagacccagggatctcagagagattgtcgagctccctggcctccctttgcagatgaagaaatttaggcggagggtgtttttgcagtgatgctttcagtttcacttttactagtttttatttttaactaaatttaaatattgtactgtattaaaggcctaattttgttttaacttttcattgtggaaagattttatgcacataggaaggagacagttgagtaaaatttaccccataggccatcattcagattaattttaaccttaatcagctcctggccagttttgcttcatcaatagcccctcccatttcctgacttctaacatgaaattgcagcccttcaaccatttttgacttacagaagtaatttatttatttaattttttttaaactgagatggagttttgctctattggcacaggctggagtgcaatggcgcgatcttggctcattgcaacctccgcctcctgggttcaagcgattctcctgcctcaacctcccgagtagctgagactacaaacacgtgccaccatgcccagctaatttttgtatttttagtagagatggggtttcaccatgttggacaggctggtcttgaactcctgaccttaagtgattcgcccacctcagtctcccaaagtgctgggaatacaggcgtgagccacggcactcggccccaaaacaattttttatagttcagctttttttttgaactattttttggaatttgaagcaaattccaaacctcatagcatttcttccataatagttcagtatatatatttaaaagataagtgctctgtaaaaataccatgatgtcattactgtacctgaaaaagttcacagtaatttctcaatatcagtgaatatccagccagtggtcagagtttcagttgtttcatacatgttataacattcgtgtagtttgttacttaaattaagacccatataaaatccacatgtgatttttgaatgtcttttaagtattttttaaggatatatgtttctcctatattacctcttaaaacatttttttttttttacaattgaacaaacctagttgttagccatatcgtttctcacagttttttttttcgttttttttttttttgttttttttttgagacaaggtcttactctgtcacccaggctggagtgaagtgacgcgatcatagctcactgcagccccaacctcccgggctcaggtgatcctcccacctcagcctccctctagtagttgggtctacaggtgtgtgccaccaagcatggataatttaaaaaaattttcttttatagaggtgaggtttcattctgttgcccaggctggtctcaaactcctggcctcaagtaatcctcttgcctcggcttcccaaaatgttggaattacaagtgtgagcctggctgagtttgtatttttaaggcctacgttttgattcatgttatttagtcagaaaagcacagctttctcacacatgtgtgagaatttgctacaatttcaagtgtgactgaatcgtatttactactcttttcccattatctagctcagtgcctggcccagaacagatcactaatacgtatttgataactgaatagatgcatccgcatttgttgactaaatagatgtataaataagtaggatatgtggggtgggagtgaggggttttccattaggatgcagatttaatttcataatcgcagttaatggagaaataagaacggagtaacagatgttgccttttcagcacactttgctcacatgtacccactgtattccatcgaacgccagatgccaatgatgctaagatgcactgttattttatgtatctcttagaaaaactgcttgcaatgaaaccatgacacgtaatggattgaaaggcatgtcctctttcagggatgtggcaatgcgaggaaatgtacatcttagtagttcatgccatgtggtggtcccgtttgtctgggatctctacagccacatgggcactggtggtgtcttcacatggccctgaaatgagcaagttgtggaaggcacggtcctgggtgggcttgaccatcctggcccagggaagtaagtgagagatcccgttaggtgcagccgtgtgggtcaagagccacctcagccaagtgtgttttatgaaatccttgtgccgtgaagatatgattcatacctgaaacttttttcttgaaaggacctgattccttcagcggaaggcaggtgattcattaggcctaaacacagccttacttttgaatttagatctacttgcattgtgctttccagtgtagcagggaagctcagaagaggccagtgggcttcccgagttctgtgcttcctggctgttcaagctattgtgtggactcagtgtctctgtagagtgtttgaaaagtgaactccctagggcgtctggaattggaaagtcagaggacaattactagctattaatatattactttttaattgtgtatcaaaacacccaagcactgagttaatatatcctgtgcaaatatactaaacctacttagtctatccaaatatgtaactggatacactacgtaggtttcttctactgaggaaatttgtctttcatatggtaactaggtatgaatatttgctgttgaagcaagcttttcccaatcttcaagttgaagttttaattagcaaacaatgtttacaacatgtaggccaagtattagaattttcttggggtcactcatgatttatctccatgctatatgtcccccaacaaatagtctccccaagactggaacacccaaggcccattggccatgtggcaggtgcagaaacggcctcagcatcctctgacatttcgctttgtgagcatatccctacaaactcagtcagccatgttttccttgagctaagccccacctgtgcggcggtaactggttatctaaggaaataagaacaagaaaaacagctgggtacagtggtacatgcctgtcccagctactcaggaggctgaggtgtaggaggatggcttgagcccaggagtttgaggctgcagtgagccgtgattgcaccactgcgctccagcctgggcaacagagcaggaccccttccccacctcaaaaaagaaagaaaaacaataatgagaaatcctggattctacatcatcagtgcatgtatatgtttcagaaaatatcatggaacggtttgctctgagacttcagacaaggccaagaacagtaagaatagaagtagttaaaacagaggggtgctagttgatatttttgagctgattccaagttcccagctatgatttttgtctcactgagttctccctgtgatgggcaggtcatttcccttttatacatttaggaaatgggtgcacagagaagctgattcattttcccaaggctgcattgctttacagagctgagatttgaatccaagtttgtccaccgggtgcctcgtagcctttggggcctaagccaggccttgaggggtggacagggtcaaactggtccttccgcagcactaggggcatcaggaatgaaggcctggagattacagttggtttgtctttcctggatgagacaggaaactggcttaattagagcaggagtttgtgtgagagggcaatgggaaatacaggcatgtaggtggggcgaatagaaatgggtacttcctgcttcggagggttgtttgcagctgaaacatacatgcttgaaactgtaaagtgcttccggatcaaagtgttagtgttatgaaggagacagaattgggaagggctgccaaagtcgcttggaaaagattaggcctggtctgtattcgttctgagcacagacctatgggtagaagttacagaaaagcagataggggttcggctgctctttctcatagagctgttggctctaacagtgacctgagctggattaaaacacagcacactccctggcagggctgctactggagtgatcccttcactagttggaagaggtcttcagtttttaaactttaatcaaatgaaagcacacaccagcaactcacttgaaaaacagataagatgagagatgccctgggtgaagcaggttatcaggcttattctgcctgcccgggatcctcccttcccatgtggtagctcagaacgggagctccgaacccagttggaagagcttgagggacagttttacggaatgagacacagttgaactccttgtagcacacttagagcaggcgggaattgatatgtaagggaggcctttctcaccgggatgggaaggagtgggaggcaggagagactgctgtggaaaggcagtagctggtgccactggcatggagggaggagacatttctccagaaagtggaagagggtacggaggatgcagataagagcggcctaaagaggaggccccggcgttttgcaccttcagaagcgagtgttgggaatgcaggtcgttttgtggagagggtgtttcgctttggacatgctgcctttgaagtgacagagagccctgaaggtaaatgccagctagaaagttggagggtacagcacttgagtgagtgcccaacgggcagatgtgtggtcatttacttgagaatggcgttggtagctttggaaactgatgccttctctaagagatgcagacaaaggcccgcagagaagatgcagagaaaagtgagctaagggaaaaagtcaagagggaagctgcagtgagagaagggaggaagagaatgacgatggcctcattccaagcaaggagcagaaggaaggtggttctgggaccgggcaggaggccccagcctgtcttacgagagcttctgttgtcagtggcattgcgcctctgtgctgggtgtgtgcactcgccaaggtccagttccctgacctgctagtgaagtccagctgtcagcctacacgttctgttagcagagacttagagatgtccttaaatttgatgtccttaaatctggcttcaaagagactggctttgcacagatgagttagagcattttggaaggtgggaggtgggctggaggcccattaaatgggacttcagggacaaggggcattagcacagggttgagacagcatgggctcggagcagaggggagtccctctgctgtcctctaactctggtctgtccccaagcccattcagcaagtgtagcttcaagaccagctaaaggtgtattattttacaggtctaaagaagtgtgctcctgcccctgaactctctcttgtgccagtttgcttttgcttaaaatcccttaaaccagagaccaaaccttggattctgtaattatagcaaaggttcttgagcgtcaatgtttggcggagttcatgcacccacgtagatcaatccttggattctacaattagagcaaagatttttgaacataaatgtttgctggagttcatgcaccgtggagaagtctggacccaagcagagtcttttttttttttttttttttttttaatctttggagcaaggggagaaaattaaaagccaagaaagctatgggttacttgatttacagaagagcctctatctaaagtgagaaagggagcagacagaggggatgtgaatcctgaccaggattaaccgggccaggttatggtgcagcaaagcaggagttgagccagggcaggagtggggcatcgggggtccaggagaggcttcgggcgaagagtgttcagggcctgcaggatctctgtgtttattttacatagagaactccacaccccttttcttcatttgagatccttggatttttaatataccttagatttagatattcctacttctaatcatttcaaaaattgtgacccagtttagtgaagatccttctctcctgggcctgttctgcaccctggatggaggtgtttcgggaggtgctggctccgttttactgtgccattgactgtactgtctgtccagagtgacggtgtcagtgagatgattggcactgatggctctgaaatgacagggtttcttttgaagtggggtgaggggagtaacacagtgtttggaatagtctctcctagcctccatcggtggaatatatgatgccattatagaagtggtcagtgcaggatacagggtaagaatggagagagtagaaggctgggcatggtggctcatgcctgtaatcccagcactttgggaggccgaggtgggcagatcacctgaggtcaggggttcgagaccagcctggccaacatggtgaaaccccatctctactaaaaatacaaaaaattagcccggcatggtggcaggcacctgtaatcccagctacttgggaggctgaggcaggagaatctcttgaacccgggaggtggaggttgcagtgagccaagatcacgccattgcactctagcctgggtgatagtgtgacaccccatgtcaaaaaaaaaaaaaaaagtgtggagagagagtagaacagtgttcaaaagagtgtctcagtctccgctggaattagggcaggatacaagggcttcttaagacagaaagctcctggaattgaaccatatttcgtgaccaaagacagagttcagttccggtgtctctgcaggctaaaagtagcgtgatcttggaaaattaatttagtctctgagtcatcgttttctcaagtgataaaagtatcacttgtcactaattaaactgtagatcatgtgtaacacttagaggtcttcaatggagaaatcagaattaatttagctttttaaatatatgcaagcctgactgcctcattacttttataagaaacctagaaacagaatgactaaaaaaataaggtcagacagcaaaggaagcccatacaaatgagcagttctcttgtaacttcttcagaggcctgtgcttagttctttttgagggagttgaagagatggaggtggactagtgaaaggtggggcatgactcggggtggggaaactgaccaggggtcattgaggacgccattgagaaaggaggctgctgttggagaggtggagaattgcagcagtgtcagacagttcaggccgccatggagggacagcatggtccatcagaggtcagcatatggggctgggggaagggatttgagaaaaggccattggatttgggagagcacagttttgttggtgacctttggtaatggtgagtgcttatttactagtaagtgccatgtacgtagttagctcatttaatcttcaccttatccctatgacgtgggtcctattattgtcctcagtttacaactgtccgcagtgccctagggtggcttacagaggttaaataaggagctgcagccagtgaggagtggaggtgccaggctttgctccaggcccttctgattccaaagcccgagctctcaagacccttctgggagcttgattctgcaggtggagaggaagcgagaccacaggaactaatgggggcccaggtggagaggcgaagtccggaaaggcagacagcgggtcggaagtttggttgtgaaggaagggaaaacctgctgactcacccaggtcacaggcaagtgggttttttttgttttttgttttttgttttcagaaggggcagactttttttttttttgtctttaagaatcaggctctcgctctgtcacccaggctggagtgcagtgacatgatcatagctcattgcatccttgaactcccgggctcaggagagcctcccaacaccgcagcctcccaagtatccaggacaagaggcgtgcaccaccacacccggctaatgctttcattttttgtagagacagggtcttgctatgttgcccaggctggtctcgaactcctgggctgaaacgatcctgcagcctcagcctcccaaagtgctgagattccagggtgagccaccgtgcttggcccaagaaaaggcagacttcttatttagaacttgtaagagagaagagtgcaagatgctgggggagaaaggagtaaaaatcgtgcctggtagggatggatattctgggcctgcccttacgctggaccttcgggacatctggtaaaccaggcagtgtatggtttgtttaaaaaccgagctatacagtggagtgatgcctttgaagtcatgttattaaggtgggagtttgccaggtgggattatgaaggaggaggttatttcccctccttccgttagtgactttttgaggattttggggggattgattccaagtagtgtataaataagctgatgagaacacccaccatgtttcagagccgaccactgttgacttttccaagcacagtcacgtctacttgcatgatcctctgcttccagtcctgtgttccttctgctctctaccctcttccgctttggattccttgggtgttgtcctgtgtggcttttgtctgacttgattgctatcgtagcagcagatgcaaacttaccttgagagctgaacgtccacaggcacctcagggctggcttttgcagagctgtttagtacaagggagtggagggttctggtgcacttgaaaaaaaagcacacatttagagctccaataagggaaaggaatttgttctcattatttcattagtgtgcacgtgcagaattcttgggctggatgagatattcagccacctgaagggcatttatgtaaagcccatggtgtggggttgcccggctggactcaggccagggtgatcagccagccatccaatgcagggcctcaggtggccagaggccatggcaaaacttatctgcagagaattcatctacaatgtcctctgggctcctgttcttgggccagtcactgaggcagagcttttcctaagaaataattatgaaagaggtagcatgattcctccctggtgaaagccaggcattgattcttttgagcaccccctcagaggaggagagtgtagaatccacgcagtgcagcattttacagagacaatgatgcagctctgcgtagccccaaagctattgtctgcaggtggaagcatttcctaaaggcaagccagatgggccggtaccgtttccttgaaggaaaatggaaggagctgaatacccagcagtgcaccctgggcagaaatgtgctttaaaacaggccagtttaaagaagcaggggatgaatgtattcggcagctgaacatgaatgaccctagcattaaagaaagtaggcagagggtagaatttcagctaagagaagggaggggaaaggaagtgttctcaattcttttttcttttcttcttcctagcaagaaccagttgagtcatctctggggcttagtaatggagtaagtgatctttctcctgagtatgcggtcctgacttcaactataaaaaatgaagtggatagtacggtgaacatcataggtaaactgttttgacgtctcattttttatacataccagcagccccctggggcctaaaatttgtaaaacagagaacttcaaataacatagtcagtgggaggaggtcttggaatcatctcagaatgcaagttccagcccccagatttcaaggctgagaaacgaaggcttttgaggatcagataaaggaacttagacgggtcagcctccgtggaagaaggctggggtgacctcccaggaaaaatgtttgtttcccggcggcttgtggctagcgatcccagtctttcactatttggttcacgtgggcaaaagagtatttatttaactcgggaaccaaggagagggaagatggtcctcgcgagtcctctcagcaactgcttcctggcagacagagaaactgaggcacagagacatgttgccaaagggcccactctgattcagcagatatttttgagcaccttctgtatatcagactcagtactaggagcaggaaatagacggaggaggcccaatttcttttctcatggagggacagagatagtaaacaaagacacccccagataactgcagtgttaccatgtgtggtaaatactgcaaaagaaaagaaaggcgagagaaaaatcaaggcaccaaatttagattggaggtctcagaggagcagtgttttccctccttcgtaacagttgaacaacttccagatgtagctagctgcaccccctgtaaagatgcaggctctttacaatgaagacacatcttctgatgttccttctctcctgtatggccagatgcacaggaatagtgcccaaaagacctcagcctgctttccctttaaggggaaggagaagaaaaaactcctttttatttttactttctttcagcattgaatttttgttgtgtgtatggtgacttctgtttttgggaaacggaagaagccagcagcatgctgaattgtcctgacaggcctccgctggcctcttgccgaggttagcagtgctttttttgtatttaaaccatctcccgggcagtgtaaaaagtttgcaggtgcggacattctgtctgactggtctcggcagtgctctataaccctgttgtgtttcttgataaaacacagccccaccctttaataaagcaaagattgctatgaaaccagagagtctattcattactgtggagtaactagagcagtctgtagtgactagacatacggcaattaggaagtcatggagttgggatttttgtcttaattttggctgctcaaagtgccccctgtaggatattcttttttcgggaattgtttccaaacttgcctgtctttatctatggtgaaactcaagccgctttttaaggcaagcctgcaaacccaagtatcaacatgggctcctgaaggcacaggagagcagattcacagcttactgaccagtgttagggtccccacgagggccacccatttgaactcaaggttggcagactctggccccagcacttgccgtggtttcaggatggccagcggtgacacagggctatggaaccctgggtcttcatctcttcccatatcctttgtttcaccttctttttgccatattttattgtgcttcagatagaaattttatttataagataaaaagtagctctgaggctgggcacggtggctcatgcctgtaatcccagcactttgggaggccgaggtgggtggttcacgagctcagcagatcaagaccatcctggccaatatggtgaaaccctgtctctactaaaaatacaaaaattagctgggcgtggtggcaggtgcctgtagtcccagctactcaggaggctgaggcaggagaatcgattgaacccaggaggcggaggttgcagtgagcctagatggcaccactgcgctccagcctgggtgacagagggagactgcctcaaaaaaaaaaaaaaaaagataaaaagtagctctgggtgagtctttagatggaaggcaccacctcttaggagatcacccatgctgtcagctgtgcccatgccttcttcctggaagctgagttgttcaccccttaggagaaggggcctgagacaaggcattcgattttatccacacccctagaatgctcttagcaagatgaaactccatatgagatgtgaacccttacatcgcaatatgcccagacacagaacccacaacaacatactttattcttggctgtattggacctggagcacctgggcactgaggtgagactgtggggccactcctcagtcaccaggtgccaaccgagagacctgggcagtggagttgggctgctgtgttttcagccttaagaagtttttatttactcaagaaagctgtcatctttttgtgaggctatatattattttctccttccctctctccctggctgccgctgcctcgtttataattagctgtcagctcctcctatcttccctcaccgtacttctcaagtccatccccttgtttctgacactgtgtgtgggcctgccttggctgtcacctgggctctgcttccattctgctccccatttcttcttctcacaaaataaagaatgccagtgtcatcatgtcaccactgcccctaagagaaggagctgagttcccccaggtccccggggtctggcatgatctaggccctgcccactgctttcatacctgtctttgaacttgaattactctgaacgagttaagctccctgtggctgctcatagagacagtgaggttggtggtgggtctccttatggtggagcagctgcaaaggctttgtccacagggcacagtgaggggtggacacgtggcagttccagcaggaggtatagctccagcccaacacgtctcatccacacttccgctcccagatcattgacccttgagacactggttacctctactgagttttgttttgttttgttttgtttttgagaccgagtttcactctgttgcccaggctggagtgcagtggcacaatctcggctcactgcaacctccgcctcctgggttcaagcgattctcctgcctcagcctcccaagtagctgggattacagggatgcgccaccatgcctgggtaattttttttgtatttagtagagatggagtttcaccatgttggtcaggctggtcttgaactgctgacctcaaatgatccacctacctcggtctcccaaagtgctgggattacaggtgtgagccaccgcgcctggcctctactgagtttttactgggatacatcctgtgcttcccttcgtgtagtagcctgagatgctgttttctcacggggtgcaaggtgcacgctgccctgtcccactcttgcctcctcctgcactctgtcaccctggtgaggtgtatgcagcctgtagtcagggacagcctggcccaggcacctacagatccctgtctcggagtcaccggccccgcggtgaccttctctcccaccatggctctcgagtgcctaaaccaaatcatggctgtattttataccgaaagagcacgagattagaagtcaaaaggcgtgggttctagacctgcttctgaagttttttatttaccatgtgattttgggcaaactccttaatcttttgaaattcaatttctatatagattggaaacaatatataattatttataaaatggaaatatttaaaattatatagaaaatggaaataatcgtactgatcctgcccatctcgcagagttattgtgaggatgaagtgaaatgtacagataaatcactctggggctagaagggggtaaaatgatatgattatcatattaccaaaatcatattaaaatatatttgattaagaaaagtagcctccatctgtgccatgtcatcaaggctggtgtgaagtttaactcctgaaactttcagaggggtcaggggaaatttccctgcatgatgctctgctgatggcctgattttttatgcctgctagtaagtttcattcttgactctgcagctacatgggtgaccttagcaatttacctgagctctgggtttcagcttttttcaactgtaaaatggtaggaccaaaccacctccaaggacccctctgtttctaataatctgcttttaagcactttctctgaggcatgggagcaagttgctttctcaggtggagacctacattaagtcaacaattgctaataaagtgagaatgaccttttaaagaagcaaaccggttcatcagtaaccagccataaataatattgttataattctcagcaactagattcagataaaattgcattcctgtgggtgactcttttcagatgtgctgactttaataaactggagaaacttagtggatttctagttcttctgtttgagaatttccctggcacacaatagataactgttgaaaagaaatgtcactattagttctgagcctggagactcactaaggtgagattcaaaagtttttatcctgagaggggctaagaaagccctcagtaactcagtttggacttcattaactctctctgttagggagagcatattataaagagttgaaatttggagttgggtaaggctaacattgaatcccggttctgctgctgattgtctgtctgaccttgaattagtcatgtagttctgtcttgtatggttgtttcagcatgtctagaatggggatcactattgtgccttcctcatgggttgtgaggtcttgggaggtggtagggagaggcaaagatcagtgctcagaaagtcaggttttgtcattattcagtcaggacactctttggtacccagaggagtgccacttctgactgtttactgtagcaggtaagtttgttattcctgtcttttcacctgtcaggagtcagtgttgctgtctgttttgccgcttggtggtccagggaaatcagttcacatgtcgagagagagagagagaaacagatagagactggttagtgagagtgttgatgctcatctgagagcatttcgatattgggatttccctgcttctctcatgggctttcactcgagagctggaaagtttctaaagtacccacgatgtctggatggagagaagccattgtcccttaccagggcataaagcaacacactcctatgggggaatttggcctgagagataacgtaattatattaacttggtatccagatcatagcccagaaaacagactgacttttctctcctggtcagccgcattcaggatacacctaaaatctgcatggacgtgcttatctacttttttccccaagtcatgtatattaagtgaaatacggtaaaattcaccccttttaaggcacacggtcctataaatgttgacagacgcactcagtgatgtaactaccaccatagtcaagacagaacattttcatcaccccaacacgtttcctccctggccccagccctcgcacccacagccggctgtctttatcacttcccaaaggtttcaagagtccacttgtcagaagtcttgacatttttctagaaaacattaattgtcacgtcccgtatttgcagattgtcacaatcccctgcaggactccactctggctccagtcagtgagcctcggccccatcacatgtccatttattcaggggagagtccctgagcgcctctccggtgggagttgtgagcatgtgtcatgactggacacaaaaagttcatactttggttgaggagagatgccattgaccaactcaaagctccatacgggtatatagcgttaaccagcaacttgaggtcagaagtgtcacaaggtcgcggcccatcgtagtttcggccgagtgacggggacagtgagtgagaggcacccaggggagagaggccagtctgtgctggcgggtcaggaaggggctccagaagtcaggggcatggtgaatgctgcctgttgctcaacccccactcctgtgccactacctcattgaagcctttgattcctcaaactggaaaaaacaccccacttctctagcttccattgtatggcccccttctttttcttttctttcttttcagtgctcacggccttaaactgactctctagatggttagtcgctggcctatagccatgtatatgaacttcttacaaaccggatccttgactgcatcgatcttccgctgctccttctagccctgggaggctgggaggtgcaagcaggtgttccataaatctctgttagttgaataaccgactaggacgtcatggggagaagcagtgagagaaagaattcctggttggaacaaagggatctgactagggggatacttgagctgctgccattgtttgtagtcccagctggcttgccctctttctgttaggagcaacgtgcaaaggagagatgagttttgaaatattggaagttaaaatggcttcgacttaagtcacatttatctaagaccttcactgccttagtatgcaaggtatcgctgcgccctccctcctcaaactctcacaccccatttggtttctacctccacccaccagctgcttcttaggacttaggatagggcaggccattatcttgttttcctgccattttattttacttggctggaagaggcagaggaaactagagagaggttggtgtaggtcagcgtcagtctgtgtctagtgacctgcataattgatgtcctcaccctcacgtaggataatccaaaggatgaaataaatgggcttgggagtctgcctgccatatatagcctgcctgccttttctttaattttatccccaccaggaaaacctaaacaggatccggtttcccttccattctgtatgctgtggcttttggactcttgtatcacagccccaaatcccctttctgagcctcttttgtgcctttcctttctttattaaagaacctatgaattgccactgccctctaaaaccttccctgcgtagaaatcagataatgtgcttgtcactccacagacagcaattaaaacaggaacctgtttataaacaaaaatacttcagaaaataaaatacttggagtgattaaaacgagcctctccatgacgcctggcgtctcaaggagactggaatgcgttctaacctgaatactttgccgattggtgagaaaatgactgcaacatagagcaccacatatactccaagctgtgcgagtctggacaagtcactctccctctctgtgcctgagtttcttcatctataacaggataacgatgctttctctgtcatccttatgggttaaaatgttaaaataacagatacaggtatgagtaaaacgttgatgatggtggcaaagtgctttgaggaccttgggaattatttcttcacctttatttattgaagctaattttcagggacatttcatccaactaacagtggtatgaggtcagtttcattcaaaatgagggcaggaccttagggaccttcaaattaaaatggccatgaaacatcatgacttacctatgagaatggccaaaataaataaacagtgatgacacgaaatgctgccgaggctgtggagaaatttgatcactcagacactgctggtgggaatgtaaaatggcacggtcactccgggaagcagtttggcaattttcttgtaaaattaaacatgaaattaccatatgactcagcaattgcattcttgggcatttatcccagagaaatggaaacttatattcatacaaaacctgaacacaaacatccatagcagcattatttgtaatagtcaaaggcttgtagcaactcagacatccttcagaggggagaataaacacactggtacacctataccgtggaatactactcggcaattgaaaaggaaccgatgactgatacacacaacaacttgggtgactctgcggtgaattatgctgagtaaaaaaaaagccagccccaaaagtctactgtatgagtccattaatataacatccttgaaatgaacaaattaatgaaatggggaacagattaatagttgcccaggggtcatggacaaagagatggatggggaggtactgaaggaaggtggctatggttacaaagagtaacgtgagagagattggtcgtgatggaactgtttggtgttttgacagtggtggtaggtacatgaacctttatgtgtgataaaattgcacttagtcctggtgcaggtacacactcacacaaaagagtgcaagtaaaactgaggaaatcggaacaagatgggtggattgttatttatgtcaatactctggttgcgatattgtattctagctttgtagcctataaccattggaagaagttgagtaaaaggcacacaggatctctctgtattatttcttacaactgtatgtgagtttacaatgatctcaaaataaacaatataagaaaaatatttgaggcagttttcagagccagggtggtcagaatccatcttatcagtgttccggggagctgatgctactaatgtttgccagaattggagatctgactctattccattgtgctgatatttcagccagttggacatgttgcctgtagagcaggaagagagctgggagcgtaagcagagcgccacccagctagatggggaccttgggcatttatcccagagaaatggaaacttatgttcatacaaaacctgaacacaaacattcacacagctagatgtgacacaattgggtagattttcatggcccttcctctttagtaaggtttgataatgtctccctggattgtagaacccagaaaataagcacagcgccttcttttggagcaagagcagggagcagaaatcggtcaggttcaaagtactgtcatgtctggccctggggctggggctggatgccgcctctggtcctgtggcctcggctgtgacggggttgactgtggaattctgctgagctggaaaggacatggccaccgtgcgtgccattggcaggcatgctggagatagacctggggagccaagtgctggccggctgctccctgggagacatcacaccagagctacagagctcaggcgtgttcttcagccccatggcaggggacagatggtgatgggagcctggcgacctggctcttttggggaagactctttcttgagaaagtgtgctagaattgtgaggtcagcagactttgcatgatggctgtcttttctttgaagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcaggtaagcgtcagcgggaggctccgggaggcgtgggaaccggccgcgcagtcctttggtctagggtcacccatctcaccaccccacggagcatccctcctctgtcctaggagttattctccctggagtttttcatactttaattatcttgatcaacatcttcttggacacttttgttctcaggtagaggacaggatcacagcatttctttactcagttggccatgacattttttatttatttatttatttattttttttttgagacagagtctcgctctgtctcccaggctggagtgcagtgggatgatctcggctcactgtaacctccgcctcccaggttcaagagattcttctgcctcagcctcctgagtagctgggattacaggcgcacaccaccatgccagctaatttttgtatttttagtagagacggggattcaccatgttggccaggctggtctcgagctcctgacgtcaggtgatccgcccaccttggcctcccaaagtgctggaattacaggtgtgacccacagtgcctggcctcccataacatttttatatatggttacagataagatttctttagggcagtagttcatcagagtctaatttattagcccaagttattagaaatttggcagagtgttttaatggattctcagtttgagcaggctggataggaccttagagatgatctcttcctgttccttcatttctgaaagggaaggggcttgcgcagggtcgtacagtcagcaagtgtttgggccaggacttgacctcagccttcagaccccaagctcattgctagatccattccatccaccaagcgtacttgtcctttccacatattttctctttctttttatatctagtacaggttctaattaggccagatgactgagccatttccaattctccagggacttggctacataatgacaggagttggcccaggcagagtcacagggggaggaacagatccagttggttcttccattcttccagagtaaaaggatggctcctctcgttcgccaacattacttcatcttctcctctcttcctgatgatctccattgaattttgtggaaatcaattgtaattaggaaatataaattctgagtcagtgttactgcttgcagatattaaaaataaaaagcagagtccccatcctgggaaactgcagttcagctctagcaaatagttcagggattcttccctgtgctctttacacgctgccaaatgggatgtcctccagtaggtgccacccccaacactggctccgaccagcgttggaattagagttgactcaaaggactgttgtttgtgaattatcagccactaagtctaatctcattttccctgaatgccaactttcttttttttttcacttttaaaaattgtggtaaaatacattaacataaaatttaccattttagccatttttaggtgcacagtttagtagcattcagtgcattaatgttgtcgcagccatcaccagcatccacctccagaacgtttttcatcttgcgaaactgaaactctgtctgcattaaacactaagtcctcttttccctcctccaccccagcccctggcaacctcctgcctattttctatctcagtgaatttggctattctaggtacctcctatgagtggaatcatagtgcttgttgttttgtgactggcttatttcacttagcataggtcctagtgtgcatttatgctaggagcgtaagtggaatgtgagaatagaccttggccacaggaagattataatctgtcaaacaggataagcttgtcatcggtgctttattcagcaaatgcgttttggactcttacacgtgccagtccctgtttggtccttgccagagtgcagtcacaagaactactatgttttgcaaatttattgtgccctgggaaccatgctcagtgcttgggtacagttgactgttgttgttgttgtttgttgttgttgttaatagaaatagggttctgccttgctgcccaggttggtctagaactcctgggctcaagtgatctgctcgcctcagcctcccaaagtgctgggattacgggcatgagctgccatgcctggtatgatacagttgacttgtttaattataattagagtaaccctgtcagcctgggtatcgtcatcatcccgtttttaaaagtgaggaatctggctgggtgtggtggctcacgtctgtaatccctgcactggaaggctgaagtgggaggatcacttgagcccggaaattggagaccagcctgggcaacatagtgagaccacacttctacaaaaaataaaaaaagttaaccgggtgtggtggcatgtgcccgtagtcccagccacttggaaggctgaggcaggagcatccccttgagcccaggagttcaaggcttcattgagccctggttgcaccattgcactccagcctgggtgacagagcgagatcctgtcttaaaaaaaaaaaaaaagaaaaaaaaatatatatatatggatctgcggctggcgtgggtagagcagcgtgtctgagggaggaacgattgggagcacagctagaacccatgagccgttgatgccaaaggccggtccttaacgcccgccctgtgtcgctgccctggacagcgcacgggctctgccgttcagaacacagccacatcccgtgatctcatttgattttcacaaggacccaccaaaggaggcagagcagaatgtttatgcctaaattttacagtagagctaaccgaagcgtgaaacactcagccactttgcttatatttacatagttatggctaaaaacccatgactttcttctatagcctgctgctgcaggcatcgttacactccatgtggttttctttctctcttctttttttagggggttggagctttagaatagacttctatgtttatctgttgagtaagacttttctgaggtcttcttggggattctggaaagacctcttcttgctgttctgccagcagtggcatttgctcaagcaaaagattccggagaacagcagatccatgcagagagaaatgaacatttcattactctcttcaggacatttgcataggtttgaaaggaaggatttcagtgccaggatggcagtcaacaggaggttttgctggagcctggcttttcagcctggcctttggttctttccgttgttttcattgtctggattctccagaacctcgtggagggaggcttactggttggaggcaaaatgttccatcgctgctgatgttctagagctcacagtgatgtaaaacatttccctgctactgactgtagctaattttagttcctccgtcagaaattgtataacatgctgtcaggaaaggcagctttctgcgtgtattcacctttcttgctttatgttctccagtagagtcggccatttgcctgtttttcatgatggagttcctttgtttgggctgttcatctgaatttcaatctcctctgaccacctttttttttttttttttttttttgagacggagtctcgctctgtcgcccaggctggagtgcagtggtgcgatctcggctcactgcaagctccacctcccgggttcacgccattctcctgcctcagcctcccgagtagctgggactacaggcacccacaaccaagcccggctaattttttttgtatttttagtagagacggggtttcaccgtgttagccaggatggtctcgatctcctgacctcgtgatccacccgcttcggcctcccaaagtgctgggattccaggcgtgagccaccgcgcccggcatgctctgaccacctttattcatctgtttgggaaactggtatttggaggctgctgtttgctagtttttccccctactgatcgttgaatcataatcccagtagtatattacaaaaccacattcagttttgcaagtctgtcttctcctctgtggtctaaatattatgatgagaaagagaagagatagtacttgcgttggatgttttaagacaacataaaattctagtgtgatttgtgaaactttcatactagggagggacatttcaaagtgccactttgggaagctctggcggagagacatgtcatgtttaaaggtgcattacaaagtgaccccttgcctgatctgtggcatcagaattttattaggtggttgatggtttagtagaagaaaaccacagtagaataatggggtgggggaggatgggtaagaggggctggagagtagactcgagaagaaaacatcatctgaaggactcactggctataatgagagagtggagatcgcctgctgaccagcagccatcagtaaaggctttgaatccttcgggaaaccacaccaggcttgcattttgttgggcagagcaaagacacaatcgctttgagattaagaggattccgatttgaaaataatttactcctggtgaaagtaattgagaatatgatcaatagaaagaaattcaaatcaaacttgctgaacaagagccttccagaaagtgtagcagaatgtcagagtgcaaaaagcctttcaggtgaaaatgcatcctctcccttcccgcagtgttcctgcttagacaatatgtatatcctcagcgaggcgttaaaaactggactggatagagagtgaacctacaaccagtgtcaccctagaactggaagagcttttgagatcatctaatccaaatcctccccttccctcccaccctagatgctttcaggaaaactgagaccagaaaggttaagtgaattactcatgtgcctgttggtactgtacgaacaccttcagcttcttcatttgtttggagttgctggagaagcaactccagacttctttattccattgtattcgaagtaagtaataaacaaaaagcaaaaacaaattcaaactaatcaaaagggaaaatgaaatgacaacgtatgttgatagttcgatagtaacactgatctggaggcccagctgcagtcagctcccttgtgtaagaagtcagcgtggaagtggcaatggtggtcaaaccaaggaaacagaggacacggggcgcagtgcatccaacaaagcacttggagccaccgattctggggtcacagagagaactgctcccctcagggggaggttcagggttctctgctcctaagctaaggtactgaaggcccctttttgaaactgtcagtgtcctaatagggcgcatcttcctgacgacttcagatgctgtggaacttaatctagacacgacgctctttaactcgcatttgtgtcagctgaaaacataagttcggagcatgtgtatcttttcttatctgcagctatttccccgaagctgaaaactgggtacttaaaggaagttagcatcccggtcacattcatgggcggtgcaaggtcttacccgggagccttaccccaggatctgacttccagcccctcctgcacctgcgactggggctgtgctggaatcccagcccccaaagcatgcttggttgcgtatctttgtttgtatttggaggggaaaggaaaagaagacagtgatatttatggagagtcattaggagtgaagagcatctgaacccgtatgaaaggaagagaaagcttggctttggagcacaaagaaagctaagcataaaatggaaagcggatcttgaaatgttgtcagagaccagaacaccagggaagcagggctgctgtgtgcagtgcacaggccctggaatcagaagtacagttttgttttctctcctctgtgctgtctcagttggcaactttggcaagtttctcaacatctctgttcctcatttttcttcttgggagtggctgttccgattcctgcctcctcaggatactgagccagcacgagggttctctgaggaggggaattttctttttctgttggttttcatgtgtttctgcgtggaaacaattcttgtgctcggcaacgtcagctcatcttcatagctgggatcgtcgtcagctgaggctgagggcttctctgggtctctgtggctcccagcacggggtgttttggggaaacatgcccagtccgaggagtggagagatctgtcttctgcatgctcatggccagcccaccgcgatcactcaggtttgtgtgaagttactggagaacagtggctgagaaacaggcccagagactccaggctgggaccagtggagtccacattcttactttccttgtttaaggaatgcacctgtggcacagtttgtccatttgttcttttgcctttaattgatagagagcctggtctggggctaatgctctcagtggaagaaagggctctgtctgggctggagccatctcatcccagctctgccaccaggaagatgtgagacagaggccagcccctcagcagggaccgggtggaaagctggaaggcactggagcataagagctcttctgcgtaacgggggatgagagcagctgcttgctgacgtgggacccctgtgagacctgcatgcaaagcctctgacatggcactgacccatagggctccctaaatgtttgcttcttttagaacacgagcttcacttttggattttcttgtgttgtgaaatatacgtcacctaaaatttaccatacttttgggtatggggttattaaattcagcattggaactaaataggaggaaaggcagttaaaggttgccatcaggaagagaagctattgcagttactctttaggccttgtctgtaaaacgaatggctcaggctaagtgatctctaaatgcctaaatattgcacaggctctgccctctgtgattgcatttctcaatggttatggacactggaataatcgcacaccattgatattttattttacaaaatcaaaatgtttttacgtttaaaaagctttttataagcataggtcatgtgtaatcactagacttcgattccattaatccagcctgttgtgcaaacccagtgttaagcagtgctgatgtatggagtgtgtgctgtgtgccaggcccttgctaggcctttcccatgtaccctctcactcactctccatgtaatcctcttagatggtggcagtgccctcattttacagaggagaaaactgcagctcagtaaaggtgagaaacttgcccagtgtctcacagctggcaggccaaatggggatggcaactgattggctgccatagccatgcagccacaaacttagtggcttgaagcgacacacatttggatcttacagtttctttgagtcaggaatccaggcgtggcttagctgggtcctctgctgcagagtcttgcaaacctgccatggaggtgttggctacagctgctgtctcatctgaggctcaactggggaagggtccatttccaagctcatgtggttttggcaaaattaagtttcttgcaggttgttggactaagggcctcagtctcttgctggctgttggctggaagcagtccttagttctttgccataggagccttcccaacatggttgcttgctttatcaaggccagcaaggcagagtgtttcctctcccagcaggtttctgagttatgtaacatgatcatggacacaggatcacatccatttcatcccctttgctgtatcttatttgttagaagcagacacattccatccacactcaagggaggcaatcccaaagaaagtgaatccaaggaggtgaggatcatggggagcaccccagatctgtccacctacagtaacccacatggcagatgcaactctagaaatccaggatctaagtcctaaaggggtgagaggtaaaggaaggatctgagtgggatggggataatgtaggaagaccttttggaaacggtcaactctgcactgggaattaaatgaattggttggcatggattgaaagacaggacccatgtgggcattgtggacagagctgcagtgaggagggccccagggaccagcgccccttcctgggaggtagtgcccagtgtatacacagcccggccctggccaagggagcctcctcacagctctcaagcctggtttctccgaagattacagagttgaaattcactctagcttctcccatgtagaatgtttcgctttacaaagggagggaggtgatgcgtttagttactcagtctcctttttataaacactgcctgagcctggggacagcttgagggacaggaatgatggccctgtgtttttctctctgtgaacagaaagcgaaacgactgatagtgtgcccagcgatgaagagagtgccgaggtaagccactgcccagcctgcccacgatgctgccaaggaaaagcctcccgaccagctccgggctttccttgctgctggttatgcacctttcctttagatcacaagcttcactttgggattttcttgtgtggtgaaatatgcatcaccagaatttaccatacttttgggtttggggttataaaattcggcgttggaactgaaaggaggaaagggagttaaatgttaccatcaggtagagaagctgtgatagcaggaaaagggaattgaagtggaggctgggaaatgctgatgctcttaccacttaaacatcctacttcaccggcaaaaatagagcagccttcccagccagaagcagtgaccagtacacgtcacaaaatgctaagcaaaagcctcttccacgtgtgcgtgggttccctcccgctgtgacccgtgcccagagctggttgtgtgccccatctcgattccgagtgggtcccgtcccctctccctcccatagatggggcgtgcacaatggcagaaagtggctggaatggagatggaaagcattcctgctggccacctgctgggggtctgcgcttgagtgaatgagagagagagagggagggagcaagagagagggaagctcatggttgtttgaattagtggtttcccatgtactaaacactttgagaaaaagtgcagggattctgaaaagacagatgtacacgctcccatacaccctggcctgatttcttcaaggttgcagctctagccacttctctgaatgaagccagccctgaggccgctgcttgctgtacaccgtggagctctaagccgcccccatttgaaagcaatcaaggggcattcattgcctgtcactaagttcctcgctgccttttctctgaaaatgcaggttggctcaggttgactgggccagcattgagggaccgagtcgctgtgccacactggccatggtgacctgaaacctatcgaataatcgggccgagccgcagagcacaagggaaccagaaaccaagctgctgccttcttttcctgccttcacagagtagtctggaaagtatttctgggaggtagcaaatgggaattgattttttaaaaaaaaagaaaagggaagaaaaaccattacttggcatatgaatagctgggtgcaatagatttcagttgagggatgtagaggtgctaagcctttgttcattctgcagttcttaagaaactcagctaaagcaccaacacatgggaacgacacatttttcattttaaaattttttttgtgggttgttgttttgagacaaggtctcattctgttgccctggctggagtgcagtggcgcaatcatagctgactgaggccttgacttactgcgctccagtgatcctcccgcctcagcctcccgagttgctggggctaaaggtgtgcaccaccatgcctagctaattcttacgttttgtagagatgaggactcgctacattgcccaggctggtctcaaactcctgaggttaagtgatcctccagcctcagcctcccaaagtgctgggattacaggcatgagccaccacacctggccagtgatgcatttttaaaaagccatccaatagaaggagaaggaaatacatatcttaattactttcttgaaagggacggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaagg

SEQ ID NO: 1269 - DNA, 2223 bp, Homo sapiens
tctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaaccgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtacctggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttaattttgtaaaggtgaaaaaagcttttatgagctcatctagcaatcagattttcctgtgga

SEQ ID NO: 1270 - DNA, 1050 bp, Homo sapiens
atgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaaccgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaa

SEQ ID NO: 1271 - DNA, 54355 bp, Mus musculus
  misc_feature (8835)..(10000): "n" at positions 8835 thru 10000 can be any base
  misc_feature (15149)..(15262): "n" at positions 15149 thru 15262  can be any base
  misc_feature (21932)..(21951): "n" at positions 21932 thru 21951  can be any base
  misc_feature (24275)..(24638): "n" at positons 24275 thru 24638  can be any base
  misc_feature (48355)..(48374): "n" at positions 48355 thru 48374  can be any base
  misc_feature (51060)..(54355): "n" at positions 51060 thru 54355  can be any base
gggtgcaggcctagctctgaattcaaggccagcctggtctacagatcgaatttcaggacagcaggggctacatagagaaaaaccaaaaaattaatagtaatggcagaaagatggctttgtgggtaaaggcatttgctttgcaaacctgacagccgagttcaaaacacaggtatggtggaaagagccagctcccaaaagttgttctctgaagctcagcacagcgcagaggtccacacaagcatgcattctctcaaacacagaataaagaataagataaagcttctaaaacggtttctaataatttttgtccacatttggaaaatagcaatttcaaattgtaaccaaaaagcacatcccttctcagtttaccagtggtcctgacgcagatggcttgccatatgaaaatgtgtccatttttagctttctggcattgatgagcgcactgtcgtcttttataatcaattgaagtcatcttcatttttactgtctagtaatttctctaaatggttccgcttaccatgtcaggtccacttgggttactctcagcagacgtgaagaagtaaggctataggcgtctcaaaggcatacagtaatcacactgtcttaccatcagtagacagtaagtggtgtgtggccagcggtccccctccgtccctttcagtcaccctgtctgcctgggtttctagctttgtttttagcagcacccagtcatgctgaagacttgtggtaccattgatctgaagaaatagtatggattatggattgtcattccttattctgcccttgacagacactttgtgtttgttctcctgcagctatagcaaatgtcagatttctctctttaacatttttctttgtgtatggagtgaggatattcatatagaaaagtaagggacaatagtcactatctggatgataatgcaaccctaaagccctttataacataacaaagcttatttttaaaaattgcattaatctctttgtcaggggagatggggcctgcattaccagtgccttggtacaggcatggaggtcagaggacagtttacaggaatgaattctctttctttcatctgggttctagagagcaggttatccatcttggcagcaaacacctcacctaagccatcttgccagctccaaagctaggggttgtattcaagatgtatgtccttttatatctgccagacagtatggtagacactgaggctgccaccgtgactgcacagcctcatctcatgtagcttgcttcatggcagaaggagaagtaacagggcttctccactcgtgatcactcgcaggagctgacatacagcttcctgtcggagcagggaccggcaagggatggagcagcagctgcgccatctcctacttgcagtcggatgcattgcagtttgttgttatacccaggtctatagactttggaatttacttgcatcacacacttataacccatttgtcatatttgttggatattattttcgtgcatacagattttgtacaaaggtgcttaatgttatctgtcttaacaatataaaaattaactaattaagatcaatggcatgtttgggtagcttcaaatgaaaaagaagaaaccatgtaaatgaaatactctcttttcttggaatttgtattttatcatgatttgttgttgttgttgttgttgttgtttatcagaaaatagagtgtgaaagtggagtggaagactgtggtcggtacccctcagtaatagagttcgggaaatacgagatccaaacctggtactcctcgccttacccacaggaatatgcaaggtaggggcggagcctggcggctgtgtgggaaggcctggggagctctgttctacagcagaagtgaaatgctttgaggagagaggagaagtacacttgggtacagggatgctgctcagctgggagagtgcttgctgagtatgcctggcttccatcaccatgccccacggaaaacaggtcatggtgtgagcacctattcgtgagcgccttggagttgaggcggaaggtcagaggttgaaggccattttgtcagtatatattctgttgatagccatgaacttgtctccaaaaagtagtgagtgagtgagtgaataaacaaacataaattttggtagtcaggcagaagtctttgccattagcgtacttttgtagtgtgtttgtactgtttgtgtatattccttaactcgtaagaaccacgggtactgtaaatttctctttgagccaggaggtagtggcactcacctttaatcccagcactcaaggaggcagaggcaggcagatctctgagttcaaggctagccaggtctacagatctagttccagaacagccaggactacacaaaaaaacgcttgtctccagaaaaaacaaacaaaaaacagagataaataaacttttctttgacttttgaggccatcctgtttttgttcggttagtaggacaattgctggttttatatagaacaaatcagagaaaacaacggtcggttagaggtgcttgatatattcactacactggctgtcttttagttaaggatataggttttatcaataatttctcatcccttgtttttttcgtggttcttctcccagaaattaagcaaaatagaaaaagtaggaggaagtagtaggtggcaggtaactttcagagacccttcccaagtcactcaaagccatttacagccaacattctaaaaataacagaaattgttgtcagtttcctgcttttcttgaactaagattagagtgtcttagcaaccaactatatcacccaacatttcttttcttctgatgcccacatcaagtcacatggtattagtagaatcttggggctttaccctcccaaccaaaactacaaagtgagattacatctcaaaaatggttttgttaaagaagaaggagaaggagaaggagaaggagaaggagaaggcgaaggaagaagaagaagaagaagaagaagaagaagaagaagaagaagaagaagaagaagaagaagaagaagaagaagatgattattctaagtctcagtggaagaccagcttagctgagatttcatgaataaaaatgaggtcgataggagagtaaggactgtgtctacctcacaaatatacctattacctaacacttgataccacgtatgtacataaacgtatgtgtgtgtgcatagtttacatatctgtgtaatatgtgcatatagcttaaagtgtctggaaagatttaatggccggatcactgaagtggatgtctataaaatgggtgttagcatgcctcagccctttgttggtgctatgtaaacagttctgttactttctgaagattaaagagcgtgtgcttagtgattctgtagcactgagtgcagataactgagttaagaatataacactgcagacaaaaacccaaaacacttcttaatttaagaattaaagcagcagtggaattggtaggaaacaaatgtgagcttttgactgtcggacttgcgtccactactttagactattacattatatagcttcctcatccagaggcagaaataaaagccaccttttaggacctctgcctcatagatatccatatcattttaaagataataaattcacttataaataaaatattactctaggtacagcagtctgcattaagaatatttaaaaatacagcattaaatctgaatttttaaaaatatacttggtcacactaaagaatagcattctgaattgttgatttttcaggcctgaaaaacctgatggtaggtcatagagtaaaataagaacacattattataagctttatttaaaatattttaaggtctttatatttctttattactggattctccacaccccgccccctgccgttttgttttgttttgttgtgttgtattgtgttgtgttgagacaggctcttactgtgtagctctggctggtcaggaattagctgtgtagaccaagctggcctaaagctcacagagacccttccctcctgcctctgagaccgactgttggggttgaggctatatgccactatacctggcttctttttccctttttgaaaatgttttcaaaagattttatagccattttatgtctagaaaacattgaacaatgtttagcttttctctcttgaacagtatagtcactctaatagactttctgatttttaaactttgacagattaccaaagctttacctgtgtgaattctgtcttaaatatatgaagagtaaaaatattttgctaagacactcaaagaagtgtggatggtttcatcctccggccaatgagatttaccgaaggaaagacctttcagtattcgaggtaagcaagtataaacaaaaacatggtctttttgaaccctaatattcctaactgttgactgtgtgcttggatggtttgtgtatagatagcacagtgtgtattcaatcttagcatcggaattcacactgctctttaagatagcgccatggtttagcatatttatctgactacattaagcaaccatttagactgatgaagaattcttacttcatcacatcaacttttttggggctttttaaaatccctttctacagcacagtatgcaccagtgaattagtggtctccttggctctttgtaaattccacattctttggcaggaggaattagctttgtttagcagctccagccagtgtctggcaggtactccctcttccagggaattgagcagctgtacgtatctgcttagcacacaaacacctgtgcttctgtccagttcttgccagggtggataaatcctctgggcgagatcccagcagatgttgggactcttccccagtctctgtggacagctaccctagagaaccttgccgttcccaggaagccctgtgttcctgggtctcattgtaggtttcttgaagatattttgtgttttcagagcagacgtagtagcagaaagtctctgctttattttcattgtttagccaggcttctgctgccaggctcggggatctagcttagctgatcagctgtatactgaggactccaggctctcctttggtggtcctgtctgttcagagggtcactgtccgttctcggcattaatcctcctcactgtagctgcacatttctgtgctttgctgtattggcctctttgttaccatcctggtgtgttgtttactcttcagggtctcagatcaagccttcctcctacggcagacatgatgtcttctttttctgaaaaccagtgtcctttctctttccaatgctcatgttgctgtgtatcattctgctgcacagctgccgtttgctctggcctccagtgtccctccattataataagggagggtcatcagtttcccatgtgtctaagaggcttctcaggcagggctttccctctctagactggtcaggtacctactgctgtggtgttttttaagcaccttcctgctctttctagtgagcttgaagggcaagtggaattctttgtgaggctgcgctattacttcttattaaaggccaagcacaggctgctcagcctgagtactactggcatttcaagctgaataatatattgcataggaactgtagtatactttttaaggtgtttagcagcatcctgccgtctacctcctggctgctgctgctggtgcctcctgtccattcgtgacaaccaaaaatgcctcagcagccacatatctgagcagaaagagggtgggaggtgaaggataccaagtacaggttaccccacttgatgtactgtcgggctgccactcaggcagccccaagaaggcaggggagagagttggtctcagggagcctttgcgttgtgccagctttactgtttggtcctttcctcgtgccctggatgcttttcctccaaccgaaagaaaattgaaacgactgttcatcttttcccagacagcaaaacacattgtttgccttaagtaattattgaataaatcatcatgagtaaggctgtgtgtggacgctctaatctatcaggaagtcatctgggcaggataatcagtcttgttagacatgtgtttgaaagcacagagatgaaagtcgcccaggagtgtagttcattcctacactgagggtgtggaggaaaccctaaggccctattctagcatcttgattgaaggtatcagctttggaaaggaaactttcggatcttttctgtgatttagaaagaagtaaaccgtatctgtgattttggttttgtgagtctcttctgtacctgtctcttttcctagacttctgattgatcggagattgtttcagtgttttcatttctgtttctgatgcacagatgtacatcgccattagttcttgtgtacggcactgtttccaaaaggaccatactcccaaatacatcaaaacgtcctttaattaaagagagaattgtatcctcagtgccagttgcctgtatttgattatgttgctatgtgtgggactaaggttctgtccaagggaaatagttatatgaaatctaaaaataatttgtgcagtataagaaccagtatggtccacaggagacctgggaatggtcaagttcattgtcaaagagctcgggttagcaaaacctgactcccctaagaagagtgtggggtctgtttggctctctgtttcagcaagtcactacatttgatcaaagacattggtttctgtgccttagctcctgtggaggcctcggtgtcccagcttgagtcttttattttgaagagaagtagactataatcattacacttactgtaggtttaaattcacctgactctctctgtaattattcccaacacagagattgtatattctccagttatattaaaatgatacttgggataaaactaaaatggatgcctctgctgtttaatccacacttttgaagaatcagaataactcaggcggttcatttatattatttttatttgaagtccttttgaaaataacaaaagtttggcatgcatgatgaaatttttatttgtttttttaattttcagatttacttggctccaatttaaaagtaagagggcatgcctgataaattttaactcataataaattgcaagtgaaagtgactttgctaacgttgctgtttcttgaacgagcttaaggaggagacgttagctgtcttgaatttaccttaacaagaggaaagatgggattctggctctgcaagtaacagctgttccctggttaacactgtctttgtttaatggagtattttaatcttagagtgtaggatttagaaataaaattatatactttttaaaatgatatacagaagaagcaagtttatattctgatgatacttttatgttaaataatgttgtctgtttctctttttctaggttgatgggaatatgagtaaaatttattgccaaaacctttgcttgttagccaagctcttcctggaccacaaaacattgtattatgatgttgagccattccttttttatgtccttacaaaaaatgatgaaaaaggctgtcatctggttggatacttctccaaggtaaaccacgagccagcatggccttctctcgcttgcttgcaaatgtttttagtggagctcaggtctttgaacagggtttttttgttttgttttctcttgtttttgtatttttatgacaataatttgagtaagtggctcatgtttctgaaaacctcagctttttgtttaaagctcatttgaaaggacacaaacaagaaacaaaacaaataacaacaaaaggtgcctaggaagtgtgtaaaggaccccagaaccctgtgctgtgctgacagtgaccatgcgacatttcattaccaccttgtagactgcctcgcagctttgatttccaaatgttgagcttctttcttcttttaagtggtgtgcacatgaagctttctgtgatggagcacttaagacctcagcctctctggctcatttcctacctcgtggtcagcagtatccagtgttagagcattggtgtgggctgctgagatggctcctgagaaacgtccaggacctgcttggtaggagagaactgactcccagaagttgtccgcatgcaccctaccctgccctgcctcccaccccacacacaccaaggaatacatgtaattaaaacaaaaacaaaaacaccactggcaattgatggcctagttgataggtggctggttttccaccgctgcctctcatgatctgtgctgtggtttttaagttctaagggagtcttgcctgtaggaaacctacctgtctctagcagtcaacatggggaagaacttgcatactaaggcacagtggctcgtcttttcactggttcagagctcttctccagaagaaactgctcagaaactgctgttgctaagtcatgcaccttgaaagagagctggtttggaatgtgtttgccaggtgttgaactttccctgggtatgcacccaagaatggttacagaaacagagatggtaattatccagacgctcagcagatgagtgactttattggatctgcttttctttaatgttcatgatgaaacactccatagaagtgctgttttcacaggaaataagaagctagactatcttcccggtgtgttggcatatgctgctaatataaatactcagagggctaagacaagggatcaccagtttgtggtcagccaagacggcatggcaagactgtccatgtccctcagtgttctctccctccagacacatgaaccatccagaggtcctcctgtctcatccctgtgtgcagctattttgactgactctctttccttctttctttctttctttctttctttctctctctctctctctctctctctctctcttttctccctctctctctctctttctttctttctttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttggacgcttttctcattgatttcagtaagtgaaaatacattaccttccttccagagtagctgccggctgtttcaggaaactgtacccgcataaagctttatttaacctgctgtgctgttttctttttgtaatcgtacatagtgggtcttctgtttataaccacctgagttagaagatcttccctcacgtgacagtttccctgacacccacttacactccagggaaaatgagactagatctcaccacagtgcccttgcctcagaaagccattacctgcaatgagctggtagagttctgtggcactgtgctcactataccattaggtaattattgggaataagcacaagcgattgttagttacaaggagttttcgctttctcagattttgcccagtagtctttgtggagcagaggagagcaggggtaaagagagcctgttcacctgaggaggctctagttacttccctctcactgttgcagaagctgttggtaacgaggtttctcaggagctgctggcttcatatgcacttgtagccctgagcctctctggttaaagctggatgcttgcaacagtgcagcggctggatgcttgcaacaatgcagcggctggatgcttgcaacaatgcagcggctggatgcttgcaacaatgcagcggctgtgcttctttcttagccgctgtctctcttcttgcttatttcatactaaggctcaagctgcatttagagagatagtagcctgtgagccccttaccctgtgatgataggactctctagctatatgacagtctgtcacttagtgcacgtgaattcgtaggttgttagctggataaaggaaatttgaatatatgtgcaggaaatgcaaggccttgcatgtaggtatgctgtgagggtccataaggaagtatgttgactctataagtctctatcattagattctgaaatgttgaagtctgcagataaattttagactgattttgtataatttcctgaccaaaaaaatataaaattaaaaaggattttgggttgattatttttataccttcagatagtatttccaattattaatttgttttcctagtcttactgttttggcctagttatccaggagactaattgtccaaggagggctatatactagctcactgtcgttcctttccacatcctcgctgtaatcagactctttttcttctttagttttccatgttttaaatcactgttccctgagccttccatacttgtacctaatgcactgattgctcctctcctgccctccctcttccctccctcatccctcacccccttgtttgctacttaatctctttcttgtattcatgtctttttatctatgtccctctgggtttgaccaagtccatgtatgtggctttagttcctggtggtgtaggagtgggtacacatgtgaagaccatcattacatgaggttttttttaaggggggggggttcttcttgtttatattggataagtaaatgtacagttacattcgagttaaatccctgctacagctatttggaaaggcagaattagctgactctttatggaatattttacagtcatcatgtatgaggcgctcatctataactacactttctgggatacatcacaaccatgcaggtctaagcttgctgacagtgttctcgtgtctctagactaaaaggacgttccaggagacagctccaggctaccttttaagctttttgactcaacagtttgcttctctgagttctttttctgtgcatggcctttcctgacatggccccttcctcttgcctgttcaaaaccatgctcatttggtaacaactcaagaacctcttatctctaatgctgtctttgtaagttctatcttataccgtcccagctatgttctatacgagcatgcttagaccgtgtttgtccttttgtgctaaacatcagtatatcgtgcttctgagttaccgtgatctccttggaaacttttttggatcagcatagttcctataacaatttgtattagatgtcgttttgctgatatgaagtgataatgaagctatctaaagtgatgcctagattataaaggaactggtaccaccaggtaaaaaagtcaagctctaaatacagtgatataattacaggggacatacatgaatgtacatgtatggataacccagggttccctttaagtgctaaaactattttaaaacttcagacatgaaaaaacaaggtggacttgaacttttctttcctttgagaccaggtctcattttatacttctggctgacttggaattcactttgcagaccaggctggtcttcatcttccagagatctgcctgtctctgcctcccatgtactaagatctgaggtgtgcagcaccattcctaaccaccaccctgtaatttcagacatgaaatacaggacacactggaatacttttggggacatttgcggtcattatgaatgccatcctccggatgtgactgggtttagtagtcctgacagtcttgtagaacccttggccttgtctctccactagagtgcttaagcaccatgatgaaagattttagtatagttgaaaggtggggtggggaatagtttgaagggaattggtattgttttacagtactcacaagaaaacgggaccgagtgtaagcccaataaaaattcactttaaaaacagaattattccttgaccaaccattgtaaagaagacagggtatgctgttgaaaaattaatagcatctccttggtagtcacttaaaatattagtaggtaaatatctttccagaaccatttggatccaggcattcacagaggggggtggggggggagcacataacctctcatcagtttttcctcacaggtcagtgctctgggtaagaaagatgagcaggacttgtaagatttctaaaatatgttctgttccattaaaaggacctcttaataatggtttgggttctgttgtgtaaggctgggacctgttgattaaggttgtattttcagttagtcagagcaactgtaaagtagggaagtccttgtcaataatgattgtaatttagcaaaggaaaacagcatactgcacctggacttttatatatgttccaatagagtgtgtgtgtgtgtgtgtgtgtgtgtgtgtgtgtgtgtgtgtgtgtgtgtgtatacgctcttgagtgcgtgtgtctgtttgtctgtctgtctgaaaaatgcatgcacaagattttggcactgttgtccggtacagtaagagaactgatggggttgtccacaggcccaaatgctacccttccaagaagctgtctcttgcttctgggacagcttatctggcacttgtcagagtgaggtctctcaggaggctgtttgcacatcttggccagagtgagtaaaaggtgccagcatctcagagacagcctgctcatagacagactcagggttcatgactgctcaagaagcgatggacacaggctgcaggggtctcttctcctggattctgagatttcctctcccttagtcaaaaactttaaagccctcctacacacacacagacaactctccaccctcactagacatgtcaagacttcaaagaagcccacttcccacaaaacttctgctactttttgcctcccacggacaaggaaaatagctgctcttcccacggggaacagctaggcactggggagctagaatgttccttcctgagccctggcctgctcctgctgttagagctgcccagcaatgccttatatatttcactgtttctttattttgaaagaaaattcagacttgagagaaaagttacaatattgtgcctagaatttccatgaattctttacctggatcccctgggcgttggcatgtatagtgtctgttcttttattctccttcttctctctcatacgtctctttcctgaattgtgatgaggatgaaccgcgtgtgttagtccatctttaaagatcctctgctgtgtatcccacaaactctcagaaccaaaatatccctatcagcaggcactctgtatgagtgagtgtgctagattcaggtttcgtcttgccagtgcttcctgctgtccttttgggggaaatacctctcagtgtgggtttatttctcaccacattcagtcactgggtctcttaaatttcccaagatcaggggtattggtgggtttgtcttgattttagttccttggacattgtaaagtgtgcggggacctattctgtacagtacctgccttcccattggggcttctctgatattagatttgggtggtaagctttggggagaagtactagagaaactaaggttcctcctccttggcatacaaaatgtgctgaccatgttatgcggtggtacctgccaagtcattgtaatagtgtctggtaagaagataccttgaggttatgtaaataccatttctcccatcttttcctcctagtttcattgatgggattttttttttttaatttggtgtttggaggcagagcctcacataacctaggctgtcctttgacttctgacactccttccctcacctcctgagtttaggatgacaggtgtgtatctgcccaacctaaagaatgattttcacgagggctggagagatgggttagcagttaaaagcactggctgctgttgaccaaagatccgttcagttcccagaactcacgtagtacctcacatctgtgtgtgactctagttccacggggatctgggctctcttctggcttctgtgggcaccagtgcttccatggtacacagacaaatgttcctgcaggcacaagagccatccacataaaaatgatggatggatggatggatggatggatggatggatggatggatggatggatggatggatggatggatagatagatagatagatagatagatagatagatagatagatagatagatagatagatagatagcagagctgtgctcctcccttttccgtaggtcaccggctacactcatctttaggtgctccctcctctccgttttgtactgatgagcatgtaggtgtgccctttcttactactactactactactactactactacttctactactactactacttctactacttctacttctactactactactactactactactactacttcttcttcttcttctccttcctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataagtatcacatacccagaacacatggaggccagagaccttaagatttattttattttatttttaattacgtgtgtgtgtgtgtgtgtgtgtgtgtgtgtgtgtgtatgtaagtaagtatgggttccctcagagatatttcaccaccaccacccccagctggagttacaggagattgtgagatgccccacataggtgctggacggtccttgggaagtaaaatatgcattcttaaaacctgggccaggggctggtgagatggctcagtgggtaagagcacccgactgctcttccgaaggtccagagttcaaatcccagcaaccacatggtggctcacaaccatccgtaatgagatctgactccctcttctggagtgtctgaagacagctacagtgtacttacatataatcaataaataaatcttttaaaaaaaaaaaaaaaaaaaaaaaaaaaaaaccctgggccatgcttggctcactgtctcaagccttagtgattgggatgcctgaggtacactccagtgaatacttgaataccagtgactaggttaaatgctcttgctgatgtctctgttgacttgtcagccaacagtggctgtatgcagcagcattatctgtgtagcgtatgcagcatatctgtgtagcgtgtattcagagctaacaagccaggctgaaggttgaactccaagctcagggaactgacatgccccagaacatgccttcatgagcatgcatgttagatgtttcacatactacaggcagattaaagactcaaggagtcttgtgctcagcaaagggtctgcattaaaaaaagctagtagaagttagtgggcatgctagataacagctggagtaagaacagccaaggggtccatgaggctggggaacgtggctttgagattccagaaaacaaaggagatgagtgtttcagcactgactgatcctagcacagctgggatttgtgaaattctttctgtgtgtcacctgaattgcacatgtgagcccaattctcacagataactatggggaaagtgacacaaaaaaacagtcatagatcctcagtgtcccaaaggaaaaggtgtaagcagtatacctggaggactgtggcctaagtggaattttaaaaacatgaatctggggctgggattaaaagcacttgctgtatgagcctgacaacatgagtttgatttctggaatgcagtccatggggggagtggagatctgagtccagaagggtttccactaactttcatgtacaaacacagcccacacacaacaaggggaatgttataaagaagtggatttacccaagaatgatggcccacgtctgttattctcggttatggcagaggattgccatgggttctaggcctgcttggactacaaaatgagaccctgtctcaacaaaacacagagcagggagaagggtggttcagaaagcttgactttccagagctgggggcaacatggtggggttgtttttatactgtaaagactaggacactggattcgagagtgtgtgggtgtctgtgtgtctgtgtgtgtgtgtgtgtgtgtgtgtgtgtatgtgtgtgcgtgcacgcgcgcgcgtatgtacaaatgtgttagggaacactgatgagaaagattgaagtaaaaacaaaagtaatgcccaggtgcagttttcattacaaagtcataaacgaaaggcatttagtgaaattagttgcactttcctagctaaaagactaaaaactcactaactagaactatagattctagagtcagcaagataaccagctcagtgggtatacgtgcttgctgtgtgactctggtgacctgagttcagtcccaggaacccagagggtaaagaggggaaccaagtcctgaaagttaccttctgacctctatatatagtctggcatctacatgaagatggtgatagagaacatttttaattaaaaatattttgtttacacatgggctgcttcagggctgctgagatagacctgtggttataaccatattcttctcttccagaggccccaggctcagttctcagcgtccacatggcctcttaacaaccttctgtaactccagttccaggacaccaaccccctcttctggccgctgtggcactaggcatctacatggtgaatagtcatgcatgcaggccaaacactcatacatataaaataataatacaggaggggaaagaaaaagaagagtctgcttgctgagtctggtgataaccggtctttaatcccagtactcagaaggcagaagcagtaaggtcgttgaggggttgagtggtggtattgcacagttcacctatgctacctactcactgcagtttttctttcttacctttttaaagtggtcctgaccattaaaaaaaaaagaacaaacaaacaaagccactgtcccagcccctagctgtgtgtggcacccagtgttgctggtcttcctcccgtctgaggttgtcattggaatgaaggctgtttcttgagttcacttacttaagttgcaacaggaaggatcgttgttctcaactgccaatcttgggcagagagaagagactaagttggttgaagagatgtttctctttcccttcctcttgacaggtagttcatttcttggcacatttattttagaaggaaggttccagtgttagacctcagaaacagtcagctctgtccgctccctttctctgccactcttctcccagtcagtgcaaccaaggcaatcattaaagagaaacaagatgtccttgtgaagtggcgttgaggtccttccagctctcggatagagacctctcccttgacacttggaagagctcgggccagccactgtcactggaaggcttgttttgatctgtgcaattaagtttgatgatgacatattttaatagagtctagtctataatagaataaggaaagtgaacatctttccttatttcctcattgtaataagtttctccaaaagcctttgccactactgttttagtacacggagctgatctgtgatacattttaatatgctaaagataatatggaggtggaaaattgagtctgtggtgatttattcagaggttgactgctactgaatacatagacatgcattgcatgaggcagtgcagccaatgtttttatgtatcttttttttcaaataaactaggtttatcataaataagaacaaataaatagtttgtatagactagtgtgtatcattgcttcagtgaaaacatgactatgaaacatggggtctgccatctcattcttttctgaacaccacttacttgctttacatacctcaggcttttccagggtttggcacacaggtggatgttgttgccgtgtaacctttgttcagattgctacccagtgggcatatgcagcgagtagtgttggaacccactactgggcaaattccattccgataaccaataagcatcagttggcagtggcatcctgaagacagggacttttgccgggttgaatgcccagccataagcacagtgcttgtcagtcacataatgggcatgcagtgcttgtcacataatgggcatgcaataaacaaccgttaagggaagaaatgagtgtctgactctgctctttgtactactgggagtacctccaagtacacacagccagcttctgacagaattagctcttgatctgagattttctcatggccttctgtcttgtcacatgtacacctttattcttccttctgcagacatgctttggacggactttggccagcgtggcctcggtgacgcagccaagagggtacatgatccaggccttgttgtggggtgtcagacacagggttcataactcatctctgcggtcttaggtgtgagggtatactgaggcttcgcagtgggaagtgcttccaactcgctttcactggccccgttatggtatttgtaaggcagagcaagatcacacaagctttgttcttagtgcttgaaactagtgctttcctgattttggttccaaggagactattacctttaaatctgttttccagctgataaaagaagcaatgggcttaatgttttaagtgaaaaacaatctactataaaagtttgcttgcagggcaatggtggcgcacgcctttaatcccagcacttgggaggcagaggcaggtggatttctgagttcgaagccagcctggtctacagtgtgagtttcaggacagccagagctacacagagaaaccctgtctccagtttgcttacctcttcaggataattttgataatgcagatgactgggtcagaaaatggttacattttcttgtttgctcctttaattttgctttgggagaaaatatgtttttctttatttgcttagagttatattagagaaatacagttttacactatatcatactacactgttgtgtttaataacataaaaacttaagttttataattatttatgttgcatcttgctttggattaacattaaagaagaccttttcttcaacaaaattgttttaattaatatttttaaagtacataaaagtaattgagtgaattaaataattttattatttatatagcaatatgttgtccatattgaaacaaatgcgcaacatagttatactgtagcaggaaccaaagataaggttgctaaaattgtgatgcccatgtacctgggaactaagtagggttccttatgtgaaaatggattgttctggaatagggggaatgatactaaaaactaatctgaacaatgaaaagaaccagttcattgtcttaaagctggtgaatgaagcatttatcctgtttcccctgtctgagctgtaccactaggtgaccaagtggtgcttgagaaaagcaatctcttcccatgaattaatggatccgtacattgaacatcaaatagctgcaaattgcacaaagaggagcaaacagacatgatcaaacttctattctgtcttgctggaaaagacatagaagaacatggtgaacgataatacaagcacaccacgagaaagccccaagatcaggaaccgataggaaagaaagaatatggggtagaaggagaaatccacacattaaaagaaagttaagtctttgtcttaaatggacacaactgcattggcaccttgatattgtggtggtaaaggcataacaatagcaatagagcctgagagatgtgtcagtcagtggttaatagcactgaccactcttccagaggacacaggttcaattcccagcatctgcatgatagcctacaaacatttgtaactccagttccaaaggatccagtgccctccttagcctctgagcaccaggcatgcacataatacaccaatacttgcaggcaaccattcataaaataaacaaagctaacccaggaggtggtggcacacacctttaatcccagtgtttgggaggcagaggcaggctgatctctgtaaatttggagcccatctggtctacagatccagctccaggacagccagagctacacagagaaaacaaaagcaataaatctaaaaatagtaagaataataaaaacctatccctgattgctaggaaaaggctttcagtagttattgatgagagaaggggaaggaggtattgcctgggccaaacagaagattgcttggtggtgatcagcaaaatcctaagtgatagtcccaagggcagttgccttttggtaatccactaagctatacattgtatgtggttgtctgtgttcgttggaggcgtgttttgttttaaagtgggaggtcatataccctatggcatttgttttatggctgtaacccttaaaactctcaaaacagcctttttttatttattggtggtattacatcagtggtgttgtaaagagagagagagttcttcacctttactgctctacataagaaacattaagtgcataagtgcttggtgcttggcaccagcttcctgtcagcctttgcaaagctgtttttatgtgaagcaattgcaccaaacatcactgagactgaggccctcaagtgttgaatctcttagagaacggccttcctgtaacttctgcttccactgttaaacatgattgaagactgaagggtgatgaaatggaagattcaggtaagaaatacttgtctgggacttgagaggtggcttagcagttaaaagtactggcttctctcacaggacccaggtttaattcccagaacccacatgcatctcgcgacagtctgactccagtttccggggatccagttttctcttttggcctccatagatagacaccaggcacccccacgaggtgcacagacattgcatgtgggcaaaatattcatactcataagaaatataaaatagccttaaaatttttaaatactaagaaagaaatgtttctgccgtgaggtggaaagtcagaggtgaagccgagacgagacattccagcctgggcactcatgctttgttctcctactgttgattacactccagagtgaacgaatatagttctgtcagacactgcaagtgggagtgggatgccctctccttccagggctaatgcacttgtgaaatttggatatttaaaaaacagtgcttacagaagagaaaatgggaacgaaaaggcttaggttgccagaatgaagctgtgctaggtgagattaaggaagacacctagagttatctgtggcttctccctctctgtcccctctctctccccatnnnnnnnnnnnnnnnnnnnnctctctcccccccccactttctccctcttcctctctctaacacacacatacatacacaccacagtggggggtgggggggtgtgtgtgccaaccacaagatggctttctgttcttcctgccctttgctttgtccaatacaggatctttcctcttgaattcaaggaagttaattttattttctgtaccacagtagaaggtacatcagaggactctgtgccagcctgccttgcaccctgcagattttcatttgcttccagttaaaaacttacagaccatagcaagtacttttagagaagagataaaatgaatggtgcttgtgaactgttttaaacaccatttagaatacagtttagaaaactcttccctgaagaaaagtcactagctttcatcactactgggaacttttcagagaattttctctgaaataccttcctgccacatctccataaattaactttctttgacctcatcacacataatgctaaagggttaaaaccaaggaaaaagtaattgtgtgtctcagcctctttctctgcagattgcacaggaagtttgttcctgtctgcagcagggtaattacaagagatggttccataatttacagttgagtgtacttgtccataatcacacacctccaccttggcgtgcagaccctcctgtgtgtgccctgtccttttatttgtaaatgattaccatatgatctcttgcagtgcagcattgaattgagttatcagtaatgaacttcagctattactgtgtatgtgtgaattcctgttatttatgtgattagtggctcttagatttaagttgcctggtaatgaacaaattaaactccctgcgatttgtctctagctaaatagtcctgggcaccctaaccagaatagtgactagtgtgcccgcagtagagattcaaccactgaaaccttccttccctgtacattcaagaaccttcaaagttggtgatttggtgattaacaatgtccacacaatagaaagactcgtgggaatgataactgtgatattatggataatgccgtgctcatattaatatattgttactgatggctcaactctagctgcatccagtgttagagtcagtctgaacagcagcagaattgtaccttgtgcaaggaactcagagaaatgtactgtctgcaagctcaaaaggcaatgatgtcttttaatactgtttgtaataagttgggcacaaaggcacacatctgtaatgccagtgcactggaggctaaggctggtagatcattagttcaaggccacgccatagcaagattctgtctttaaaaaataattccaaggggctggagagatggctcagtggttaagagcactgactgctcttccagaggtcctgagttcaattcccagcaaccacatggtggctcacaaccatctgtaatagaatctgatgccctcttctagtgtttctgaagagagcaatggtgaactcatatacataaataaattaaatcttttaaaaaaaaatccaagatgtgtgtggtggtgcttgcccgtaaggagatcgagtcaggagaattgtgagctggaggccagcctggtctacagcacaagttccaggccagccaggactacaaagtgataccttgtctcaaaagcaatgataattataataaacccttgttattgcttctgaaaaccctgcttgtatgatacagcatatattcttgtttctctcacagaaacatctaacatagccagactaaatgtttgagttctatgaccaaagctactggcaagtcagccaaccactgaagtacgtgtcccacccacccctagttcccacacccagcacacactgtcctattggcagtggctgagccactgccctgacacagctatctatttccagaagctttgtgcctcagagtgtgttcaaaagcatgtagcatgtgcatgcgggaggggtgcgagcatttgtctcgctaacttggggatactaaagatgcttctgagccttgagcagatcagaggacgggctgggctttgattttagaaagttgtctcaaagactgacaactcccgcttgagatgtactttgtttgaaaacaaagggaaaatggaaagagatttgttcttccacttttcctgatgccatgctttacacagtctgtgtctgctaggtgagcgctcagtttctagccctgggtgctggtgtgtgtgtgtgtgtgtgtgtgtgtgtgtgtgtgtgtgtgtgtgtgtacaccagacagagagacgggcaggcagacaatatttgtagagctgtaaaaggtaagagaatggcctgggatggggagagggaaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgctcgcacacgcagactctctctcacacgcacgcacacacacacacagctttgttgggctagctgagctgtgcatttactgggctcagctaactgggctgcccctccagtggctagaagtgaagcccttccagttcactcggttgtgggatcttggcgccagggcagtttcatgccatttgatgaaagtgtgcttggtctatgagttttgtgagaattttgaaatcatgtagcttttcaataggaaagtcttgtgaggattttgtacttgtatgtagaattttattcaaggtttcaacttggatagcaatttagggtgcctttttgctgataggtgttattttttagaatattttttcaagcagtctttagtgtgaagaaaattttttctaaaagaagaaattagttttaaataccaaattacttcttaagttttctcttttgtaaacctgtgctcttcctaaaatatcctagaatttaaaatactgctattgcatttaaatgtgtgtgtgtgtgccacagtgcacatgtggggaccagaggacaacttgtggaagtgagttcgcctgctgtgtggtgctcagggattcagctcatcagcaacagcctttacctgctaaggctatcagaagttaacagcatcctgtctccatttctgtctcatcaaaaacagtggctcctagtactctaccatctcccagtgaagttgcctctgggaacaaaccggcttgactgatatttgggaatagtagttggctttgtgaacaatgtgattccttctgaaatatatttatgaaaacatttttaaaaaatcatttaatttaaaaaatttttaaatgcttttagcttggttatatgtgtcattggtagagtattcctctctcattctacaacatcttctcctataccccaggaccttatttccctaacaaggaagttatggattgaattcaacagttgatcatctactcaggaaaagaattcagcactcaggaggcagaggcaggcagatctctgtgagtttgaggccagccaggactattacacagaaaaactgtcttgaaaaaccaaaacaaaaaggctgagtgtagtttgcattgacataccttaccctagcagactgcacctgttggcttcagccatcacttgacatagctaaagccatcccaggaagtcttcattgagggattactcagatccgattggcctatggctaggtctctgagagattgtcttaattatccatgtgggagggcccagtgtgggcagggctgcccctctgcaggctttctaagaaagctaaactaacagcctggcatggtggcacatacctttaagcccagcactagagagacaggcaggaggatctctctgtgagttcaaaaccagcctggtctacatagtgacctctatggcagccaggactacattgggagactacatagaaaggaaggctagctgaacaggaatcagcaaacagtacttcagcagtgatttcagcttcaggtcctgtcctgacttacctcaaatgaacctcttcttagtctgtaagccaaataagctcctcccccaagcagcttttgatcagagtggtttcttcccagccacagaagaggaaactggagcacactcagtccccggttctgtttgactgagagaaacctctgtgcagtgcatgccacaccctctttactaaaactttaccttctgcccaggctcttcctacacgtcaggcccaccctttaaagttctgggttaaaggcactcctcaagacttttgcttaatactgtatctgaaaccaaactctcgtgggggaaagagttgagatttaatgagacggacatgaaggtcaggaagtgattctaacgtgcagctatggatgagaaccgtagctagacccaagcacagggaaggaagctggggagagctcccactaaagcgggtggtcggttataaagacaccatggactcagtagtgtcttggggatgtgtgtctggccctcagactgctcccatggagcagatgctgccccggtcaccaagctcagcagcatgtcacagatgtgcagcaccctctgtgacaggcatagcaggaggaggaggaaagtcctaacttcgagtctacatctcaacaccctacatctcatctccccttggtatctgatgcagatcaactactagagcatccacagccaccagggagccatcaaaattgtttggcaaacccccacgtgctctgtaggcttgggcacatgtgccagtacagggccatgtctctagtgcaggcctccctttgggaggaacatgcagaccattcttctctggagtaggcgtcgggtagtggggatattcagtaaggaacactagtgactttgttccacataactgagggagagcttagcagtggagtgctcttcaggaagctagtgcatcttcaagatgtctacggctgagatgtgactcagccaacagaactttcccaaagacagcatgtccctgggttttcaggccggttttcccaggacacacttgagtcttctagaatctgcgagtctttgttatatttctctgggagcttgtgggtctgctgaagcctcgggcagccactgtgtttgtgggttgatgggctagttgttcattcagggtagtcattgaaataaatacttgacagccaaaaggaatttgggagccaattatgtttgctgggaattttcagtagttaatttcttgactattcctgaggccaaaggagaaggggcttttcctttaattaaatttatatttgggtggtaggaaacttctgaggcagtagaatggtcttgaggtagctcaagcaaacgtaggaataggaaggaggctcatctcagtccgacgccaaagagctctttgacttcttcctctccacattctcttaatttcccctacattaggagtttttagtcatctaaatgaacgcctatagatataacccttaatagctaatctttaagccaagcattattctgtgtttttattaacccatgtaatgcttccagtaacttgaaaagataagtgtgattattaactgtgtggtctaaatgaggattcagacatacacagagattaaagaagtgccttgggttacatagctgttacatggtaggtcctgaattctgccacacagcttgtggctccacagcctgtgctcctagcctcctgtgagctgtcgcaatatatgacagttctgaggttcttatggtctcattgccctgcttctcaacgtttgtattattcatatatacagatagtctgagtacagttcaggcagtctgaggtattccataagtattccaaagtaatgctactttcctctttaactctttttcattcgtgacagtaaagtggaattttccagaaatgtcatgacacaacagatgagggaccaaagtagatattgactggagtgtaaaatgtaaagcaagctttctcctctctagtttgtttatatttttaaaaatgcagggaaggctttttttaaattatcgaaaattagagtaacactaggttcgttgctgttttaaaattaatcaatgtcacttctctgtaaaaatcaacagatacagcctttataaacaaaagctctttggagtcttaaataagtgtttaaactacaaagttctgaagccaagatgtcttagaaccccaccagtgtatctcagcaggtatagtgacatgagccctggttagagatgcatgctctcaggcctctctctaccttctaagttgtaattcatgttgtagccagaattcttttgtagtgacatccaggcatagaacagagcaatcagccactcattgactctagctaacccacatagcctgatagggctttaggaaatccatctattctattctctcccagtaaggaactgatgggacctgacttatcccattgtacattcagtgtctctcccacacaagcctgtttgcctagcagctccagagcaggtcctcaagggccctgaccttgagtcacctttagggtctgtgagagtgcaggttgctcggcgattagtctagttgctatgtaattacactgggcccaaagaattatggtaaagagtgtctcaaacttccagtttcaaatccagtctgtttcaaaatgtctactttgagagacattctcaatcttttggtaaggtcatctttcagacacatcacaggtcatttggaacagggctctcttaaagatactaacttcaggatcagcactgaatttaaacaaaagacggcccctcaaatccactctggtaatgaaactgctaaccgtctacatggtcacagtgctgctagcccaggaaacgaataacagaccacatggcccagtgaactgccacctccaaggaactccatggctaaaggcattggcttacctcctaagttaacatgagcccatggctggtgtcaatccccaggcctgcaaagcccaggctgtgttctgttgtgggtcttccattggcgtctgctgagctcagcaggtgttggtgaaaggtatataatccttggagattatctcccctaaagcaactgaaagctttgaattcacataatccagacagatgggagctggaactgagtagcaagccaaagtttatgctgtgtgtctgaggaggttcagatggtttggaagcagacaatgacagatggaagtgtacacggatgaggggggacacttgtgaagatctctgtcacacccttgcctctttttactcttgctccactatatcatcctgcatagcacttgttcaaaacgagggaagttccaaataaatgagagttgggatcaaattgattttgatttattcatgactgccaaaacaaactttgacctcatcaaatagttacctccataaagtgggtctaccctgctttcctagaggcagttagccattcagtctctggtcaggaccaggcagcgagaactgatactttaggccgtcctcaatggaggccaggtggcctgtatgctctgcttggaaatgcttttttccctgcaagaggatcatctctgagtcaagcatgagagacttccgctgccccttcgacctcacctttcccctggtatgcagttccagtgacgcagaggaggaagtggatcatgctagtttggggtggttaatgcaggggatggtgtgtgggctactccgtttccattacgaggttctcactcatgactgagtgctcgttgcctgaatctttggctcaccgacaagttcaagggaatattcgcaccagcagttaattatcctgaagctcctgggacttgtcttccacacgtcacttttcgtctgaaacagtaggtttccccaggggtagttgaagttttctgattgaaagtgtcctgcgttaaggagaggtgtgagcacgccgtggggatctattcaccaggggtgtattgtacttgtttcagatgcttcaggacaatacaccggcttccaagataagtgctttttatttccctgcatcttagatcaattatttggaatctttttggtaagttaaacttaagagcttaaaccatcacatctctgtaattaataagtcaaatgttcttaccaaaatttactgtgtctgctttatattgtaactgtgctttgaggagctgagagaaagtaggaagggacagaaggtggcaagaagcccctcacttaacacccatgtcgcgaaggacagcataggtcagcatcagcagctcagctccttccaggcaagcgcctgccgcagatgacatttatagccagccgctcttctgtcgtcagtgcacaaccaggaggcacagcacctttccaaacagcacagattgtcattctgcatgccatttcagtcaactagtaagaaataagacatgtgttcatggtcatttttactgttcctggtggattctgtttaacatcagagcatcctccgtcatggggagattccaaatagttctcggcaaaagtgccattttcttcctggctgcaacttctttgagggtctctggattcccagaggaggaggagacacactacaagcagggccaggcacctcagggcattggctttgggtggtgtttggtgctcatcatccctgggatgtgtgcaggaggttctgactaaacattgggtttccagtcatattctcggcaccctgaaaagtatccctcccaacaagtgcttgcagagtccctgcctcttcacagcctctgagtgcacacacaacaggagggtgctttgctgggagagaccagtgggctcaatgtccatgacacatagagcgtgttaccttccacctatggggcagcagtcctgcgctgcagtcaaaaggccaaggaattgtcaggagtcagccttttgacactgcaggagtggagggtactgaaaggtttgtactccagtgctccccaggggctcagcttgctggctcgcctaaattaccgcatgctttttagactcggggtacaagaacagctaggtaaaattgaaagggagggtgggaatgcttccctcttaggtcaaagtgtgggaacatagagacataataaaaaccgtgcctccagggtaaggtagttctgtgtagtggtgagcgtaggtgggagggggaactgcttgtaggccaaatttctgccttcaacagtgggattcacatgaatcagtgagggcctggggacttccatagttagtcactgcagggaacttttaattgtgggatcttgtggacaaagggaacagttatcatccatggttctatacctgcgcctcacccccccacccccggcagaagtacagagctggggctcccagctgactaagtaaatttctcaggctatgccaagcacttagggagcaggtgacgggatacgccagttttctgtgctgaggtttgggcttcctccactgctctggcaacgcagcactctccatgttgacaggacacgatatgggctggctgcagcacagcagctgtccacgttagcattcctgacaccgctgttgaaaacctcagtgtggcagagcggcacgcgccgacagtggcttggctgttaaagtctggtgtttgtttgcattcaatacttaaacaggacgagaggagttaaaccaaaaatcttaggcaaaacacgatgcttattttatttctattctgtatgatgacattcaaataaaagctgtcaagatgcagcatgctgttgaggtagagtgtctttttctagatttctgcattatttgcaagtggttttgagaaacaggaagaaaatggatccaaggcattgatttctctttgtaacaacaacagaaaaactaaaacagaaaattcttgcaagtgcagccattttggaactgtagatgaaggggaggaacgctgatgtctgggttggtgtagagtggcctggtttggtgagtgctgccacctactgtctgtgctgatgtttgtttacacgcaggaggttcacggaggtgaacctcagggaggtgaggctgttgaaacaattagagcaaagaagccatcactacttgacagtcaattcttctctcctccattactgcctcttaattaccgagacagccaccagcttccgttcatttcctctaagtgggcttaaagtcttctcatttcagagtttctttgccagaaaagctgtgcggttcgagcttcatgtgctcgtgtattttatttgtaattgtaggagccacattctcaggttggcttagtttttatgagaagggtaaaaatagagctagcatcgtagatttgcgtttgccaccataggcgtgaaagccagtgttttattaatactaaaacagcttcaaatcagccgctggttaaacggaacaggcagtgcaggctgtgtcagccgaagccccttcactaagccccagctgtcaaagggtcatcgggtcctctgtggaaaacaacctgcccattaatgtcggggtggtccctccccaggatccgagagatcctgacattgagtatccgagagaatttcaggcttgcaggggatttatgtgtggagattccccagaagtctctttagtcttagctttcaacctccgtgacacacaacaccatgtatgttagctgccaccagctgtgtgaattcgcttacagtgtcaccacaaaagttgacaagcagaaatttgacgaggtgacatcactgtaattgagagaggtgacgagcttgacaggacacacttgacctgtgtgatgcttttaccttgtggctgatgacattgttcctagtcctggccctagctctgacaaccaagctgagtgcagttttgcttttcctgcctaggctatttgctttctcgaagagaaggccaagcagggtctcccgaaaagccgctctctgacctgggccggctctcctacctggcctactggaaaagtgtcatcttggaatacctctaccgccaccacgagaggcacatcagcatcaaggccattagcagagccacaggcatgtgcccacatgacatcgccaccactctgcagcacctccacatgattgacaggagggatggcaggtgagtgccctgctttctgctttcttgatccacagcaggatcaagcctgttgttgttgcttttgctggttttccattttcataacctgggtcaaaggaatctggattggccagggactttgttcttttaaaacagtagcccaggtaaccttcaaactcatgcgatcctcctgcctcagttctggattacaggtatgcaccagcatgtccaccatttaatcttgagttggtttggtttggtttggtttggtttggtttggttttctagacagggcctcactgtatagccctggcatccctccatctcagtttgttagaccaggctggccttgaactcacagagagtctcctgcctctgcctcccccaagtgctaaggttaaaggtgtatgcaaccacaccccactagctctcagtttttttaatctcactttgtcttgtctccctatattacaggtttgtcatcattagaagggaaaagttgatattgggccacatggaaaagctgaagaactgttcccgacccaatgaacttgatccggagagtctaagatggaccccaatgttaatttctaatgctgtggtttctgaggaagagcgagaagctgagaaggaggtgatgacgagctgcgtcatcctgagtggtgacttttgtcttgtagttgcttaagctaagagagtcatttgcgtcattgtgaaagctcagttataacgcttatgaaacgatacagcgctaatttatcctaaccgattaagacatgataattttattgaattaagtatgaaaaatgagacatttatcattgatcacaccgaggcactcagcactgacagtatgtaatcagatcagacttggtgctgggctgcagtgctgccatgttaatcgattctttgtgtttataaacttgcgtagagtgctccatgccagtgagcatgtaatgtagtgataaagagcttgaatcaattcactgcatcgttaacaccacttactatcccatgaaacccagccgtaacaccacttactatcccatgaaacccagccgtcttaggtctgctctcctaactgatacagctggaatgtgcttgaccagctggtcagaactcacttagagagagatcctttttcattgatcctggaggctccagccgtgtaactgacctcaccgatgaccattttgctccccaccccaggctgaacgactaatggaacaagccagctgctgggagaaggaggagcaagagatcctgtcgtccagagttagcagtaggcaatcgtctgcaaaagtacaatcaaagaataagtacctgcactccccagagaggcggccagtggccggggagcgaggacagttgttagagctgtccaaagagagcagtgaggaagaggaggaggaggaggaggaagatgatgaggaagaggaggaggaggaagaggaggagagcattcagacatctccccctcggttgactaagccacagtcagtttccattaaaagaaaggtgtgtatgcagataagctgttttctggtctgtctggcttctcttcacagtttttgtttcactctctgtagtttccctgtagtttacatctcagtggtccagtgtcacaatcgtttatcttacacttgtggttctgcttactgctaacgtgtgcagcatgctaaccaccctagtctggtgttcactgccacctgctggtctgcaggacacctcagaggcctgggggggtcagaccagaccaggtcacatgactcactagagggccagccacacctcagagctccaagtccagcgttcctgcattagtgtcccttattctcacatagggttcttaggtattccgcaccctttagtttgctgctggtgttctgcttgtgtggccagtgacacggaagtaaaactcttcatatcctgggtaccaggtagtctcctcagacagcgccagttcctgcccagtgggatagaaagcgcaacattggtttgtgtgggggtgggggtaaatgttcttccacatctgctatctttgtctgcagtttctatctgtgacatacagcagggcagatattattaatacagccttgacaaggagggataacacggtagaaatgaaagctcttcccaggggctgtcctaagaagtattttccaggcagtttgctagtctaactcccaactaggttctttcttctgacctcacagttggagttagcagagggagcaccccgtgaagtgcacttgtggctactcagcattttaacttcttatacagagaagtcagtcttgtgttatgggtagaatgagaggaaggagatctataaacagagtcattccagtcatggtgtgggccacagctctccgtatggattcacctgaaggaaaccagctctttatattggctgcacttgcgtttgggggaaaggtgtgggggcttagggagcagataacagcaagtgttaaatgactaatacggttagattttagaatgttaataggcctgtatgtgctctttaagaacattgaaagcattaaaagtgtaagatgcaggaattcttcagtactgtttatctggaaatagtgccccccccacccccaccatgctgggaggggagcccagtgccttttgcatgagaggtaagtgctctgctagtgagctacaccctggccctggcccgaagctgacattcacgtagacatactgagccctcacagagcagcattctgccaatttcatggttcattgacacatatcttaacattgaatctacctgttcctttatttaaattttgtatattagatgggtgtccccccccccttgggaaaatagcttattgttgcaaccacgggaagtcatttgtgccattatcttattcagagactgcgttactttttaaggtatcttccatatcaaaatagtctataaaatttttaactgcccacatcccagtagccaagactctctaactctgcagttttctagccagtaattattcaagcaccttttcattttggggacaaggaagttcaccttcagccccaccatgtttctcatagtgcctatcatgccgtgggcatctccagagcagttacaaggtaataaatgactgacctgatagccgattgttgcaacatttataaaagcgtttctagaatcatctgtgatatgccagatactgaagctggtgagtgccacttaaaaaataggtgctggaaaagcaatgctcagcttttaaaatctgcagttgagttgctaggatgttctctctcaaagcatctgcttgagtaaacaagtgttttatttggaaaacatatgcctgtgttcttggcacccaagagggatgttcaacatcaaatggaaggttaagtacaaaggcattgaagaagtcctgacatgtaagagtctcgggcgcacgtcagtacacgtttactgcgtatcacctcagctgtttaattcctcaggagcacttatgtattatgttttgaattaatttcagaggccttttgtagtaaagaagaaaaggggtcgtaaacgcaggaggatcaacagcagtgtcaccaccgagaccatttccgagacgacagaagtgctcaatgagcccttcgacaactcggatgaggagaggccaatgccgcagctggagcctacctgtgagatcccagtggaggagggcggcaggaagccagttctgaggaaagcattcccacatcagccagggaagaaaaggcagacagaggaagaggaaggggaagacaatcatttcttcaagaccgctgccctttgtagaagtaagtggagggttagttcgccgcagggtgtgccagtgcacctgagacacatgccagcccatcctttctcattcccagcgtctcgcccctttttccttgcaatggggtactttgtttctaaatcagaataatcctgtaggtggtttcttcttactctgtagaaattgcctcaccctaaactctgaaggctagtaagaaacacagcacacgttccctgatactgctctgtgatctacctagttagcatttttggacatcagggtatttgttaccagtgtgcacttctgttttccttgaaaacaacttctcagtgcatcagggtgtatcctaatattcctctgtgtgatccagaagcacctgaacttcaaacaccctcaatatcagcgttggtaatatgggatgatacagaaatcccaaagacagactttcttttgaagttgacagggataccctcttctacaaacataccagactcaagtgaattgtctctgatgccctgttttaaagcacgtatcccttactctgctagcacaggtactccaagatggacggtgaggagctgtaggacagctcctggtagctggaaggctgaaatgactctgtctaaaacttgctgcagcctagggaacaactcgcctcctttctctgggaaccacaggaattgctgtctatgtctctttttcaaagcataagccagcacttccctgactccttagtgaatatttgctatctcctgtttcattttttaaaattttatcctttccttttttaaagacaggctctcactatgtagccccagctggcctggaactcactatatagacacactggcctcaagctctgaggtcagcctttccctgcccttcaggtgctgggattgaccagcatacctgacccattctccctctccttctctcctcttttcatctcactctctatccctctcttcttgtctgtctctgtctctgtctctctctgtctctgtctctctctgtctctgtgtgtctctctctgtctctatctctctctctctctctctctctctctctccctctccccctccccctccctccctccctctccagttttacttagaattcaacctgtttgtgccggtcttgtacctggtgagcccccaagacctgtcagttttcctctgccccctcagtactggttccgggcataagacagcccacattgcccgtatgtgtgtatgaggaatctgaatgcaagccttcagcactgtgtggcaagctcttacactgcacccactgcgccttctccccagactcctgtgtacatgtgaggctcatggagagctccctctgcagatgtggacgctgagcctgactctcacttggaggtgtcggctcggaagcctgcagatgagctgctgctgctgcctctcaccttggctttgttctctttacctttgatggtcacattccaccatatttctttcacgatcctctccttaaaggagattattagaaaactcatcttctcatctagggatgtattcctatagaaactgtatggccagtgactcatagaataaacgtgggtaaaggcacttgctaccaagcctgacagcctgattttgatcccaaaaactcacatggtagcaagaggaaaccagttccttcaagttggtgatgctcgtcttcaatcccaatactcaggcagagacagaggcaagcagatctctgagttcaaggccagcctggtctacagtgctgtttctaggacagccacagctacacaaagaaactgtcaccaaaaggggtgaggaggggcgctaagagacattgagatggctgattcctgccattgtgaatgaaaggaagtggtgtgagtatccttggggaagtggccaagctctggagcttgtacagagtcctctctaaatcaagtacatgctgtcagctagtggtgagctcgatgtctgtagggaagtttatgtgccctcactttattatataaatgagctgatcttgctggactccagccattctggcatcaactttgtgactttgcttttattatcctctaaaatactgtttgtttgtttgtttgtttgtttgtttgcttgcttgcttgcttgcttgcttgcttgcttgcttgcttgcttgcttgcttgcagacagaagctgtcctagaactcactgtatagaccaggcaccaccacccagcaaaaatagtgttttaataagaaatgtcttaaggccccagtgttttatgtctacatacttattcatgaatatgtctatttgtttgctgtatttttagtagcaaacattcgttttgttttgttttgttttgttttgtttattcctctcagaattttataaggtggagtttgggtgagagaaaaccctgaagcagttgtctgcctgtacagggcaactggtatagagagcctttgaaacaaacattcttatttctgtgtacatagaggtccagaagaataggttttagacttgtaagaaaatgttcacttccatctggttgctgattgtcattctaaatcagatcttatatttgaacagcagactgatccctaatataccatgaacagaatccctgatttaaaacaacaatgggggctggagagctagctcagcgggtaagagtactgactgctcttccagaggtcctgagttcatgtcctggcaaccacatggtggctcacaaccatctgtaatgggttctgatgcccttttctggtgtgtctgaagacagcgatggtatactcacatgcatcaaataaatatttaaaaacaacaacaacaaaaacccctgtgttttaaatattcagtaatattatggtaattgtattttagcttgtgtcattgataaattgtgatgctaacaatgacagtgattacaactgcgctgttctgtgtagtcactcatgcagttcagaggtacacagtaagtaatgtctgggctggagagatgctttggtggtaagagcagtggctgctcttccagaggacccaagctccatccccagcacgcacatagtggtagacagccatctataactccagttccaggggatctgatgccctcttctggccttcatatcaggcatgtgtatggtacatagacatgcatacatgcaagcaaaacacccacacacataaaataaaatgaacaataaataataagaacaaagttatgtcagctgggatcatctaaatctagcaaatgttcacagagaggaggtcctttcctccggatggtaccagattaaccctttgagtgcagtgatggtttgggtatgacctaacattaatcctgtcctgtggtattttcagatttgttgatgttgaaattgattgttttacttttttagtattgtggagctcccagtttttgcatcttagaatgtctttgacttcctaggcctaggttactcgggttggcttattccacaatattcctagttacctctctcatcaactcttaaagtgctaaagtaaagcagtgcttgcttatttaaaagggtgtgttaagttgtctctggttttccttcctaaaatgtgtgtttttctgtctttttgtctcctcattaagaagatgtagatgatgatgcagaacacttgaaagaaggcagcaaagacaatcctgagcctctaaagtgcagacaagtgtggccaaaaggagcgaagcgagggctctccaagtggaagcaaagcaaggagaggaagacgggcttcaagctgaacctgtacaccccaccagagacacccatggagccagaggaccaggtgacgatcgaagagcagaaggagctttcagaggacaagggcagccccgtggggatggaacgggaggtgacagagaccgtggatgccttgctgcctcaggaggggagcagaagggaagagacaggcatacccgtgagtccacataaatcaccaggtggaaaggtagatgaggaggacctcatcagaggtgaggaggagggagaggaagagggagaggaggagggagaacgagaagaacaggaagaggaagaagaagtaactacagaaaaagacctagatggtgctaaaagtaaagagaacccggagcctgagatctccatggaaaaggaagaccctgtgcatctgggtgaccatgaagaggacgaggatgaggaggaagagccatctcacaatgaggaccatgatgcagatgatgaagatgatggccacatggaggctgccaacatggagaggggagacctcccaagagaaaccttcaaagacgcactagagggccaggaggcttttttagacctgagcattcagccgagtcactcgaaccctgaagtcttgatgaactgcggtgttgatctcacaatgtcctgtaacagtgagccaaaggagcttgctggggacactggaactgcacctgagtctgacgcggagcccccggaagaacagacacagaagcaggaccaaaagaacagcgatggtgtggatgctgagctcgaagagggaggcccagccgctgtggaaattgactccgagaccgcccaggctgttcagtctttgacccaagaaaacagggagcacgatgacacctttccagattgtgctgagactcaagaggcctgtagaagcctgcagaactatacacacacagaccaaagtcctcaaattgccaccacgctggacgagtgccaacagtcagaccacagtagcccagtttcatctgtccattcccatcctggccagtcagttcgttctgtcaatagccccagtgtccctgccctagagaatagctatgcccaaatcagccccgatcagactgccatcacagtgccacctctgcagaacatggagaccagtccaatgatggacgtcccgtcagtgtcagatcactcacagcaggtcgttgacagcggattcagtgacctgggcagtattgagagcacaacagagaactatgagaacccaagcagctatgactcaaccatgggaggcagtatctgtggaaacggctcttcccagaacagctgctcctacagcagtctcacctctagcaatctgacacagaacagctgtgctgtcacccagcagatgtccaacatcagtgggagctgcagcatgctgcagcagaccagcatcagctcccctccaacctgcagcgtcaagtctccccaaggctgtgtggtggagaggcctcccagtagcagccagcagctggctcagtgcagcatggccgccaatttcaccccacccatgcagctggctgacatccccgagaccagcaatgccaacattggcttatatgagcgaatgggtcaaagtgattttggggctgggcactacccacagccatctgccaccttcagccttgccaaactgcagcagttaactaatacacttattgatcattcattgccttacagccattccgctgctgtgacctcctatgcaaacagtgcctctttgtccacaccattaagtaacacagggcttgttcagctttcgcagtctccacactctgtccctggagggccccaagcacaagctaccatgaccccaccccctaacctgactcctcctcccatgaatctgccaccacctctcctgcagcggaacatggctgcatcaaatattggcatctcccacagccaaagactgcaaactcagattgccagcaagggccacgtctccatgagaaccaaggcggcatctctgtcaccagctgccgccacccatcagtcacaaatctatgggcgttcccagactgtagccatgcagggtcctgcacggactttaacgatgcaaagaggcatgaacatgagtgtgaacttgatgccagcgccagcctacaatgtcaactcggtgaacatgaacatgaacactctgaatgccatgaatgggtatagcatgtcccagccgatgatgaacagtggttaccacagcaaccacggctatatgaatcaaaccccccagtaccctatgcagatgcagatgggcatgatgggaagccagccatacgcccagcagccaatgcagaccccaccccacgctaacatgatgtacacggcccccggacaccacggctacatgaacacaggcatgtccaaacagtctctcaatgggtcctacatgagaaggtagacagcctggcagcccacccagcccactgggccccactattggattgatctgcacaaatacctttgaagagtacgatttcaaaaccagcattggtgtgaatgcaaaaacatttgttggcaccatttatttaaaaaaaaaaaagctgtatgcagcagaaagaaagccttatacaagttgtttttcttttttcctttttttcttttttggtacctttatttctgttacttttatataaaattctctgcaaaggaaggcctctcttaggactctagttggcagcggccacacgtcgtgcctgcttccattaaacagtgtggatacaagcccctccccaaatcacctgttttaatactgaacctccagcttttctccttcctgtctactccatggaaatgcctttagcatttcaattactgtatattttgtttaaggtgacccttcagcatgccgctaatgtctttgttagtgacagtgcattttgtagtactgtacaagtgttgtgctaacggtaagccatttcttaagttttttgccttgattagggtaccctaatttgagggttaaaaaaaacaaaacaaaacaaagctctatttttgttaattataaaactgtaaagagctacagagctatccccgtctggttagtgaagggggtttatcgctaaatgtttggtgtaaagttgagaagacctttttccattttggtggcaggctcctttggggggaggcagctttctgttttataaatgcacacttctgtttattgaatgaagcatatctcagtgtttatctgtcaggttttgaagcatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcagaaaagttatttgtgtctgtttctattgcgtccttttttagcctttgtacctggacaggtgacagtaagggccaagcaggagaggcgggcgcggccttgtataaaataggagccagcgggactcttgtatctacctgttctctttttagtcagttacttcaaaaaaaagaaaaagcaaaaacaaaaaaacaaaagctgtacattttaacataaaataaattatgatgagccatttctagcctctcgtgtcctgtcatgttatgattgatggagaatgaccagctgagctgtgtcatgtgtcacatttcagaacacatacacgatgggggaaataaattatttagtgtaaattgaagttatgagattttttttttctgatttgttttgactttgggggaggggttggcaataagtatgaatgagtactatctaataaaaccatcacctataccaaatacctatttaataaattaatttataatggattttaatgcttttccatgaaagttgactttatgctggtgcataccttctgtatgccaatcattgtctttaaataaagtgagtttggttttttctttttgactttgatcttcattttgcccagagctcccacatagataatccatttgcttcctttgtgccaagcacgtgtaaagccccagaggcctggtaccacactagcaagctgcttgcttttttttttttaaagacaagtcacaagcttctgactcatggtggtatgtctcaagattcaagtcttttccaaagtgtggaggttttactctgttgtgaatgattgtatgttttctttagtgtttatagtaacacacacaacatgaatgcttatacacattccatggcattcagagaaagttttgactgtgagttaaaatatttgcttacttgagcaacaaatttagaagtaaattcttggcttgttacctgtatgcgtttggctcactaagtttgcaaggcatctaagcaggcgcttgaaactctgcaggtcaaaccgtccataacttggcctcaagcaggcagagcagtgcatccacaccagcgcaaaaggccaccccggtgctcttgcccttgcttgctttctatgagtgtacggtggggttaacatccacattttacctttgagccatctgctcccaacaagccagtggagtaatctctcaaatggatgagggaggcttcaaagaaggcaaagcgagagcaaaatgtaattttgagagaaagaaagcatgctgtccgtcttctgagcagcagatgatgctgtgccgtttgtctggattgattgctagagcagatgggagtggctgagggtcccagcgctgcacatctggcaggaagctgttgtgtgtctaggaaccctactgaaaccccctcctccactttttatgtgctaatttagtatcttgtgtctttgggggtataggcactcccatttccctttgacagtagcctgtcaatcaatcagacctttgccctcttgcttgtttcacagtccaagggagcttatggatcaagtgctagtagctgttccacacctgccagatcagcacagtggttccttgtgacactgggagatggcttagatctgtcataactggacatgactgcttttagactggaatcctctgatagccctcatctttaaaaccagcaatatgttctctcctttgtaagagtgatcatctgatgccaacggcacttaaatagctcacatggtgcctacccaggtatgcaggccttgcttgccaacatactgttagaaatagtgacccagactgcctttgtcagcactccgcccccataaactacacacactgcccaggagtgggaggaacacaacaaagttaattgcccccaactcacccagctacaaattgtaaagctgcaatctatccagatgaccggaatcagctctcctaaacacgagtctgaaatggcccgaacttgtcacgtctctgccataaaatctgtactgctcagtgaatgcgggatcctttgttggaggactcgaacccagatgcagcctcctgccatctttctggggtggctttcctgtgtcttcctcctttacccactgatacccagaacgttatttccctctggtcttgagcatttcttccgcctcaagattccaagtcaaatttctagaatcttctgccccctcaaggctgtgtgcaccaagtgccagctcccccgtgtgttctcaggttccctctttcctactgaggaagagagctatggattatttcttaaaggttttgtttttatattaagtataggagtgttttgcctgcactgtatgtgtgtccctggtacccatggaagccagaagagactttgggtcccctggaactggagttgcaggcagttgtgagccaccgtgtgtgtgctgggaaccaaacctgggtgttcttcaccactgagtcaactctccagcataggtcaggaattcaaaaccagcctgggctgctcaggcagtgagaggctttctcagaccctcctagcaataaaggtttctcagtgagaaatgagctgcttgggattttttttctatcaaaggtggctaacccaccaagagccaatattccctaggtcacccccaccttgtaaaactttttttcaaatcttttcatctcccctgctctgtaaaactttgaagtaaaggccttggctcttgccggtttcctctttccttcatttccttctctatgctttccaaattagccaggctagggtagactgtgagattttgaacctcagccagtggagcagccaagctcccccttgcgttaaggataaaaggcaggccagcttggccctctgtgtgcttaccagccccatttggcttgagcacgccttattttacagtaagaagtggccttccccggttaacttcgagtttatttgagagcacaagagaaagcaggttccttcccaacaccccactaacttgtctgaggtggcctctccccaccatttcatctcccgtatcccacactgcattttattaccatctgcactttgtaatttgcttaatcggttttagaatgtactataaatctcaataatgctttttaaccaaacgaaaacgttgcttatgaagtctttaaacactaaactttctgttcctccattctcctacttctaaattccaggagtcagcaggaccagacagctaacactaggttctctgcttcaaaaggactccactccagggaaaggggggatgtggtatgaggtacggggacagtggctccagaaaatcctgagtgggactatgtatgttctatcctacatgtgcgttcaccttcagcgagtatgtcatgaaaatagaaatgctgacttgtctggatactgaatagatgagaccaacagagctgaggtcaaaaggagccagcaggatgctctgatgaaacgcctaagtaggaacgactttgaccctgggttcctaccccaggagcccttggctcataggacaccaagtgtgggtcatcatggagtccatctgctggcctctaccactccagtgttctctccctcagaaccatgagagccctgctttgtccagccaagcacctggcccaatgagcactgtctccagtcttgctgcctgacaagagcaggtgactcggtgtgttggcggtacagctttgcctgttgccttcgcaacgttgtggcaatgttttggttttttaaacttattaggaaaccaatattgtaactgttaagtgagtctctggtaatctcccttacctatgttaagagaggacccagccttctcctgaactaagggcacccagagcatcctcagaattcctggaaaccaacctgtccacaaggtcccaagctacaggtggcatgaaagtaaaacagcttccccaggagtcacagtgacctggatgactttacccagctgccctggactccagcaccctacagtaagaacatgtcttggattttttagttcacactgaagacatgggcccttcctatccttctccagcaggcattagacacacacacacacacactttctccaggacgctgtcgttcatgatgctccactgctggtgtcctctctcagcagcctctctctaggttccatcttctcagggctgctggttctggaagcccacatgcggggttgtgctgctgctgctgctgctgctgctttctcaagagtgaagaatgaccatcaggtgccagcttaactcagctcatnnnnnnnnnnnnnnnnnnnnaaccacacatctgcggtgtgagtaaaaaaaaacaaacctccctgctacccttactgaaggcaaaggagtattctggtcccctaaaactaagtgccctgcctctccttttctcccaaattgtgaggttacactcttccctgtctaaatttaccacaacccacttggatgctggcagctctggctatggcgatgcaaggaaaggcatttctgttcagaggctcaggacaccatgcctacccctgccaggtgcctgcgcacatgtacatggactgcactgaataagaaatgtgattctgtccaggcttcctcccaagtcctaaggcctgtcctgtaacacagcttaccaggcaaatttctgtggttgaaaaaaaaaatcaagctctatttttttatctttttataataacatgatttttccctttcagagccaagcatttaatcacaacacagtacccacacattaaaacaaaacaaaaaacagcccaaacaaaggaaacctttttttgcttccaacttaaagacaggagattgtggagagcggtaccttttccttacccagatccccctgcagctgacttggcctaccatgaggcaaagaactagactggaggagacagcgggcatcctccctgctgcgcccagcctttggtttcactgtctcatctccctgcccaccaaagcctccttgcagacgtgcttcagccttctgctctgggtgccagggtctctgatcctctctgaggaggccccctacagccctaggtcactgtcccctggcccggcctgtcgccgctgcttcaccagctgcttgtccagctctcggagttgcttcaagaagccccggttgggcaggacacagcggttcttagccacttgttgaatggcgtccaccaaagtcatgttcttgtggatcatcaggtaggccaggaccagagttgctgaccgacttcggcccatggcacagtgaaccaggatcttacctgcaggtggaggagacaggaaagaaagccagtgctgaacgggatggggttcctcaacccacatttactctgtcacccacagtatgacttgggccacagctccccatcagcaaaatggggacacagtttcttggctctttctttctttttctttttcttttgtttgtttgtttttgtttttgagacagggtttctctgtatagccctggctgtcctggaactcactttgtagaccaggctggcctccaactcagaaatccgcctgcctcccgagtgctgggattaaaggcttgtgccaccacgccagctctcttggctctttcataggcgtgttgggaaggcagtttctgtacaccgcacttgtttgctgatgatcacgtgataggattggtagcaggcagacgctacaactcttgcttggtaagagaaggcattaaaacatctgtgagatggcccaactccatgcctcagagagtggcctcctggaagcgattgactgatggttttaatgtttattcagtcatgtttagcagggttcaaatgtcaaagcataccccaggagactgactgggtgacacacacacatccctcccaccgggttccttgaccctcaagagcaacaggtgtccccaacccttcatctcctcttccagagaagactctgcctagaagagtctcccatttactgtacttcatgccggcctcctaccctcccctgtcctccctctctccccctccctcccttttgcttctactgtggatagaaaccagggtctcacccctgccagacaggcactgaactacactcgcagcctttcaaaacccatttctatatcttgtttatttcattaacagtttacatttgaggtctctacacctcagaatataaatagttctcttttctttctttcttaagcatcctcccaccccatgctgggaataaaacccaagaccttacacatggatggcaaacacatcctcaagatacatccccagcaagaaattattttcaaagcatatgccttccttttatttctttttgatgctggggaaccaaatccaaggccttgtatgtgctcaatacccattatttcactgacctagacccctggcccttgaaagtatatattttgaaactactggtgtgtgtgtgtgtgtgtgtgtgtgtgtgtgtgtgtgtgtgtacatggacagagtttccctgtgtaacccaggatgttctcaaactcatctcaacatcctcctgccttagtccctcaagtgccaggattaaacaatttaaacagaatgcatcaccacaccctgctagtagaacctgtaagcaattgactcttttgacagtgttaggatacaatctgacttagtccttgtcacatacacaaagacaatggtgccttagtatgaacaatgtcacatgcatcaaatatacaaataatcattgcttacactggggagggggcaggcgattgattcccttaaaaatgatgtacaagcaaccaggtccctcaggcctccacttggtggcgctctagagcccacccaggacacccgttggccctgtctcatttcagctttgacttaaaccttgttatcattgtccctgccttgcagatggagagacaggttcaggaggtgcaatttcaatttcttgccagaggtcacccacaatactaatgccagaagtatcttaatgcaaaactgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1272 - DNA, 6909 bp, Mus musculus
ggcaaaggacaggcggaggctgaggaaggcagcggggagacccggtctgcagcaacaaagggcagcaagcgattggccgggctggaggcgaggtcttggtttcctaaagatgtctttcacttgaagagtgcagtccttcccattggtgaactaagacaactctccacgttgcctggcagtcagtcctctctttaaggatggttgtccctatgctgttgcttcacatgggctgggatcctctgcccttgtgttgaattgtgactttggaatgtgcaggttgtgttaagtacaaggcgaatctctatgggtaacgtctgtgttggagaagccatttgtcaaccatggtaaaacttgcaaacccactttacacagagtggattcttgaagcagtgcagaaaatcaagaagcagaagcagcggccctcagaagagagaatctgccatgcggtcagcacatcccatgggttggacaagaaaacagtctcggaacagctggaacttagtgttcaggatggctccgttctcaaagtcaccaacaaaggccttgcttcatataaggacccagacaatcctgggcgtttttcatcggttaaaccgggcactttccccaagccaaccaaggggtccaaaggaccgccgtgtaatgatctacgcaatgtggattggaataaacttttaaagagagcaatcgaaggccttgaggagccaaacggctcctccttgaagaacattgagaagtatctgagaagccagagtgatcttacaggcaccaccaaccatccagcctttcagcagaggttgcggctaggggccaagcgtgctgtgaacaatgggaggttactgaaggaaggaccacagtacagggtcaatagtgggagctcagatggcaaaggggcgccccagtaccccagtgcttttccatcctcactcccgcctgtcagccttctaccccatgagaaagaccagccccgtgccgatcccattccaatatgtagcttctgtttggggactaaagagtcaaatcgtgaaaagaaaccagaagaactcctgtcttgtgcagattgtggcagtagtggacacccatcctgtctgaagttttgtcctgagttaaccgcaaatgtgaaggccttgaggtggcagtgcatcgagtgcaagacgtgcagcgcatgtcgagtccagggcaaaaatgcagataacatgcttttttgtgattcctgtgatagaggattccatatggagtgctgtgacccaccactttccagaatgccaaaagggatgtggatttgccaagtctgcagaccaaagaaaaagggaagaaaactacttcatgagaaagctgcacaaataaaacggcgatatgcaaaacccattggacgaccgaaaaataaattaaagcaacgattgttgtctgtaaccagtgatgaaggatccatgagtgcattcacaggaagggggtcacctgatactgatattaaaataagcatcaaacaagaaagtgcagatgtgagtctggtgggaaacaaggagctcgtgactgaagaggatctggacgtttttaagcaggcccaggaactgtcttgggagaaaatagagtgtgaaagtggagtggaagactgtggtcggtacccctcagtaatagagttcgggaaatacgagatccaaacctggtactcctcgccttacccacaggaatatgcaagattaccaaagctttacctgtgtgaattctgtcttaaatatatgaagagtaaaaatattttgctaagacactcaaagaagtgtggatggtttcatcctccggccaatgagatttaccgaaggaaagacctttcagtattcgaggttgatgggaatatgagtaaaatttattgccaaaacctttgcttgttagccaagctcttcctggaccacaaaacattgtattatgatgttgagccattccttttttatgtccttacaaaaaatgatgaaaaaggctgtcatctggttggatacttctccaaggaaaagctctgccagcagaagtataatgtgtcctgcataatgatcatgccccagcaccaaaggcaaggatttggacgctttctcattgatttcagctatttgctttctcgaagagaaggccaagcagggtctcccgaaaagccgctctctgacctgggccggctctcctacctggcctactggaaaagtgtcatcttggaatacctctaccgccaccacgagaggcacatcagcatcaaggccattagcagagccacaggcatgtgcccacatgacatcgccaccactctgcagcacctccacatgattgacaggagggatggcaggtttgtcatcattagaagggaaaagttgatattgggccacatggaaaagctgaagaactgttcccgacccaatgaacttgatccggagagtctaagatggaccccaatgttaatttctaatgctgtggtttctgaggaagagcgagaagctgagaaggaggctgaacgactaatggaacaagccagctgctgggagaaggaggagcaagagatcctgtcgtccagagttagcagtaggcaatcgtctgcaaaagtacaatcaaagaataagtacctgcactccccagagaggcggccagtggccggggagcgaggacagttgttagagctgtccaaagagagcagtgaggaagaggaggaggaggaggaggaagatgatgaggaagaggaggaggaggaagaggaggagagcattcagacatctccccctcggttgactaagccacagtcagtttccattaaaagaaagaggccttttgtagtaaagaagaaaaggggtcgtaaacgcaggaggatcaacagcagtgtcaccaccgagaccatttccgagacgacagaagtgctcaatgagcccttcgacaactcggatgaggagaggccaatgccgcagctggagcctacctgtgagatcccagtggaggagggcggcaggaagccagttctgaggaaagcattcccacatcagccagggaagaaaaggcagacagaggaagaggaaggggaagacaatcatttcttcaagaccgctgccctttgtagaaaagatgtagatgatgatgcacaacacttgaaagaaggcagcaaagacaatcctgagcctctaaagtgcagacaagtgtggccaaaaggagcgaagcgagggctctccaagtggaagcaaagcaaggagaggaagacgggcttcaagctgaacctgtacaccccaccagagacacccatggagccagaggaccaggtgacgatcgaagagcagaaggagctttcagaggacaagggcagccccgtggggatggaacgggaggtgacagagaccgtggatgccttgctgcctcaggaggggagcagaagggaagagacaggcatacccgtgagtccacataaatcaccaggtggaaaggtagatgaggaggacctcatcagaggtgaggaggagggagaggaagagggagaggaggagggagaacgagaagaacaggaagaggaagaagaagtaactacagaaaaagacctagatggtgctaaaagtaaagagaacccggagcctgagatctccatggaaaaggaagaccctgtgcatctgggtgaccatgaagaggacgaggatgaggaggaagagccatctcacaatgaggaccatgatgcagatgatgaagatgatggccacatggaggctgccaacatggagaggggagacctcccaagagaaaccttcaaagacgcactagagggccaggaggcttttttagacctgagcattcagccgagtcactcgaaccctgaagtcttgatgaactgcggtgttgatctcacaatgtcctgtaacagtgagccaaaggagcttgctggggacactggaactgcacctgagtctgacgcggagcccccggaagaacagacacagaagcaggaccaaaagaacagcgatggtgtggatgctgagctcgaagagggaggcccagccgctgtggaaattgactccgagaccgcccaggctgttcagtctttgacccaagaaaacagggagcacgatgacacctttccagattgtgctgagactcaagaggcctgtagaagcctgcagaactatacacacacagaccaaagtcctcaaattgccaccacgctggacgagtgccaacagtcagaccacagtagcccagtttcatctgtccattcccatcctggccagtcagttcgttctgtcaatagccccagtatccctgccctagagaatagctatgcccaaatcagccccgatcagactgccatcacagtgccacctctgcagaacatggagaccagtccaatgatggacgtcccgtcagtgtcagatcactcacagcaggtcgttgacagcggattcagtgacctgggcagtattgagagcacaacagagaactatgagaacccaagcagctatgactcaaccatgggaggcagtatctgtggaaacggctcttcccagaacagctgctcctacagcagtctcacctctagcaatctgacacagaacagctgtgctgtcacccagcagatgtccaacatcagtgggagctgcagcatgctgcagcagaccagcatcagctcccctccaacctgcagcgtcaagtctccccaaggctgtgtggtggagaggcctcccagtagcagccagcagctggctcagtgcagcatggccgccaatttcaccccacccatgcagctggctgacatccccgagaccagcaatgccaacattggcttatatgagcgaatgggtcaaagtgattttggggctgggcactacccacagccatctgccaccttcagccttgccaaactgcagcagttaactaatacacttattgatcattcattgccttacagccattccgctgctgtgacctcctatgcaaacagtgcctctttgtccacaccattaagtaacacagggcttgttcagctttcgcagtctccacactctgtccctggagggccccaagcacaagctaccatgaccccaccccctaacctgactcctcctcccatgaatctgccaccacctctcctgcagcggaacatggctgcatcaaatattggcatctcccacagccaaagactgcaaactcagattgccagcaagggccacgtctccatgagaaccaaggcggcatctctgtcaccagctgccgccacccatcagtcacaaatctatgggcgttcccagactgtagccatgcagggtcctgcacggactttaacgatgcaaagaggcatgaacatgagtgtgaacttgatgccagcgccagcctacaatgtcaactcggtgaacatgaacatgaacactctgaatgccatgaatgggtatagcatgtcccagccgatgatgaacagtggttaccacagcaaccacggctatatgaatcaaaccccccagtaccctatgcagatgcagatgggcatgatgggaagccagccatacgcccagcagccaatgcagaccccaccccacgctaacatgatgtacacggcccccggacaccacggctacatgaacacaggcatgtccaaacagtctctcaatgggtcctacatgagaaggtagacagcctggcagcccacccagcccactgggccccactattggattgatctgcacaaatacctttgaagagtacgatttcaaaaccagcattggtgtgaatgcaaaaacatttgttggcaccatttatttaaaaaaaaaaaagctgtatgcagcagaaagaaagccttatacaagttgtttttcttttttcctttttttcttttttggtacctttatttctgttacttttatataaaattctctgcaaaggaaggcctctcttaggactctagttggcagcggccacacgtcgtgcctgcttccattaacagtgtggatacaagcccctccccaaatcacctgttttaatactgaacctccagcttttctccttcctgtctactccatggaaatgcctttagcatttcaattactgtatattttgtttaaggtgacccttcagcatgccgctaatgtctttgttagtgacagtgcattttgtagtactgtacaagtgttgtgctaacggtaagccatttcttaagttttttgccttgattagggtaccctaatttgagggttaaaaaaaacaaaacaaaacaaagctctatttttgttaattataaaactgtaaagagctacagagctatccccgtctggttagtgaagggggtttatcgctaaatgtttggtgtaaagttgagaagacctttttccattttggtggcaggctcctttggggggaggcagctttctgttttataaatgcacacttctgtttattgaatgaagcatatctcagtgtttatctgtcaggttttgaagcatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcagaaaagttatttgtgtctgtttctattgcgtccttttttagcctttgtacctggacaggtgacagtaagggccaagcaggagaggcgggcgcggccttgtataaaataggagccagcgggactcttgtatctacctgttctctttttagtcagttacttcaaaaaaaagaaaaagcaaaaacaaaaaaacaaaagctgtacattttaacataaaataaattatgatgagccatttctaaaaaaaaaaaaaaaaaa

SEQ ID NO: 1273 - DNA, 5292 bp, Mus musculus
atggtaaaacttgcaaacccactttacacagagtggattcttgaagcagtgcagaaaatcaagaagcagaagcagcggccctcagaagagagaatctgccatgcggtcagcacatcccatgggttggacaagaaaacagtctcggaacagctggaacttagtgttcaggatggctccgttctcaaagtcaccaacaaaggccttgcttcatataaggacccagacaatcctgggcgtttttcatcggttaaaccgggcactttccccaagccaaccaaggggtccaaaggaccgccgtgtaatgatctacgcaatgtggattggaataaacttttaaagagagcaatcgaaggccttgaggagccaaacggctcctccttgaagaacattgagaagtatctgagaagccagagtgatcttacaggcaccaccaaccatccagcctttcagcagaggttgcggctaggggccaagcgtgctgtgaacaatgggaggttactgaaggaaggaccacagtacagggtcaatagtgggagctcagatggcaaaggggcgccccagtaccccagtgcttttccatcctcactcccgcctgtcagccttctaccccatgagaaagaccagccccgtgccgatcccattccaatatgtagcttctgtttggggactaaagagtcaaatcgtgaaaagaaaccagaagaactcctgtcttgtgcagattgtggcagtagtggacacccatcctgtctgaagttttgtcctgagttaaccgcaaatgtgaaggccttgaggtggcagtgcatcgagtgcaagacgtgcagcgcatgtcgagtccagggcaaaaatgcagataacatgcttttttgtgattcctgtgatagaggattccatatggagtgctgtgacccaccactttccagaatgccaaaagggatgtggatttgccaagtctgcagaccaaagaaaaagggaagaaaactacttcatgagaaagctgcacaaataaaacggcgatatgcaaaacccattggacgaccgaaaaataaattaaagcaacgattgttgtctgtaaccagtgatgaaggatccatgagtgcattcacaggaagggggtcacctgatactgatattaaaataagcatcaaacaagaaagtgcagatgtgagtctggtgggaaacaaggagctcgtgactgaagaggatctggacgtttttaagcaggcccaggaactgtcttgggagaaaatagagtgtgaaagtggagtggaagactgtggtcggtacccctcagtaatagagttcgggaaatacgagatccaaacctggtactcctcgccttacccacaggaatatgcaagattaccaaagctttacctgtgtgaattctgtcttaaatatatgaagagtaaaaatattttgctaagacactcaaagaagtgtggatggtttcatcctccggccaatgagatttaccgaaggaaagacctttcagtattcgaggttgatgggaatatgagtaaaatttattgccaaaacctttgcttgttagccaagctcttcctggaccacaaaacattgtattatgatgttgagccattccttttttatgtccttacaaaaaatgatgaaaaaggctgtcatctggttggatacttctccaaggaaaagctctgccagcagaagtataatgtgtcctgcataatgatcatgccccagcaccaaaggcaaggatttggacgctttctcattgatttcagctatttgctttctcgaagagaaggccaagcagggtctcccgaaaagccgctctctgacctgggccggctctcctacctggcctactggaaaagtgtcatcttggaatacctctaccgccaccacgagaggcacatcagcatcaaggccattagcagagccacaggcatgtgcccacatgacatcgccaccactctgcagcacctccacatgattgacaggagggatggcaggtttgtcatcattagaagggaaaagttgatattgggccacatggaaaagctgaagaactgttcccgacccaatgaacttgatccggagagtctaagatggaccccaatgttaatttctaatgctgtggtttctgaggaagagcgagaagctgagaaggaggctgaacgactaatggaacaagccagctgctgggagaaggaggagcaagagatcctgtcgtccagagttagcagtaggcaatcgtctgcaaaagtacaatcaaagaataagtacctgcactccccagagaggcggccagtggccggggagcgaggacagttgttagagctgtccaaagagagcagtgaggaagaggaggaggaggaggaggaagatgatgaggaagaggaggaggaggaagaggaggagagcattcagacatctccccctcggttgactaagccacagtcagtttccattaaaagaaagaggccttttgtagtaaagaagaaaaggggtcgtaaacgcaggaggatcaacagcagtgtcaccaccgagaccatttccgagacgacagaagtgctcaatgagcccttcgacaactcggatgaggagaggccaatgccgcagctggagcctacctgtgagatcccagtggaggagggcggcaggaagccagttctgaggaaagcattcccacatcagccagggaagaaaaggcagacagaggaagaggaaggggaagacaatcatttcttcaagaccgctgccctttgtagaaaagatgtagatgatgatgcacaacacttgaaagaaggcagcaaagacaatcctgagcctctaaagtgcagacaagtgtggccaaaaggagcgaagcgagggctctccaagtggaagcaaagcaaggagaggaagacgggcttcaagctgaacctgtacaccccaccagagacacccatggagccagaggaccaggtgacgatcgaagagcagaaggagctttcagaggacaagggcagccccgtggggatggaacgggaggtgacagagaccgtggatgccttgctgcctcaggaggggagcagaagggaagagacaggcatacccgtgagtccacataaatcaccaggtggaaaggtagatgaggaggacctcatcagaggtgaggaggagggagaggaagagggagaggaggagggagaacgagaagaacaggaagaggaagaagaagtaactacagaaaaagacctagatggtgctaaaagtaaagagaacccggagcctgagatctccatggaaaaggaagaccctgtgcatctgggtgaccatgaagaggacgaggatgaggaggaagagccatctcacaatgaggaccatgatgcagatgatgaagatgatggccacatggaggctgccaacatggagaggggagacctcccaagagaaaccttcaaagacgcactagagggccaggaggcttttttagacctgagcattcagccgagtcactcgaaccctgaagtcttgatgaactgcggtgttgatctcacaatgtcctgtaacagtgagccaaaggagcttgctggggacactggaactgcacctgagtctgacgcggagcccccggaagaacagacacagaagcaggaccaaaagaacagcgatggtgtggatgctgagctcgaagagggaggcccagccgctgtggaaattgactccgagaccgcccaggctgttcagtctttgacccaagaaaacagggagcacgatgacacctttccagattgtgctgagactcaagaggcctgtagaagcctgcagaactatacacacacagaccaaagtcctcaaattgccaccacgctggacgagtgccaacagtcagaccacagtagcccagtttcatctgtccattcccatcctggccagtcagttcgttctgtcaatagccccagtatccctgccctagagaatagctatgcccaaatcagccccgatcagactgccatcacagtgccacctctgcagaacatggagaccagtccaatgatggacgtcccgtcagtgtcagatcactcacagcaggtcgttgacagcggattcagtgacctgggcagtattgagagcacaacagagaactatgagaacccaagcagctatgactcaaccatgggaggcagtatctgtggaaacggctcttcccagaacagctgctcctacagcagtctcacctctagcaatctgacacagaacagctgtgctgtcacccagcagatgtccaacatcagtgggagctgcagcatgctgcagcagaccagcatcagctcccctccaacctgcagcgtcaagtctccccaaggctgtgtggtggagaggcctcccagtagcagccagcagctggctcagtgcagcatggccgccaatttcaccccacccatgcagctggctgacatccccgagaccagcaatgccaacattggcttatatgagcgaatgggtcaaagtgattttggggctgggcactacccacagccatctgccaccttcagccttgccaaactgcagcagttaactaatacacttattgatcattcattgccttacagccattccgctgctgtgacctcctatgcaaacagtgcctctttgtccacaccattaagtaacacagggcttgttcagctttcgcagtctccacactctgtccctggagggccccaagcacaagctaccatgaccccaccccctaacctgactcctcctcccatgaatctgccaccacctctcctgcagcggaacatggctgcatcaaatattggcatctcccacagccaaagactgcaaactcagattgccagcaagggccacgtctccatgagaaccaaggcggcatctctgtcaccagctgccgccacccatcagtcacaaatctatgggcgttcccagactgtagccatgcagggtcctgcacggactttaacgatgcaaagaggcatgaacatgagtgtgaacttgatgccagcgccagcctacaatgtcaactcggtgaacatgaacatgaacactctgaatgccatgaatgggtatagcatgtcccagccgatgatgaacagtggttaccacagcaaccacggctatatgaatcaaaccccccagtaccctatgcagatgcagatgggcatgatgggaagccagccatacgcccagcagccaatgcagaccccaccccacgctaacatgatgtacacggcccccggacaccacggctacatgaacacaggcatgtccaaacagtctctcaatgggtcctacatgagaaggtag

SEQ ID NO: 1274 - DNA, 96594 bp, Homo sapiens
  misc_feature (659)..(1103): "n" at positions 659 thru 1103  can be any base
  misc_feature (13097)..(13318): "n" at positions 13097 thru 13318  can be any base
  misc_feature (25404)..(26575): "n" at positions 25404 thru 26575  can be any base
  misc_feature (66626)..(66645): "n" at positions 66626 thru 66645  can be any base
atgaaactctcaaaagggaacctgaatttttcagggtatctggatatctggtctgaagacatctgtaatacagttaacaaagaatcctgtaataatctctctttcaaaagaatcataaaaaagttaagatgtcagatttttctcagccaggtgcagtggctcatgcctgtaatcccactactttgggaggctacagtgaaaggatcccttgagccctggagttcaagacatgcctgggcaacatagggagacccccgcctctatttttatttatttatttagattttttggtatcttcattttatcttatttattttgttgagatagagttttgctcttgttgcccaggctggagtgcagcgacggtgctcttgtgtaacgcctgttgagctacagacaggaaaaggcccatcatggtttctgtgtacgcctatgctgtttctaatagaaaggacaaaatagagcccaaacatctgttgaccagttaagtttgttaatgaaaccaaattgcagctggtttatcacagatcaaaagtgaggcaaattatagaaaggatgtatgaacaaagctggtttctaaaaaatagtggctaaagaattctaaacccacttgtcaaattaacaaaaatccttcctggattttgcttaaaccactgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgacatgaaaaattaaacttgcaattaatataatatgtattagttgaaatgataatttttatggtgatttagcctcttagaaatccttggaaaacattattagcttatgaattgaaaactctctttgttaatgagtagtgggaaagaacttagtgttactctaaaaagatggggaattaaatattcagttcaaccagcgttttattgagtgcctgctctgggcttgctgctgagttaggctcataaatataagttgaacaagattgatgtttgcagagatgaaatactggttgcttttgttttttctttcaatcacccttccctccagagtagatggctactattgccagagtgattcaaacattcaacaggtttgtgtgtgtatgtgcatgcccttccctgtgcattatggtgtcacctgctcctgcagtggcttcctattcatctgtcacgttcacacaccacagcttggcttttttcacagccaactttatttctgttttttttttttttgagatggattctggctctgttgccaggctggagtgcagtggcgcgatctcggctcactgcatccaccacctccggggttcaagcaattcccctgcctcagccttccgagtagctgggaccacaggcatgcaccaccacgcctggctaattttttgtattttagtagagatggagtttcaccatgttggccaggatggtctcaatctcctgacctcgtgatctgcccgccttggcctcccaaagtgctaggattacaggtgtgagccactgtgcctggcctatttctgtttttcatttttaaattatatttgtcttttttagagacagagtcttgctctattgcctaggctggagagcagtggcacaatcatagcccactgtggcctcaacctcctgggcggctcaagagatcctcttgcctcggtctcccgagtagctgggtctacaggtgtacaccaccacagccacctaattttttatttttgtagaggtagggtcttgttgtgttgcctaggcttgtctcgagctcctggcctcaagtaatcctccttccttgacctcccaaagtgctgggattagaggcatgagccattgtgcctggcccaacttaatttctttatcccttttgagcatatacctgttctagtcaggcacatggacttggtgtcccttttgtttgacagctcattcttagcttctgttatttcactttgatttccttcattcattccccgatacatttatttagcaaataggcattgaaaccctcttatgatcaagttgtggtcttgggaaatcttagggtatacaaagatgaatcaagcatgaatcctgtttttaagaattttatagtctagtaggggtgacaaggttaatacacaagtaagcataatactaagtgggaaatgaatgtcaaaacagtaaaaaagctaaaagcttcctgttagacaaagatgtttggggcttttgagaagttgtttgcactgggccatgaaggatttgaatttgggcagagggacggtggggcacttatccaggctcagcattatctttcaaggttcagtttcagtcccatccatccaagagatgttcatccatcctccacgtggtttcagcaaggtagtatagtcacagttgtttccagacttcttccttctgtaatcagaggaacacttcctttaaagcgaatcttatggggaagacaaatatatgtaaaacagttaaagtggagctgcactgttgggttcaaggtgctgcaatggcccaaagtttaacccacaaggggtacctgaaggtaatacccgaagtaactccttgtcacagagatctaaagagcctagtttgaaaacctctggagagacagaaagagtttgggctttggcatctgaattaaaatccttcatgacttaatggctctgagatcttggctaagtcaagcctgttttccttttgtaaaaacaacaatgctaccttacagagttgttttaaagtttactgataatctatgtaaagtacctggaccacagtaggtgtcaggaaatggttggtattattattattattatagtttagtgctttgttatttctttttttttaaacaatttattgaggtgaaactcacataacataaaatgaaaaaaccattaaaaagtgaacaaatcagtggcatttagtacattcagtgttgtgtcaccactgccactatcaagttccaaaacatttttattgatcccaaataaaaccccttacccattaagcagtttctctagatatgtccctgagactccaccaatctgtgttttgtctatggatttatctattctggatgtctcatatgaatgaaattatatgatgtgtggccttttgtgtctggcttctttcacagcataacgtgtttgaggtccatctacattgtagtagcatgtatcgaaacttcattgctttttatagttgtatagtattctagtgtatggatataccacagtttatctgttcatctgttgatggacatttgggctgtttacaccttttggctactgtgaatagttttgttatgaacatgggtgtacgtgtacttatttgagtatctgttctcaattcttttgagtctatacctagaaatggaattacagaaccatatggtaattctgtgtttaactttttgaggaaccgccaaacagtgctttgctatttcttaattgcttcttatatgttctgtctctagctttgctttgtattccccatagtacctaccacagggctgcatgcagggagcatcagctcgctaaatatttgttggtttttctttgattagtatttataacctcacctcccagttcacatgttttgggcctgaagcattgatttcagaggaaatagatgcatccaggatttgaaagataagaaatatcaccatatggatggcgtttcatgttgtcagacaacagatatttgttaaccaaggacactattttgagcaactctgccaataacctgagctgggtgctgatagaagaaaaataagtcaaggtcccttcccctaaacagttctgttctgtttcggaagatactgcttagatttgtggatgctcactcagttacacaatgggctttgaaaaaatccaggttttccaacagtgatccctttggggaaaaaaaagaaagaaaaagccaggacttatgaaagtaaaatagttaaaaataactgttagcaagtaaaactcaggatgacaaaagtgtaaactctattattaatctttgtttttttctaccactgttttttgcctcatccataatctcatgacttgagtgttatgacattgattttgaaacaacacacacagctttagtaaaagcttagaggaggcctcgcataatacttatgatccaggatattttgactcttcttatgctgacatgaatatttctgaatagtgttgatgtttatgtaataccagtgaagctaaaagctcagtgctggactaagcatttctctagatatgtttagaatatttgtaatgaatgatgtaaatagtgttatattataagaccgtatgatacaaccatataatttactgatattttgtagttaaaaataaaatgattcacaaccttagaaaatagaataatttaatttgatgtagcacaaatccccagaattaatttaggatgatttgctacctttttgatagccttttagtccaaccttcaagtttttatagaaaaaaaatgaaaagagaataatgattttagggttttcgcttgtgatagaatgtcctatctacatgtgaagcaaatccccatgctctgaaaaagagaaatagtgtggataattccaaatcaggaaaaaaaaaatcatttctatttggcttttgaatgaattatgcatttttttttcctgtggatttgtctttccagttagatactgcttaggctaaaatgaaattggttttcaatctattctcttgcttatatgaatttacagtggggccagtgggatgttggaaacaaatcagcctaagattaaaaaatttgcggtggataatatacaaagtggataatatacatgtgtttagttgagaattggctacagataagagacttctgattttgttcctctcctagctgtgtattttttttttttttttgaacactgtgattctgcttgtagcaaagagctgctgagttacatctgcttctgcctaattaactctgttggttggtgtcagatgagagctaattttgagattaaatcgaggagtggggtgtgtgtcgtggctgggggaggggagaaggaggatccaaggttgcttgattgttttacgtaagatcaaaatgcagttattcacaattgttcttttaaatttattttttgcttttcaagtaaaaataatcactgctgtcctaaaatgtgacttgtgtcaatacatatttactattatgtaaactggtacgtttttcttgtaggtgagcttattggtcatatctgggtagtccattcagtacctaggtgcctggtggcctttgggacaaacagcgaatgctgcccaggaatgtgaatgctgaccttaaaacaacttttgactgtctttttttctgataaatgttatatctgtttggctatttgagtagtagtgggtttttgtttttgttttgtttttccatgatgagattttttcttaggaatctatcacaaacctgatttttaaaatttgaacaggtctgggcttagggatgaaatttacttctataggcacttggctgggtccttggggcttcattttctgtctcaagtttcatatttataagaatccttcagtggtctaaaagaattattatatcaccaaatgtagtataataactcattggagctgtttgtcttgaatggttgtggagatacacggatggttgctgaatttaaggatgtccttatgtccaaatgaacatttccttttttcttttggcagatttgcctgaagacctggataatctccatttttgtcatggactgttaaaacgtttgaagttccaattctggtactttcccttattttattacatttttaaggtataaaatgacaatcttattgaaatgtgttggtaatggatataaacaattgttttatggatataaatgattgtgggtaaagatttgtgggctgggtgcagtggctcacgcctgtaatcccagcactttgggaggccgaagtgggcggatcacgagatcaggagtttgagtccagcctggccaacatggcaaaaccctgtctctactaaaaattcaaaaattagctgggcgtggtggtgggcacctgtaatcccagctacttgggaggctgaggcaggagaattgcttgaatctgggcggtggagattgcagtgagccgagatcatgccattgcactccagcctgggcgacaagagcaagactctgtgcccccccaaaaaaaaaaaatgattgtggtaaaagcttgtcatgaaggtatattttaggtatctattagttatgaaacacattttttttttttttttgagatggagtttcgctcttgttgccgaggctggagtacaatggcgcaatctcgactcactgcaacctctgcctcctgggttcaagcgattctcctgccttagcctcctgagtagctgggattacaggcgcatgccaccatgcttggctaattttttgtatttttagtagagacggggtttcaccatgttggccaggctggtcttgaactcctgaccttgggtgatccacccgccttggcctcccaaagtgctgggattacgggtgtgagccaccacgcccggctatgcattttgttttaatgtacgttcgtttgcttgtgtaacaaaacacctaaaagcaacttggcaatattgggcacttttcctgtgacctcttctactttctgcagttgtattttgtgcaatcaaattaaattagttgtgattcatcctgaataaatgatgaaagattaaataattacttggatacagtgaaatatcttctaatgaaattttgcccgaaaccattttacttgggaaagatcaatttcctgttctaaactaactgacagagaatgattctgtgttctatcctgaaagtggttgcactgtgaaagccagtgatttcattcctaaacacactgtgttccaagtctaacatttttgtcaagggtttatataatgaaacaaaagtgagtacttattagatttgtagatgacatagatgacagaatcaagattcaaaacaatctttagcaggttggaagataggcttaaatcaacgagatgaaattgaacggtaataaacgttaaattgcagcatttcaatttgcagaaggaaaggggtggaaagactcaacttgacagcactttttgaaaaaagatctgggatttttagttggactgcatgctcaccatgaccacttgtgtggcaggggtattgaggaagttcctgtaatttgggttgcatttataattggataatgcctgaactgtcatattttaagatggccaatagccaaactagtgagcaaccaagagaaagtggtgctttgaaacaatgtgatatgtggaagggttaagaaactgggatatgagtggtctaagttatggctggaggtagcatggggttttgtcgttagtggttttcaaaaggtacttgtttttggacatttgaaggcctctcatactgaagaaatactaagaattgtcttgggatccttccagggaataggactagttaggaataggaatagggtcgaagttatggggtggcagatttttgcttctctgagcaagaaatttagctagagctgtgcaacagtggggtgagctgcctcaaaaagtgacaaattatcaatcactggaagtattttaaaaatgtaaagactcattgcccatctatttgggatattgggcagggatcttttattggataactagaggttggactggatgaccttcagccccaagtttctgaatctgaggggagaatgagtagagtgaatttacagcttactgatcacagggacaatcttgtttaaattgcctcctttaaggtggcattttgggttggcatttaaaactgtactgtttgaacaagtatagttcaatgacccagctgtttttcagcaacattccaggatctctgagagcaaatactatattcttcagtatgtctggctaaagtttttaaggaaagatattattttcttctcttaggtatagtctgtctaaataaataaccagagataactttaattttgtattttgttataaaaatttcaaagtatatagatgttgcatttgatgaaagtgataactatatattgaatattagataatgtgtttatttaatcctctcagtagtcctgtaagggatataccagtattgcctacaagtaaagtgatggaagcttaagttatccagggttcctccactggacattgtggtagggctggggttcagacccaggttggtctctttgcagaggcagaactagctagagcaggcagttgtggctcaggtgagaacagtgatggacttagttggattttagaattggctgggcacagtggcttacacctataatcctagcacttttgagaggccgaggtgggctgaggtcaggagtttgagaccagcctggccaaaatggcaaaactccatctctactaaaaatacaaacattagctgggtgtggtggcacattcctgtaatcccagccacttgggaggctgtgcaggagaatcgcttgaacccagaaggcagagattacagtgagctgagattgcgctattgcactccagcctgggtgacagagcgagactctatctcaaaaaaaaaaaattaataaaaaaaattaatgatgttcgaccctttaatctgttattgactcttcccttgggtgaattccatcttctcccgagcctcagtttacccacaaagttctgcagtttaagtgacaagttatatgtgagcacactctgtacagtttaaactataaaaagaattaagaagtggatgttatcattggacaccaagattagagctcaggtttggcccaattcccaggccaaggctctttctccttgtagcctctttgtagatgtactcaataccagattggagatctagggtggtttttgtatataccaagcatctctcagaacaaatgccactgtccacctggaatcagatttgtatatatcttctttgtactgagctgtttaatgagctaactgggtattaagataactagaatgctctactacttaaaggtgaagggttatgttactgtattattttcagttttccaatttgtgggttagagggtatcatagacctctgttaaagggatggggatgtgattccatagaagtagctagatgggaagtttttttacgtatgagacttgggaaatacaatacctagctgaaagctggattatttactcttttttttaagtttaagattttttgaaataagtttaatgtactttcatcagattttttatatcatagacttattctttgatgtgtattttatgtttatggcagacatatacctcaaaccactttcatataattttgttaatttcaataaatataattaaatgtataatttagatgtgattatgcctcataaatgacttcatatagagaagtgaaacattctaaaaacaatttcttctcagactgtgacccaatttcttgttgaaaaatatagtcactgtggctgtgttatgtaatacctgcctgtcattacttcttgtggtcattctgtgtctgaaaaagtcatgctaaagaatcttttagtttatttgtgtaagcttcattattaagagactttcccctctttttatcctttaaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattctcctgcctcagcctcccaagtagctgggattacaggcacctgctaccacacctggctaatttttgtatttttaatagagacaggacttcaccatcttggccaggctggtctcaagctcctgacctcaagtgatgcgcccgcctcggcctcccaaagcgctgggattagaggcgtgagccaccatgcccagctagacttcttattttaatggtgataatctatgcttttttttttgagatggagttttgctcttgttgcccaggctggagtgcagtggcacaatctcggctcactgcaacctctgcctcccgggttcaagtgattcttctgcctcagcctacctagtagctgggattacaggcacatgccaccatgcccagctaatttttgtatttttagtagagaccaggtttcaccatgttggccgggctagtctcgaactcctgacttcaggtgatccacccgctttggtctcccaaagtgttgggattacaggcgtgagacaccatgcctggctgataatctatgcatgtaagaagttattttaatacgtcacctaaatccctcatttcaataaaaagtcattttttattgtccacttctctgtgttgtaggtgaatgtttattttgtctcatacagtatctttttaaaatactctgatttcttgggccttatgttatttctatagtatttataaatatatggcagaattctccttacattactgctaccactttaagtttttggttgagtaagatttgtctttgtttcaaagctacagtatttacttcccaaactaaacacaaagtagagcagcagaaagttatttatagttcatgtctagttttggggtttattctctgtcttttgggtgagcagatatattgatatcagttaattttattaatacatgttataaaacattaatcattgttgatagaaaggtggttttggctgggcagggtggctcctgcctgtagtcccagcaccttgggaggccagggtgggaggatcacttgagcccaggagttcaagactagcctgggcaacatagtaagacccctgtctctacaaaaaaatcaaagaattagccaggcttggtgaagcacatgtgtagtcccagctacttgggaggctgaggtgggaggatcacttgagcatgggaggtagaggctgcagtgagccttgattgtactccagcctgggtgatagagtgagatcctgtcccaaagataaagaaaggaagaaagaaaaggtggttttggccaggcacagtggctcatgcctgtaatcccagcactttgggaggctgaggtgggccaattgcctgagtttgagaccagcctggccaacatggtgaaaccccatctctactaaatatacaaaaaaattaggcaggcgtggtggggggcacctgtagtcccagctatttgggaggctgaggcaggagaatcccttaaacccgggaggcagacgttgcagtgagctgagattgtgccactgcactccagcctgggtgacagagcgagactctgtctcaaaaaaaaaaaaaaaaaacaaaaaaaaaaagaaggaaagaaatggtggttttattcatggtttactgcagccttgaccttttgggatcaagtgttcctcccaagtaactgggaatacaggtgtatgccaccatgcccagctaagtttttaaattttttgtagagatggggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgagccactgtgcctggccaacatttatttgttaactatatttttattttgttagtcttctgccacatttatttgatccttaggtggttgttgtgtttgtgtaaccaacctctagttctctgtggcagaatgtgggcataaagaaagaagtaaagttatgaaattttcttcttaataacatttgtttaaaagaaaatacaaaaagccacttaaatcctaattcatatgtctgacacagccaaatcagggacctctgtttttaattaaatacatatgtatatatatatttttgttttgtttttttgttttttttgagatggagtcttgctctgtcaccaggctggagtacagtggcatgatcttggctcactgcagcctctgcctcccaggttcaagtgatttccttgccttaacttcccgagtagctgggactacaggagcgtgccaccatgcctggccaattttttgtattttagtagagacggggtttcaccatgttggccaggatggcctcaatctcctgacctcatggtccacctgccttagcctcccaaaatgctgggattacaggcgtgagccactgtgcccagccttaattaaatattttttataaaagcttatactgtgaagaaattccttaagggactatagagccatttcttgatggatttggatatctttgtttttaaaaatatgtacactaccctaaggtatgttaaggttttataatgaacaggtacgtggactaattcaggtagctttaggcaatttaatagtatgtttcaataattttgtgatccaggggatactttttacttgtgatggaagagtcagtacaaattttccacagtatcttctgatccttcgctttaaccttgcccgtcatttcttgccaaccttatcatatttttttcaggcagcatctgtacagaagtatttttagtctaaaggaaaattcatgtctgaaagtgtctaggattgagagcagagtaatttattgcttagcaggcaattgttactgctctttttatgatgctgatctttaaattgtttagttagcatcatgctataatgaggaaagctgagaaatgttttctagaatttttacttgatgaaatttggagactaattctattaagtaatcatttgattcttaaaaaacaaaaataaataaaaatcagtttaaacaaagttggcaacatgtttgtattctttaatgaaatagcatttttttccagctgggtgcagtggctcatgcctgtaatcccagcactttgggaggccgaggtgggtggatcacctgaggtcagcagttcaagaccagcctgaccaacatggagaaacctcgtctctattaaaaaaatacaaaagtagccgggcatggtggtgcatgcctgtaatcccagctgctggggaggctgaggcaggagaattgcttgaacttgggaggcagagattgcagtgagccgagattgcgccattgcattccagcctgggcaacaaaagcgaaactccatctcaaaaaaaaaaataaataaataaaatagcatttttccttaaaaaatgtgagaaaattacaacataatatattaccctttgaaattaaaagtgatttaatagtttaaaaccatgtaaactcgctaagtaaatttaatagaaattcttagcccgggatccacaaatgaacttgggtgggtatcccacaaatcctctgaaatagagtgtgaagtcatgtgtgtgtatccatgtttttctttttttttctttttctttttctttttttttttttttgagacatagtttcactcttgtcacccaggctggagtacaatggcacaatcatggcccactgcaacctctgtctcccaggttcaagtgactcttctgcctcagcctccctagtagctgggattacaggcgtgcgccaccatgcctggctaatttttgcattttcagtagagacggggtttcaccatgttggccaggctggtcttgaactcctgacctcaggtgatccacccacctcagcctcccaaagtgctgggattataggcatgagcctctgtgcctggcctccacatgtttttctatggctagggtctatagcaagcttgtccaacccatggcccatgggctagatgcggccctgaatggctttgaatgcagcccaacacaaattcgtaaactttcttaaaacataaagagatttttggcttgcggcgtggtggcacacgcctataatcccagctactcaggaggctgaggcacaagaattgtttgaacctgggaggcggaggttgcagttagctgagattgaggcactgcactccagcctgggcgacagagcaacacttcgtttcaacaacaacaacaagaacaacaacaacaacaacaacatttttttgtggtttttaatttttttttttttaagctcactagctattgttagtgtattttatatgtggccctagacaattcttcttccagtgtggcccagggaagccaaaagattggacactcctggtctacatcttttgtcaaaggcacccaaaatgcctagtagccattttaaaatagtttgagtttcttatactaaatcatagtatgctaattgtcgacctatgatgattcttcctttggctgctgaacttggattcatatgtagattgattgtactataatttcctatatataagactttttctaatatatttgaaaagattatcattgttcttgatgtgcttgaagtcataggatttgccttgcattgtgggaggaaatttatgatataagtgaaaacagttcagaaatggagtgatctcaattacaatctagtcaactaatgccttttttttgagacagagtgtcactgtgtcacccagtctggagtgcagtggcatgatcttggctccctgcaacctcagcatcccaggttcaaacaattcttgtgcctcagcctcccgagtagctgggattacaggtgtgtgccaccacactgggctaatttttgtattttagtagagatggggtttcattaatgttggccaggctggccttgaactcctggcctcaagtgatccgcctgccttggcctcccaaaatgctgggattatagacgtgagctactatgccccatgcctggcctaactaatgacttttttttttttgagatggaatctcactctgtcatccagactggagtacgctggtgccatctcagctcactgcaacctccgcctcccagttcaagtgattctcctgcatcagcctcccaagtagctgggattacaggcacgcaccaccaagcccggctaattttagtatttttagtagagacagggtttcaccatgttgaccaggctggtctcgaactcgtgatctcaagtgatccgcctgccttggcatctcaaagtgctaggtaggattacaggcttgtgagccaccgtgcctggccatgactttcaagaagctgtttattctggttacttttttgagcagttacattaaatgtaaaacaaaataaaaatagtaagaataataactaacgttttgtaagtgttaaatgctggcactattccaagtgctttacatttattatctccttgacttgtcacaataactgcaagggaggtagattattacccttattttacagatgaaaaaatgaggctgaaagcttaagtgatttgcccaaggtcactgatagagctagtgagtggtgaagccaagattctgacgagacagtctgacctcagagctctttaccactgggcagtacactggtcaacagtggtggctttttttttttttttgagacagagtctcgctctgtcgcccaggctggagtgcagtggcatgatctcgcctcactgcaagctccgccttccgggttcacgccattctcctgcctcagcctcctgagtagctgggactacaggcgcccaccaccacgcccggctaattttttgtatttttagtagagacggggtttcaccgtgttagccaggatggtctcaatctcctgacctcgtgatccacctgcctcggcctgtggtggctttttattaacagtaaaagtatctcttccagttcttcaaatgattagaagcagttttgccccaacaaatagatttccagcattttaaatttggtagatgcaatgagcttattatagtttttaaagtagatactatttataatattagcaatatggaaaggcagtagagaaagtagtaagtctgtgtctaattagattgaacatcatcatcattccgatgcatgactgctaggaggaatacaatgcaagttaaaatagaagggctccttcctttctgaaatgtaattgcacatcttctgatagtctggaattcaaattgggtattaccacactggcttcttagcataaattctttgtatttatttaagaaagctctcttcggtgaggtgatatggaaatgaattaaaccactgaagataaaactttatctttgacttggtgagggaactcctaaaggatagtattaatgtttctcattaaaagtagtaaagctcaattaggtcagattatgaggactttggaaagtcacatattctaagagagacttccattatcactgcgcactttgtagcattaagattccatttgaacatttgagctttagcatttttataaaatcagtttagttccatttaaaataaattccatagtatttcactttagtgagaatgtcttcataaaatttattaagtgtcaagtcttggtctgtttccagtgtagtacataatgtgggaattctcattctaggttggcatcgtaattggaaggtgggacactttcagtatcaagtagggcttctgatgttttttctgttgaagaaatatttgtattagaatcttacaaaaagccttcaaacataaacaaaattacaaaaacagtgatactgtcaataagaaaaaaatcaaaatgatttttttttttttggatacagagtcttgctctgttgcccaggccggagtgcagtggcgcaatctcggctcactgcagctgccgcctctcgggttcaagcgattctcctgcctcagcctcctgagtagttggggattacaggcatgtgccaccatgcccggctaatttttgtatttttagtagagacagggtttcaccatgttggtcaggctgataagaatgattttttttttttttttttggagatggagtcttgctatgttgccaggctggagtgcagtggcgcgatctcggctcactacaacctccgcctccctggttcaagcaattctcctgcctcagcctctggagtagctagactacagacgtgcaccaccacgcccagctaatttttgtatttttagtagaaacggggtttcaccatattggccaggatggtctcaatctcttgacctagtgatccacctgcctcggcctcccaaagtgctgggattacaggcatgagccactgtgtctggccacaaaatgatttttaaaaggagttcagatgatcagaaatggggttgaaagacaaacgtaggacccttgttatgtgtggtcttggcttattcagttgtttattctatttctcctgccccttttagagagatacgttgttagggtttttggcactgttattaatatgaaatatttctacaaatagaagataaatgtacatcctacagcagttgcttgagttgtttacacacatgaattagataagtttatttttagattttcttttcttctgttttctccattctgttttctcctcttcagtccccttaaccctgccctagagcagaccctcctcatctgttctgggacttttccaatagcctgtactttatgaaggactattcattagtccatattgttctttgatgtggcaggcttccagaagtctctcagccctaggggaattgttcatagtctcaggcaactctggatcttttttggcagaaatgtgtatattttttatctgctaattatagagcctgaatgtcctcctctctgttgaccttcttagttttcctttgaattggtatcctttgtgttgcagatgtcatctttcttgaagagtgcttgattatgtgtatttaactgaaaatcgaataaatctctaaatattgtaaaatatgctcttcaaaataacctgcattttggaattggtatggataaagtcagttttagaatcactaaagtcagacagaaacctattgtaatgtgaaagacgaggtggatcaaatacttgctgttccagggtcatggaaggaaaaaaattgcagttcatgttcttcttataattaagcttcagaagttcttcacaatagcagtgtctgaggactgcttttgtgagcaggtagtaccagttgttgagacattgttgagagagcacatgaattgtctcaaactagttagttgggtcaagggaaagataaaatgaagggtgaatgagtctttctattgtactctgaggcatgacagcgtgttccacttttgagcttttatcaagatgggacttgtctagacttctaatgaaatgggcttcaggtaaagtagaaacattatgtcaagaggatttttggttgttcaaatgaatgttaaacattcttttaactctttggatcttagatagatttgatagttgtgatacctttactgtatgtaacacatgatcctgtcctgaatgatcagcagctttcaggagttactcttgtattcccagctacatttgtgatactttcagtgctaagaaaatctatattctgtagctttgaagttatttaacagttaagtactatttgctggtttattctgattttgtcttaaatgacaaatattttattcatcctttctcttcaaacattatttaacaaatgtacgttttaatgtttctcaaaaatgaaggtctatattctttttatatgttttatctttgtatgttatttctttcatctttttttttttttttttttttctgagacagggtctcactctgttacccaggctggagtgcagtggtttgatcatggctcactgcagcctcgacctcccgggctcaagtgatccttgatcctcccacctcagcctcctgagtaactgggactacaggtgtgcaccaccttgtctggctaatttttttttttcttttttttgagacagtcttactctgttgcccaggctggagtgcagccgtgtaatcatggttcactgcagccttgaccttcccaggctcaaatgatccatcctcccacctcagccccccaagtagcttggactacaggcacacaccactacacccagctaatttttgtattttttgtagagatagggtttcgccacgttgcccaggctggtcttgaacgcctgagctcaagcagttcacacacctcggcctcccaaagtactggggttataggcgtgagccaccgtgctcagccttttatttttaatatataagaaatgccttttttttttttttttttttaatttgagatggagtcttgctgtcttgcccaggctggagtgtagtggcatggtctcggctcactgcaacctccgcctcccaggttaaagcaattctcctgtcttggcctcccgagtagctgggattacaggcatgtgccaccactcctggctaatttttttgtatttttagtagagacgggggtttcaccatattggccaggctggtctcgaactcctgaccttgtgatctgcccacctcggcctcccaaagtgctgggattagaggcatgccccaccacgcccagcccattgttttatcatgacagtagcaatgtgttttaattgtaaaattcttgactttttgttttgtttataaacttccttttcttggccctgtgccttaaactacagtagattaggtgaaactgttctctgatcacactagcatttaaaatatgaacctgaatcttctcaggtactttgatctctccaatctattaatgtttctgagtacataaacatcaattagctcaccaaattaaagttagcaaatgcgtcagccatgtaatttgcatgtgacattttgagttagcagggccaagagggaagtatgtttttgtgagtgggtgtgcttatctctctgtcttcaggtggtgatggaaagttgtacatgtaagagaaggagttgtggcagtggatatgtgaaatgctaactgtacatatgcctctgcttggggcagaagcactttaccagagaagtctccaacagttgcaaactacatattctttttccttatataagtgaatcttttaattagtgtaatattatgtagagtgtatgttttttctgtttttttttaatgaaaggtgatattttgataaatctgcaaaatgagcaatatagacaacattttagagtgaatgatactagatttaaactatgaggctggtctctgcaaagatacaaagtaaatactaatcactggtctaagcaaaatccaggaaggatttttgttaatttgacaagtgggtttagaattctttagccactattttttagaaaccagctttgttcatacatcctttctctaatttgcctcacttttgatctgtgataaaccagctgcaatttggtttcattaacaaacttaactggtcaacagatgttttggctctattttgtcctttctattagaaacagcataggcgtacacagaaaccatgctgggccttttcctgtctgtagctcgacaggcgttacagaagagcaacctaactttacttacaagttcaatttttcttcctcagtatttttattataggtatacaaacattgtagttttgtctcccccatcaagtcggtcttttgttgttaatcttccatctgttagtccagtatacacttctcaccctgctttttagcattgcaaaatcttagcatgcagggaaaaaggtactattgcaggagaggtaattgagatatcagcgactcttccacaattcaagggaaggagtggaactagcctggtgaatttagataatttcttccgtcttctttgatgtcagtgagctgccatatggagagcagtgaggcctgcaggaaggaggtgagccttggtctgggctgcctagggtgttcagagtgacatgggctgagagccagaggcagagcttgactgtttctgttagtagtttctgatgtgaccagccctgctttttgtccaaggtttccctgtcatgcttgccaccctatgggtatgatgaagtttaagaaacagatcataaacattatcttgggaaagagaaacataagaacatattaaaatctagtaataaggccattaaaagatgactcccatttgatatttgaccaacttgttttcaaaattagtattgtaaacacttctgtcttataacaaaacccagctttagctgttgagccttgagttgtgagtaaagcagcagaaaacaggatctgctagtggaagagtattggctgtttgaagaacatcagctgttccaggtagactcctggcagtgtgtgagcagacctgggaaaggcaggcatggagggagctaggaaaatacttctctcctaacctttataatttataaaattagagtatttcataaatattaaaagagtagtacagtaaacactctatttctttcacatagattcaccaattttaacattttgccacattctttctcttcctatatgtgtgtatatgtatatgtttttatacatgggtgtgcgtatatatacagcacatttatatattcacaattttgactaaactgttggaaactaaattacaaatattatatttcacccctaaatacttaataatatatcaaaaatgttctcttatatactatactattacgcaaaaaattcggcagtggaatgagtgttaactgacagtccatatttccccaaatggccccaaaatctcatttataacttttgactttttttgagatggagtctcgctctgttgcccaggctggggtgcagtggtatgatcttagctcactgcaacctccacctcccaggttcaagcaattctcttgcctcagcctcccgagcagctgggactacaggtgcgtgccaccatgcccggctaactttttttatttttagtagtgatggggtttcgccaggttggccaggctggtcttgaactcctgacatcaggtgatctacccgcctaggcctcccaaagtgctgggattaaaggtgtgagccactgcgcctggccaacttttgacttttcatccaggatccaaccaaagatcatatattgcatttggctgtcatgtcacctttaatagagaacagttttccctcctttttgcttctgaagacattgacatttttgaagagtctagggtagttgtcttgtaggatgtcccacaattagtatttgtctgactgtatcctcatgattagattcagagtaaacatttttgacaagaatagcgtgtgggggtctgggagtggtggctcacacctataatcccagcactttgggaggctaagatgggtggactgattgagctcagaagtttgagaccagcctgggaaacatggtgaaaccccgtttctacagaaaatacaaaaaaatcagctgggcgtggtggcatgtgcctgtagtcccagctacttgggagactgaggtagaaggattgcttgaatccaggagatggaggttgcagtaagccaaggtcacaccactgcgctccagcctgggtgacagagtgagactctgtctcaaaaagaaaaaagaaaagaaaaaatactgtatgggggatgttgtatatttcttcttgtgagataccaggagataaataatttcagcttgtctcattactggtggtgcttagtttatcagttggttaaggtggcatctgctagatcttcgtttataaaggcgccttttcccttttgtaattaacaagtaatctgtgcaatgatactttgaaagcatgtgagtaacctttcacccagtgtgtattagttttctattgctgctgtaacaaattacagcaacttaatggtttaacacaacacaaatgtattgtcttacagttcggtaggtcagaagtccaacatgggtttcttaggttaaaatgaaggtgagggcaaggtaatgttcttttctggaggctctaggagagaatcttttcccttgcttttttgagcttctagaggctgcgcatattccttgactcatgatcccttcctccatcttcaaagccagcaatgttgcatctctctgactgttctttcacagtcacatctgcctcttaccacagcctggacagtttttcagcttttaaaggatgcatattattagattgagcccatttggataatccagataatgcccttatctcacagtccttaactttatcatatctgcaaggttattttgccaggtaaggttctgggcattaggaagtagacatttttgggggagcccattattttgcctgccacacagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaatttttaaaaattatccaagtgtgatggcacagaactgtagtcctaactacttgggaggctgaggtgggaggattgcctgagtccagaagtttgaggctgtaagtgagctatgatcgtgccactgcactctagcctgggcgactgagcaggactctatttcttaattaaaaaaaaaaaggaaaaaataaccagaaaggaattaatcacagtttatgggagtaatgctagctgaaggccgggggtcaagaggcctgagttttgagtctcatggtacatcctgagtcatttccaggagagcaggaacgggggctgcctcttgcctccacttcatgtccctttactcactagttgaagaactgaagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatggatgtatattatattcttttagtttttagtaaaaattcagaaaaataaacatgaacttgaggtaacgagcctctagaattcttcattttatttcatttcacaatgtttcagcagtcttctgcagttagttggaaggttttggaaattctgactaatccagttgttgaagaataactagttagcttaataaatatgttttctagagctgataaaaaagatgattttttcatctgatgagctctgaccctctataaaccttctaacttaactcattttccaccagctacagaaatgtaacaagatgccaacaattacatcctcatggagcatgtatactagcttataaaatcacccctttgttggaaaattgtgtaatatcttgatttcaatttagcatggcatgttggttagcagtaaatcttgctagtgtatgaacacaagcctgcaggcagtttggagaacattgatcaggtgtaaattgtatgtatttttctcgcttctaaaaattttatagcagaatgaaataaagagctagcattgagaacactttttcagttgttttttattttttatttttatttatttttattatactttaagttctagggaacatgtgcacaagtgcaagtttgttacatatatatacatgtgccatgctggtttgtaggttgttttttattttgacatgtatcttgtggaaagtgccttctctctcctgaaatccatgatttgtgtctctgaccacttaggttccccatttagtatgtgacacatagcaaaagcaaacaagcatagttaaaacgtgtatttgtgccttgtgaaatgtgcattataagcagttaatactagatttgaaggctgtacaaaaaacatgcaaaaagatattaatattaaatacttagtgcttattgtgtatattaagcatttaatatatacaatataattttgcatgaactctgaaagataagtactgttattaactgaattttacagatgaagaaacaggccaaataaggtgacttgcccaagagtacacaggaagtattggagctggtgtttcaatcctggtgcacaggcagagtgtagtgtagtcactttatcaccttctgcctctcatttcttcgggcgaaatcaacacatacctagtgaattcttgcaatatataaaacactgtattaggcacataatatggaagttaccacatatctaaatggtaataaaagtgatcagttgaggctaggcatggtggctcacgcctgtaaccccagcactttgggaggccaaggcaggaggatcacttgaggccaggagttcgagaccagcctgggaaacatgacaaaaccccatctgtaccaaaaatacaaaaattagctgggccaggcgcagtggctcacacctgtaatcctagcactttgggaggctgaggcgagtggatcacctgaggtcaggagttcgagaccagcctgaccaacatggagaaaccccgtctctactaaaaatgcaaaattagccgggcgtggtggcacatgcctgtaatcccagctactcgggaggctgaggcgggagaatcacttgaacccgggaggtggaggttgcgggagctgagatcgtgccattgcactccatcctgggcaacaagagtgaacctccgtctcaaaaaaaaaaaaaacattagccgggtgtggtgacacacacctgtaatcccaactcctcaggaggctgaggcaggagaatcacttgaatgccggaggccgaaggtgcagtgagcagagatcacaccactgcattccagcttgggtgacagagcgagactctgtctcaaaggtaaaaaaaaagaaacatgctaatacatacagctgttattccttttcaaacgatcattggagtgatcatcacttttagagcaattgaaattttaagaatgaataataacaaccaacatttataaaatgctttactatgaggcaggcactacttcaagtgctttgtgtataacctgtttgtaaggtaggactattcattcttcgtttacaaaggaagaagctgaggcatgtcaggtgaaaggacttgcccaagattacctagctattaatgtggtagagctggagccaggatttagacccaggcatccaagctccttgatctgtacatgtaaccattatactacattacctctcattttcctgatgaagaaaacttcttttaatgagaaggtattgaaaatagtttcatattaggttcttataaacatgagcctttaagtgcctttttactgtttataatagacgtcactgagaagattgttaaaatttataatatgatatcattaaagtagcttttcccaaatgatgttctgaggaagaaggaagtactctacaagaaattaatgatgctaataatagtctgagatttacagtacctgagtagttctaaaatttaccttgcctaacccaagatgatttgacgatgggcctctctcctctttgtcttcatagcagccattcacttgtctagaaatctttgcatttggttaagcagtttggatagtgctgatgtaaggttatagtgctaattcctttgcttatttcttctaaatacacatcccaagggaaaccattgattaattaaacttggagtttgtccttcagaatagaaaaccaaaaatcatcaaattcaccccttgtctctattaatgtattgatttagtaatatttatgtaattctttaaatgtagtataaaactttagagttgcaggagatctttgagatcaccaagtccagggttttaaggctaaggttcaaggagcccttttttctggggtttgtagacctctgaaattatatgcaaaaagagtatttttctggagcttcttgcccctcctctccttcagcaggtcatttgacctaggccagtggttcccaaactttgctgcacattagaattactggaggagcttttaaacgttagatgcccagatcacacctccatgctgcttaaataaaaatgttggagtgggagtcaggcattagaactttttgaagtttccttgtgatgccagcatgcatcacatgctttcttctttaatagatgaacaagtaggatctacttatgtggctgaggaagcaatctagagatgttaattggtcagggctctgcttcctgctaaaagagattttagagatcgttctgaaggagtcttgtggggaagtggctctggagctagaatgcttaggttcaaatcccaagttttcctcagctgactaatagggatgataatatagcactgaccacactgggatagtcgctgcctgagctacagaggtggtgagcttgtcctcagcctcaacagaaaggtcagctgaacagactccaaggcagtggagggacggcagcccccagcactccactctgccatactgtttgggaaggaaaagctgtaaaccgatgtcctcattaccttctaacgaagacctcctctcctcttgctctcttacgccaagaatggctagaatccgtttctctttgtggctccttccaccccacctcatgttatttaagtaatcagaaaaggagtctattattttcagagtaacacatgctccttgtacagactttgaaaaacagaaagatttggagatgatacattatcactgcaaatttgactataaagataactactgttgaaagtgtgtattttcttccagtcttttttccttttttcctacatgtaaatatgtatgctatatttaaataaaaagaagactgtgtgagctatataattttgtatcttcctttctaaatttaaaatctgttgtgagccttttcccatattcttgattattctttgaagctgactaaatagctgcatagtatttatgtctttatccttcaaaatttaaggtgctcctaaatcttctgctattacaaataataccgctactaaaaatttgtgcatgtgtggataattatttcccatagaatagattactaaaggaggtaatactgaggcatgactatgaattctttttctaaagctttggaagcatattatcaaaaactgttccaaaaagatagtaccaatttatacttatgggcagagtataagggagtgtgggcatctaattgattcttaatgcttaccttttgtcatgttaatgtagtagagggaagaatggatccttaggagttactttgcatttctttgattactaatgacttggacattttaaaatgattaatggccattgctaaataacagtgttgtggttatttccccatccttattcctatgccctgcagataagcatcttcaactctttcaaccacatttagtctggcttcttagggaagttggaggtctgtaatattcttacgctgttgtttcttatttttaaattgtagacattatctgttgacttcttgcgagtgtagataaggataaaggtccctcatacacatacacttttctctttccctttgcccctcttatctcaatatacactacttttatgtaggtaagtatatgtattcagtgcttatatttttatgagtttgtaaatattattcacacttgagccatcaaaattttttgttgttgtttttttgagacagggtctctctctttcagccaggctggagtgcagtggcgcgatctcagcccactgcaacctccacctcctgggttcaagtgattctcttgcctcagcctccaaagtagctaggactacaggtgcacaccaccatgcccagctaatttttgtattttttgtatttttttgagatggagtctcactgtcgcctaggttggagtgcagtggcgcgatctcggctcactgcaacgctccatctcccaggttcaggcgattctcctgcctcagcctcctgaatagctgggattacaggcgtgctccactacgcccggctaattttgtgttttttagtagagacggggtttcaccatgttggccaggctggtctcgaactcctgacctcaagtctgtataaaaaagcctgtatatgttctgtaaagacgcaaccatccacttttttcccctcaggtattttatttatatatttggagacagggtctttctctgttgcccaggctggtgtgcagtagtgtgatttcagctcactgcaacttccgcctcctgggttcaagtgattcttccccctcagcctcctgagtagctgggattataggcatgggcaccaccccaaccctcgactaccccaggtgttttgaattgaggttagttgactccacacatacagaggtccaactgtatataaagtaaagagtaaaagttttacctcattggccctgtgtgttcttctctgaaaacagctttccaaaggcagccacacttggtggtttgtatgtattcttacagggctttttaaagcacttgtaagctaatattatacctacgtttatgtatttcttgtaacagaaattgggatcggactttggtattttttcttttgaaaagtttttagatatataagacatatatgagtacattcttcttgaaaaagttctaatagcagaaagaaagtgtcacacaaactccctgagtctcacttaccttatctgtaaaatgggaaggattatatattcttcatagggttgttaattagaatttaatgaaattatgcatttaggtggcctaacacagtgcctattcaataacaaaaatgagctagttattttgaacatgtatcagctttggaatttttaatgaagagcattttggcatattactgtatagtttgacagtggtcttttgatttgctcagtcctttttcagggtcttacagaagaaaaggagagtcttacatgttttccttcatagctttgtatgctgtaaatatgagtttagtttaatagcagagtttttctttcttttttgaattaattatttggattgcttcctctctactgccttcaagccaaaagctcagagtttcccaaaccaaagtgtgcctcaatcacaatttttaccagttttatacaatctgtattaattattttatcttttttttttttttgagatggagtcttactctgtcacccaggctggagtgcagtggcacaatctcagcttactgtaatctccacctcccaggctcaagcgattctcctggctcagtctcccaagtagctgagattacaggcgtgcaccaccacgcctggctaatttttatatttttagtagagagggagtttcactgtgttgcccaggctggtcttgaactgctgaccttaagtgatcctcgtgccttggcctcccacaagtgctgggtttacaggcatgagccactgcacccagcccctgtattattttcttaatacttgctttcacattaccgcactaaagaggcataataaccaaatgccgtgcatggaaaacagtacagttgacccttgaacaacacaggtttgtgctgcgctggtcaacttacgtgctgatttttttcaaccaaatctaatacagtattcatggatgcaaaatgcacacatacagagggctgattttttgtctctgtgggttcttcagggccagctgcaggacttgagtatgtgtggattttgttatagtctgaggtcttggaactgatccctcatgtataacaagggatgacaatattaaaaaattacttatttgggggataattggatacatttgaatttggattacatattaagggaacttaatggcattaatgttattgttcttcaatatgataatggcattttgattatctaggatgtctttatgagttgggagatgccttcggaagtatttaatggtgaagtgtcttgatgtttgcagcttactttcaaatggttcagcaaaaatcatactaaaatatgtatgtataaatatatgtgtgaatatagacagatatagataaagatatgaggcaaaagataggacccctaattgttgaatctaggtgaagggcataccagtgttcattatgctacttcaacttttctgtagggctgaaagtttttcaaagtgtaaacttggaaaaataaatgtaattagaatatttacttaaaattaaattgcctcattttctttatcttagtagatttactaaaaaaaaggagtctatatcattattgtaagtggaaaacaagcattccttgccataaatagaagataactgtaaaagttattattttaaaaagtttcagctggatattgttgtctgccaaggctctgagcctgaggcctgctctctcaaaagaagattaacaagcattagaggcgttaaacacaatattagcaccaaaatgagactttcttcttgacttaatgggaaggtatgaaagaaaattgaaaagggaacaagtttctcattctgtgtgattcagctcacctcataacatctcaagtctcacctcaaggcatcttgagtaccactagtgatagaatcccacacttggggaaatactgtatcaggtgatttcagtgtaatgtgttagaatgaaagtaaatttttatattaaatactgtttatagtgcccattatgtcttttttaaaccttgtatgttggtttatcatcatcattattattatttggtagtctcgataactagagctagctgcatggttagctgcgtgatgtcctggcttagggcagatgtcagatattgcagtctaaattattattggggtatacttattctattttatgatatgcagtgttgcctgactctcgaagcataataaagccaattgagatctttaaaaaattaattattattgatttcttactctgaagttgctcttgtagtgggtttttgctatatatattttttctttccttctttttttcttgctacattgttcctgctgttatttggaaggcactaggacattttgcctcttgaacaatgaaaggatccagatcgtgtctgtctcacattttgttatcccagtacaagactcaattgaataaaacatattacccatctggcctggaaatctcagtggcactcaaaataacttactaacaagttgttggatcatgatatcttgagattttctgaaagttcagcttctttttagctgttgctaagagagaaatttcattgacatgagggacacgaggacatgtctgcacactgccagttgttttagaggcatttggctctgccgccttgcagatggttagactctgggtggtgggtgaatgtatgctgattatcttattgaattaaggtaaccttttgtcattcattgaattctgcagaccagttggtcagtgagcagctgctccatgtggcttggtttgggttttgaagtacacaaaaactatcttaaagggtggtcagtctaatccaggtattcaacaaagcaatattgaaagccttcttccccttttgacactgttttctgttctgatggaagtgaatgagcaaaaatatttttactttttgctcaattaactaaatgattgaagcaaaggtttatggaatggccgaataagaattttttaacctagtgctttaagttgaagaaaatacactttcataatatttggtgtcagaaacattctacttttatggcatggtcttatgtttgaagatacgtggtagagtttttaaagtttatttttacaaatatctagaaactaaaaagcattcttttttatcatgcatgcttaataacatcatcttgacaaatactagctgcataacttttggtttgtagggttgttttaagatcagttttttgtttgtttattatattttaagagacggtgtccctgtcttgcccaggctcgtcttgaactcctgagctcaagcaatcctcctgcttcagcttcccaaataactggaataaatctgccatattttttctatatggcttccatttcagtttctagaaactctttcaggaggcttcattttaaataaagaggttcttaattgtttttagtaaattgctgaaattgtatggctcatttctcttctcagagatttttatcttgagctgatccttttggttttactgaaggtgcaatataggtaacctcagagaaagtgactttagccactagttgatttgcttattgtcagagagaaatcatttaacagtgattgatgaggaactgtttaatttctccagtttagtcacctgttgggccctagagcctttcgattcagagctcactgtttcatttgcatttatatcctagtaactatcataatgtctaccagtatttattaagcacatattctgtgctgggtgtcgccgtttatatatgctctttcattttgtcctcaccacaactttatgaggcaggtcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtctatacttgtcttattaatggtaaaaataatgtaacaacattaaagaaaaattttgaagggtgaaacactgtttagactcttgccaccttaatacaaccgttttgtttttgcttatttccttccagatttgtttatgcgcgtgtcctttcacacaactataatcaaagcatatatacagctatgcagttttttttttaaacatagtgttattttatacatattttctttttaaatgttcttttttgtttttgagatggagtctcactctgttgcccacccagactggagtgcagcggtgcgatctcccctcagtgcaacctctgtctcctgagttcaggtgattctcctgcttcagcctcccttgtagctgggattggccatgcctggctaatttttgtatttttagtagatacagggtttcgccatgttggccaggctggtctcgaactcctggcctcaagcaatctgcctgcctgggcctcccaaagtgctgagattacaggcgtgagccaccacgcctggctttaaatgttgttctttaaaaagacttttcccacctctttgaatttcccaatctcaacgaggtcccttttataattcgaacaaaggaccatatgctttttcttattagcctttattatagtctaattatgtatttatttgtctggctattttgtaacttaagttgtcccctctaaatggaaaagcttcatgaagacagggaccttatttctgctgtatggatgcaagcagttatttattaactaagattaagcttctgtttatctgttacctcatctgtcagaaacagttggacagattttcaccaaacttagaaggtttttgaagggcatctgtggtgatcaggagacacatgacatatattttctgatcctgtgtctgagataacatacagagatttcaaacatgagacctggctgggtgcagtggctcatgcctataatcacagcaatttgggaggctgaggcaggaggatcagttgagtccgggagtttgagaacagcttgggcaacttagcgagaccccacctctacaaaaatacaaaaattagacaggtgtgatggcatgcccctgtagtcccagcgacttgggggtgctgaggcaggaggatcaatcacttgagcctgggaggttgagtctgttgagtctgcagtgagccatgatcacaccactgcattccagcctgggagacagaacaagactctgtctcaaaagacaaaaaaccccacgaaaaaccaaatatgagaccatgagacctatattgaagggcccaagggcagattgtcaagatggcagaccttggtttgcactttagagttgggtagcttcttaacttgggctgttccacatcttaatctaggatgagcagcaacaaggatgtctttatttaataatgaccaacaagtctcccagtcacatactgactaatttcaaataaatgcatttgatcttttcattttcattttgcttgtttaaatataaattgtctattgaaagagtttttttttctttttgagacagagttttgctcttgctgtccaggctggagtgcaatggtggatcttggctcattgcagcctccgcctcctgggttcaggcgattctcctgcctcagcctcctgagtagctgggattacaggcatgcgccaccacgcccagctaattttgtatttttagtagagacggggttttccatgttggtcaggctggcctcaaactcctcacctcaggtgatctgcctgcctcggcctcccaaattgctgggatgacagatgtgagccaccatgcctggcgtttttttgtttttttttttgatatggagtcttactctgtcacccaggctggagtgctatggcacgatctcggctcactgcaacctctgcctcccgggttcaagtaattctcctgcctcagcctcccaagtagctgggattacaggtgcccagcaccacgcccaactaatttttttgtgtgtttttagtagagacggggttccaccatgttggccgggctggtctcaaactcctgacctcacgtgatccacctgcctgcctcagcctcccaaagtgctgggatgacaggtgtgagccaccaagcctggcctttttttttttttttttttttttttgatatggagtcttactctgtcacccaggctggagtgctatggtgccatctcagctcactgcaagccctgccttctgggtccaagtgattctcctgcctcaacctcccaagtaactgggattacaggcacacaccgtcatacccggctgatttttgtatttttagtagagatggggtttcaccatgttggccagactggtctcgaactcctgacctcaagtgatccacctgccttggcttcccaaagtgttgggattacaggcgtgagccaccatgcctagccctcatatggtttatgagtacttaagacatgtttgattcaatttaaaaaataattacaagctgggcatggtggctaatgcctataatcccagcacttagggaggctaagacaggaggattgcttgagcccaggagtttgaaagcagcctgagcaatatagagatactctgtctctacaagaaatttaagaataggctgcaacactcactctaaggggagcattgtgaggtataccaagatgagtaagaacaatatggtttagcatgccagaacaaggaagtttcaggtgctagaaacacagacatcctcagctcaaacaggaacgcccagaacagtatacaagaaagcctggagctggagtcagaagactggctcccatgtgtggtgtcctaactctctctagacctcaatttcctcatatgtttaataaggataacaacctactcttcagcccacctgagaggacaggatgcttcaagaaagacagtgagcagcaggtcctttaaaaatcaaaggaaaacaggctcctggataggtgtgagatagaagtgaattatggcacatacgagagcaacaataaattatcctttactaacagtaacctaagggaaatgcccggcattgtgtctggcacagactagatactcagtagttcccttctcacacttgctcagccctgtttgaacccagacagagagcagctcaaaatatgcaagtattacatactcacagaacctggagacaagagaagcggcttctaggcacatgggctcccatccttgcagcagctggtatagaggttgcatgacaacttgtgaggattctgcagtagcgtgggctcagctacatgacctaaataaaggtctctttcaaccctgagattctgtaagtttctttttctttagacagagtctcactctgtcacccaggctggagtgcagtgacacgatctcggctcagcgcaacctctgcctccaaggctcaagtgatccttccacctcagcctcccgagtaggtgggactacagttgtgtaccaccatggctggcaaagttttaaagtttttttgtagtgacagggtctcactatgttacccaggctgattttgaactcctaagctcaagcgatcctcccacctcaggctcctgagtagctgggactacagtcttgtgccaccactcctggctaattaattttttttttttttgtagagagggggttctgctatgttgcccaggctgggtgaactcctgggttcaagtgatcctcccactttggtcttccaaagtgttggggttacaggcatgagccactgtacctgtcttagtttatgttttaaagtcatcgagagacatgaaaactaaatggtcctaggttggaggaagaaaacttactgtaaaggacagtattggggaaaactggcaaatttggaatatgtactgactgttagatgatactcttatatcaatgttaagtgtcctaagtctgataatacattatggaaatgaagagaatgaccttgttcttaagcggggtgaatgatcatggtctttacaacttattctcaaatgattcacaaaagagagataaagcaaaagtggccagttttaaagggcatatgggtgtttattgaattattcctgcaacttttctataggtttgaaattttttcaaaataaaacttttttgcccaggcatggtggctcacggctataatttcagtgctttgggaggctgaggtggaagtatcgcttgaggccaggaattggagaccagcctgggcaacatagagagatcccatctctacaaaaaatgaaaaaaaaaaaaagccagatgtgatggcatgtgcctgtggttccagctgctcaggaggctgaggcaggaggatcgcttgagcccaggaatacaaggctgcagtgagctatgatcatgccactgcactttagtctgagcagcagcaaaataaataaataaataaataaataaataaaataaaactttttaaaggtcaccgaggctgctgtgtggccaggggagctatagaggagcaagggtagaggagggcaagcctgggaggaggcctttgtgaggatggaggcatagactggggttttgacagtggggatggagagatgaggacagatctgaaatatgttttgaagaacatatttaacagaacttgctcatggattggaagagattttaggggagagagagggaggtagatgttccccacttggtgcaccctgatggttgcagactgaattccaatagaatcttctccccaaggtctttttattccctctctcttttcctcaattcagccactctatgagtagttaatacaggtatttatttcacagatgaggtgagactcagggagatgaaatgactcatttagagttatcaggtgcagacagaaattttactctacccagaaaaccaaaatataggcatgaaatcagtgttcttcaaactgaattgtctctcattaattgattgtgaaatcaacataatgagttcctatcagcattaaagaaaaaaaaaagagaaacagaataaaaatatagcatgccttgtgtaaaagggtaagtaatgtttcatgaaacttctattttagtttaatattcacatatgtgtatagtaggtcatgatgtgaacgtatttcttacttgaagttatgaaaaattggaaaggcacatacaggatcattgtagaaggaacttatgttatcacagaggtcctgtagtccccatgggaataagaaagcaaaagacaaattcacttgggtggttactgtaggttgtcatatgttgtttatttcttcagtgactgataggctgtaagtctgtcagtttcttagttgttttcttagttgatttttcttttcttttcttttctttttccgagacagagtcttgctctgtcgctcaggctggagtgcagtggcgcaatctcggcacactgcaacctctgcctcctagttcaagggattctcctgcctcagtctcccgagtagccaggattacagccatgcgccaccacacccagctaattttttgtagttttagtagagacagggtttctaccatgttggccaggctggtctcaaactcctgacctcaagtgatccacctgcctcggcctcccaaagtgctgggattataagcgtgagccaccatgcccagcctttcttagttgatttcatagtcatcctgtacttccagtcttgccattagcaaatattgagtacttgctgtgtgcagggttagaagttacttctttgtgtgagatctatgttttgtgtgtgggtggtgtgtgtggggtgtgtgtgtgtgtgtatgtgtgtgtgtgtttgtgtgtttaaaagtagacttttttttgaagagcaattttagatttacagcaaaattgagtggaaggggcagagatttctcatgtactccctacccctacacatgcacaattttccccattatcaacctcccccaccagaatggttgttacatctgatgacacattgtaattgcacagccttatcacccaaagcccatagtttacattagggtttactcctggtgttgtatattctatgggtgtgagatacatgtttaaaaatattttgtattagataaattggggataatagtcatttcaagaacaaaatgttggataaattaaattagctaataaacacagagtgctttaaacattcctagtgcaaaataagatcttgttgtttgtggtggtggtggctattcaggcttaaggtctagattccacttagtatgtaagtaaataatagcaatcctggctgtcatctgtatgtgtaatgtagtaatcagttttgtttagctagttcttatgtgtagcacattaaagcaatcttgaatagtgaggggacctcattactagattaccattaaatggtaatgttaagtgaccctgaaaccaaagtaatggaaaattgtcttcctttttttctttttttttttttttcccttgagatggagtcttgcactgtcacccaggctggagtgcagtggctcatggcaacctccacttcttgggttcacgagattctcctgcctcagccacccaagtagctgggattacagatgtacgccaccacacccggctaatttttgtatttttagtagagatgaggtttcaccatgccggccaggctgatctcgaactcctgagctcaagtgacctgcccacctcagcctcccagagtgctgggattacaggcatgagccactgtgcccagcctgtcttcctttttctcaaacatttaatttgctgtttcttgatcacatatcatccttctttcctttcaaggtcaggggagataattttttactgtatgtactgctgcatcttcacacaaattatcatctgaaaagccttctcagatttgacaaatgaagtctcttttcattcccaggaggaacttgttaaaccaatgaagttcaaaattctaattcctgttcctttctagtgtgcaccactttattcatcttgaataaacatacaacctcaagcatcctacaaggcaaatagattcctttttaattagtggctctatacacagagttttatcatcatgaaatttataaaccaggaagggaacaaatatttacacttgcaacttcatgtcaacattgcctactatttgaagagctctgaaattgtaaatgtatcaccccctccttcttcccccactccccacccctgccggcttttaaactatggcagtagaaaaataggtttcaactttctaggagcacatctctcctatgtggggaatgtggcagattctttatataagtgctctttctttgtgactggcattacttttttttctcacaaagatttgtttcagaagctaatcttcatttttttggttgttgctttttgtagtactatttctaaggcatctccaagtagaaaggcaaaattttattttgagaagttactgctttcatagttacacagaattatttctcaatttaagtaggccttttattccaggacaaaattaagccagtcagaaggtttctgggagaaaaataatgaagagctgaggttttgtatgttaatgtgggcagtctaatgcttgataaaagaaaacttttggctgggtgtggtggctcatgcctgtaatcccagcactttgggaggccgaggtggtcggatcacctgaggtcaggagtttgacaccagcctggccaacatggtgaaactccatctctactaaaaatacaaaattagctgggcatggtggcgcatgcgtgtagtctcagctactcgggaggctgaggcaggagaatcgcttgaacctgggagactgaggctgcagtgagctcagatcgcaccattgcactccagcctgagtgacagagtgagactccatctcaaaaataaaataaataaaataaagaaaactttttttttgtttgtttggcccttgtcagggacagattccgtctcagaaaagtctcgctctgttgctcaggctggagcgcaatggtgcaatctcggctcactgcaacctctacctgccggttcaagcgattctcctgcctcagccttcccagtagctgggattacaggcatgcgccaccacgcctggctaatttttgtatttttagtggagacagggtttcaccatgttggccaggctggtgtcaaactcctgacctcagataatctgcccacctccgtctcccaaagtgctgggattacaggcatgagccaccacacccagccaagaaaacttttaaagatgtgtaaatatgcagtgatttaaaaatctcagttgaagcttgttaaaatgtatcaaaataatttaggaaaaggggggctgattttgccaaaatttgggagatgcatactttttttcaaggctttactgcagttttaaaaaatattttattgttttgtaggcagcttctgaaccagagtaggctcagagactccctttattgcagttttgatgctgcagaaagtgactgcttaatttcagctgttgaggatgttggttatactatgcctggatcaaaaaaatgattttacattgcttagtttgttaaaatatgtttaataggttaatctttttttcaaagcatcaaaaataattaagatgaaatatcagataaaccctatgtctagaatgaataatttagttctaaacatcctggatgctaaggagaaaagaacaagatgttggtttataaaattcttattgtcaaataaagaagcatagaagtttgaagaaagataatttttttgtttttattttttctctctgaatttaggagtaatttatgtttgggttctaatcctatgttatcatcaaagagtaataacattggcaatcttccctcccattctgcttcatcctccccactaaagggaaataccagattgtaaaagaaaaaaaaaaagcatgctggttgtataaaaagaaacattttaaacaaataagaaatatatatattgaaatgcagtctccctgaatgatgctaaacccctgtccaagtaggcatttctcagcccacagaaagggatggcattaaatcacagctcaatggagacatttttatgaggagctgtgatggtttgtgtttagcaaacatgtattgggcatctcagatttgcctgttagggatgcaacagtgagtgagatactatttgttcccttaagaaactcaaagaggaaaggggttgacttgttcagtcagtgacttatgaaatatttcatactcattcatttacagagtactttttgtaggtatagtacagcgtggtcagccagggagactatagtgggtgcattagtaactaaccatacaactaatgctaatgttgcgggctgactgggtttggggtgaacaaatgacccctaaagctcaggagttctagaccagcctgggcaacacagtgaaaccctgtctctactaaaatacaaaaaattagccgggtatggtagcatgtgcctgtaatcccagctactcgggaggctgaggcaggagaatcacttgaacccgggaggtggaggttgcagtgagccaagatggtgccgctgcactccagtctgggtgacagagcaagactccatctcaaaaaaaaaaaaaaaaaaaagacatttgttttggctggggaaggctttgcagagggaggtaacttctagattgagatttgaagtcagagtccatccagaaagtagggaagacattttatgtagagaagtaacaagctacagggatcagaggtatgaaccagggtgcatgtttgggttatggtgagtggtgtctggccaaactgtgtggctcagggtctttctgcttcaccatctttagcatagaagccttccttgtgctcacttgctcatctcattctcacaaaatagctgcttcatatctaggcaccatctctctattcccacaggggaaagagggaaagtgccaagggtaacagcggaaacgtcttcctttttattcaggaaatgagggactccccaaggcttctgcttatatttcattggcttgagctgagccgtacaaccatcactagtggcaggtagtctgggatgtcaagaaagtagcttcccagtctctttggttagaaggcaaaggagaagatggtgggaatcggtttgcatcagtcactctacacattatctgctttgttagggcagcattatcttagtattgttaccaagttcagggtcttttctggggtgatcaagcatcctgggtcgcctgggaccaagtggttttctgggttgtaggactttgagtgctatagcctggaaagccctaggaaaaccaggatggttggccatcctagtctttccccatatcctctgttgtccaaaaatatggaagcaggtcatttcttgacataggagctgccttgactgggcttaaaaaggcctgaaaggcagcttaataatttacaatgagaaataaatgatattggatcaggggaggatactggaagaagagctccatgggatttgcttggtgctcgtgagattttgactgacaagagatcttagggctactatattacccaaattcaggggactctgttcactttgccagcagcctgggattaattctgtagtgctaatgccattctgagaagcctttcaatgaatctgagctcagggttcttagtccccctgttactgaagcttctccccagacagtgtcgtttttgttttttccttcctttctaagcttctggtgctgactagtctccccttctaatggacagtgtttagatacgttattgtctaaaggtagatctggccaggcatggtggctcacacctgtaatcccagcactttgggaggccaaagctggcagatcacctgaggtcaggagtttgagaccagcctggccaacacggtgaaaccccgtctctactaaaaatacaaaaattagctggacatggtgacaggcacctatagctgagatccattgtgagtgccattgcactctagcctgggcgacagagtgagactccatctcaaaaaataataataaaaataaaggtagattaaaaaaaaagagacataatttgcgttatcgtaaaatttacttttttaaagtgtgtaattcagtggtttttagtatgttcacaaagtcattcaccactgtctaattccagaacatttttcttaccccaaaatgaaatcctatacccattagcatcactgcccatttcctgcttcctttagactgtggcaaccactcatctattttctgtctctataactttgcgtattttagacatgtcatataaatggaatcctatggtatgtggccttttttaaaaatcactggcttctttcactgagcataatttttcaagttcttttaagctgtagtatgtatcagtacttcattctttataactgccaaataatagttctttgtatggatataccacattttatttcattcattcattagacattgatggttctactttctggctattatgagtagtagtactatgaacatttgtgtacatatttttgtgtggacacgtttttacttctcttggctgtatacctagcagtggaattgctggtcttcaggtgtgtcttactgatgtttttttttgagatggagttttggtctgtcgcctgggctgaagtgcagtggcgcaatctcggctcactgcaacctccacctcccaggctcaagcaattctcctgcctcagcctcccaagtaactgggattacaggcgcacgccaccatgcccagctaattgttgtatttttagtagagacggggtttcaccatgttggccaggctggtctcgaactcctgggctcaagcaatcctcctgccttggcctcccaaagtgttgggattacaggcgtgagccactgttcctggccttatcttactctctctttttttttttgagacggactctcactctgtcttccatgctggagtgcagtggtgcagtcttggctcactgcaacctccacctcccaggttcaagccattatcctacctcagcctctggagtagctgggactacaggtgcagctaatttttgtcattttagtagagatggggtttcaccatattggtcaggctggtctccatctcctgacctcaggggatccgcctgcctcggcctcccaaagtgctgggattataggtgtgagccactgtgcccaaccatctttaagcctccttaaggaggctgtgtctctaacatgccctgttggttttatagttggactctcactggacagcctcgtttttctaagatttgggggttataaggatcagagttgtccccagttggctcctttcacctcgtccataaggttgttgtgaggcttcactgaggtaatctgtataaagtaaggtgctggcctgtaccctgtacatcactcagtagtggtgatttcactgccctttgcctcctgcctttggcttctggctatctccaaacaccccatgccttctgtgctccaccctctgttgaaacacaggaatctaaaaccattcattgatactttttgagtgattatactgaaaacaattgcatgttgtctcatgcagaattttcgtgttaaaccctgtgttgcaaggatgccattaaccagcacacagatggcggtggagattgattgattgagatggggtttcgctgtgttgcccaggctggagtgcagtggtgtaatcgtagttcactgtaactttgaactcctggactccagtgatcctcctgtgtcagttttccaagtaactgggactacagtctcatgtcactgtgcctggctaatttttaaaattattttatagagctggggtctcgctatgttgcctaggctcttctcaaactcctggcctcaaagcgatcctcctgcctcagcctcccaaagtgttgggattaccagcgtgaaccaccacacttggctggggatggagttttagacaccagaggcttccttccgaggttgacctagaaagcacccttggtgggtgccatgggatgggggaatacagtcaaaaggaacctgctcttcccgctgcgcctccacctgaggtggatgtgtctgctggggctgctggagtctccatcttccactttaacttcacttaagagctgaaagctctgccccttcttcaagattttccctgctgtctccccttccctgctcaaccagagattcctcttattcttcctcttgctattagtattaatctggctcactgactcttttccttaacctcatcctaaaactgtctgatgcatattttatattttcttgcatgtttgacttttagttagtattttacagtaatttcgttctgcagccatcctcttatctgataccctggaactcattcctgtgcctatcagttctcacctctggtaattaaactttgtaaaaaagaaatgtgacatttggacatattctcttattagtaaaggtattattgtgtatgagactaatgctgtgcatctataataagttgtttcaccttgtgaatactaatgtaatttggaaataaacctttctttgttaaagactttttctacatgggccacgtttttccagacctatttcctaataatttgtggtttttaaaggtatgtcaatagagatgctgtagccagcatggctggattctgttagataaacattttgtgagattgcttaccttaaacaattgtctttaaaagttaatttcttccctaatgtgtcagtaaggaaattctatagtatttaagaagcctgataaagtccagttaaaacattttgcattgctctttaaacatcttttctgagggttgatgtgttcgtgtttgtttggttcacatagtttcttctgaattttaagaaagctttgtcagaatcagtaacttgcctatagtgtatttttcatgaccatatggctttcttcatcaaaaacagctaagtaaaaatttcagtgaataatagtatatatatatgggaatgtattcctcatcatttgtatgctcttgagagagtgactcatgtactgttttctattgagttcccgaaagtttataaagagatgacaaacaattggctatgggattgaaataatgcacatgtaaaatggaagggaaaacatggaaacagtttcttcctttgttcttcccttaccttgatgaaatttttaccacttaacgtttttcagtaaagtcaaggtcagtatcagagcctagtacggttctgcttgccgctgtctgaggattacctgtcttattacagaatgtacatgctcccagaggagaagatacagtttgatttcaggatgacaaacagctcttctgggacaatagtgtcaagtataaaaggattataaaggttttaggaccatgggatggtttgaaggggaaagggtgaaatgacagttaaggttggcatcaccgaggtcccagttgttggctgccccctacttctcctgttcccctctggcagtattttacagatgtatttcctttgacctttcctttagtaggaagttgtaggctttaagatccagcagaaaaaaattatgagccatttgtgaccctcttgagcagtccttcaggtagaacacatttcataagagctagtgaatggtcttgggtaattaaagctcactttatgattatacagtgtggtggccagcccagagggaacatcacaaatacacattatgaatgtatagaattgagactttatacctggagactgttggatgacctggtcctctgcccccaggcctacccttctgcccatcctcatccaattctgttttgatttttaaaaagtatgtgcttcttagccctctcattgcttcactgtgaggggaaaaacttttctattgaggtgctgaagctgtgctttccaggactcatacttatgtgctgttgaatgagtctcagtgctcctaggagtctataaaaggaatagaagacttcttttctctaactcccttatggtttgtattttatctgctaagagacactggcatttcatggagatgggagagaaaaagacacagcctacttagacagttcctttattccaacatatatactcacttcacatattcatagacaccttccacctagcatcaaattctgaactcatagaagacttaggtgtttttggttttgtatgcatagcttttgaaatccctgggttgaaaattttctaggtgttgtttgtatgctctagtcaagcccaggacataaagggttatgttaaaattactttccttagtgactattaaccagaaattttatctgtcaggagaaaggattcatgcaactctaagaatgcattgccctctgcataggctattagctttggcaaccgaagatagatgagacttaggctgtgtttaaatttttcattgtgatgagacaaatctattattataaaagccctactttatcagtgagagtgtttccttatgttgttttaattaaaggagcagtgtgtttttaaatttaattatggtaccttgaagatctgatactagctgtaagctaaggattctttgggttttcaagattttttttttggagacggagtttcactctgttgcccaggctggagtgcagtggcgtgatctgggctcactgcaacacctgcttcctggtttcaagtgattcttctgcctcagcctcccaggtagctgggattacaggtgcgggccaccatgcccggctgattttttgtatttttagtagagacaggtttcaccatgttggtcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattaatttatttatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttggacagcacagatttagaatctgaggaaactctccatttagtataatgccatctgaagctcttaaccagttgaggctggttaaatctgaagttgatattggataatattgctattaggccaatgagagatttctttaataaagatgcaagtttatcaaacttaaatatgctagatatgaactttgggaaggcaaaaattaaattccagaaataattccaatataattaattgaacaaatatttagaaaatgttatctaggataaagaagtgtagtaaatattgtggaggactcagaggtgagtgggacttaggtgaggctgcctattttgagtcctgctggggaggccttgaaaggtcaaggagaagttcttttttttttttttttgagatggagtcttgctctgtcaccaggctggagtgcagtggcacgatctcagctcactgcaacctctgcctcccaggttcaagcgattctactgcctcagcctcccgagtagctgggactacaggtgcacgccaccacatccagctaattttttgtatttttagtggagacagggtttcaccatgttggccaggatggtcttgatctcttgaccttgtgatcctcccaccttggcctcccaatgtcctgggattacaggtgtgagccactgcgcccggccaggggaagctctttctaagggagtagcttagagcacagaatgccaactgggttatcatcaggctgtaaacagtaggatttcagtttgtgcaagcacgatggttggggctgtaacaggagaagggggagctgtttacatcaggggaacattaggttacatttggctctgacaggcaagattaattttgtctgagagaaggttgaggtgggattggaattttcccaggtatgccctgcgatgttctgctgagtttcatgtgtgttggagcaggcctctcaggccatcacagttctgggagatggactttccaaagattgggaagctggaggcagggacacctggacacagagccttcttcacccccacctgcatcccaggtgaggaggaattcttgaaaatgccgagtttgactcaccaaccaggagtatctaatgtatataaatattcctttaaacgtaagtatagtgatgagtagataagccagagtatttaaaagccacagcaaagattcagcttcctctccgctcccccgtgccccacatctgggaggaccccacctgagcttggtgttatagttggctgatgctcttaggtggaaacccaggggcaaaggacaagccacagaaacataggctgcatctgctcctactctgtacttccaccttacctgcccattaagtgctatgttcttgactaaataattcatgtatcgcagagagggaaggtatgtgttcccaccaacctctgacccatccataacccagtgtattacactgacccaggaaccagagctcacttcaccctgcttggagtcagggaactcggaacctaactgtcctgggccctctttctggtagttgggtgagtcctgagggcctgatacgtgaggtttggacaggctgggcagtaggttatggcatatcttgtaagggagaccatgtcagcagtggggagcagaatgcagaggaatcaaagacctgatctcatagtgcaggtgtgaagggagaagagccagcctttctccaccgtctctctggggacaggggactgtctcgcagggactacaccttggcatttgggcatgtcagaccaggatctagtcatcagagttacccaatgccctggggttggtttctaccaggtcaggggatgcagttctgcaggcagtatgttacatctgagactacaggagagaggggtggggtgacagtctttccatagggtgtccagacactcctggcccagggactgagccatggatagtgggatgcttgcctctctgtgtggcagggctttcgtctctgttttttgtttttgagatggagtcttgctctgttgctcaggctggagtgtagtggcgcaatcttggctcactgcaacctctgcctcctgggttcaagcaattctgcctcagcctcctgagtagctgagattacaggcacatgccaccatgcccagctaatttttgtatttttagtagagatggggttttaccatgttggccaggctggtcctgaactcctgacctcaggtgatccacctgcctcagcctcccaaagtgctgagattacaagtgtgagccaccatgcccagcctggtctctggttttgagccatgatgtcaggctgaccaggctggcacatttagcctggaatgggttaggcttctggctttgatgttaagaaaggaaactagtgccaagtgcagtggctcctgcccataatctcaagactttgggaggctaagccaggaggattgcttgagcctaggagtttgagaccagcctgggcaacatagcaagaccccacctcaaaaaaaaaaaaggtagtttggtgtggggcatgcgcctataattccagtgctttgggctgaggcactttggggagattgagactgcagtaagctatgattgtgccactgcagcccagcctggttgacagagtgagatcctgtctggaaaaaaaaagagaactggctggtccttcctgaaatagtgcccacaggctggcagagcactgactgacacctgcctctttcagaggtggggtcaggatagctgtatggaaattctccaatgtgtgggttgtaggagtgtatctcatatcccttcaagcactgccaggccagaacccagtggagtttgcaaagaatgggtttcttgttagaagaaagtattacgtacatgtaagtaatcttgggtatagctgggaagtgatgaataaatttgaccattaaaagattgtaatgtctgtatcaccaaagacaaaatcacaaatataattaaaaaacaaataacagactaggagaaaatagaccatgtgcaatacacaaaggataaatacagagtatataaagaagcttctgcatattaataagaaaacactagaataaatgggcaaaagatataaaaaggcattgacagaaagggaacaaatggccaataaatacaaagagatgcttaacttcattaataattagtgaattacacattaaagcaactagatatgattttatcccatcagattggcagaaattaaagagaataatattctttggcggcaatgagaaaaaatgggtgtactttcatattctgagcatataaattgttcagacctttttggagaaggtagtttggctgtatctttgaaaataaaatcacatacttttaatttggtaattttgtgtctagtgaaatacacctgaacacatgctcattccagcactggaatggtgaaatattggaatgattaaatgtacagtggtacagccagcatatagaatgcgatacctaaaaagtgtgtaagagtgtggtatagatctttatgcagctgatgtgggaggctctctcagatacgtttttagtgagaaaaaatataaaattattacatttatatttgtaaacctcaaaatttatatgtatttgtaaattctaaaacatgcttttcagattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagatataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggctttttatactggactgggcataccctggagcaaggctcagtggatgggaggcagaaaatagatcaaatcaaggagccttatccaatgtcattgaaaggaaaattcattgttttgggagagagctaagccctagtgggaaagagccaaaggaataaatgggcttttaaatctgaggaatttacacaaggcaggcaggagatgacctgccataggttggaggcaggctctgcttggatcctgtgtaaacagggcatagtgtgagtgtctccccataagtaaaagctgtgttgtgaagatgaactcacagtttagtagtgactttttgaccaaagatgactcttcaagaagggataaggtgtatggagtatagctcattgccaggactgtgggaggcagaggaaggagaggacacttggccaagatgccatttgagctggtcactgtaggaaagggagaatttggacatgtaattttttttttttttttaagacagagtctcactctgtcacccaggctggagtgcagtggtgtagtcttggctcaccacaacctctgcctcctgagttcaagtgattctcctgcctcagcctccccagtagctgggactacaggcacatgccagctgcctggctcattttgtatttttagtagagatggggtttcgccatgttgcccaggctagtcttgaactcctgacctcaagtgatctggcctggacatgtaatttttaaggagatattcagaagaaaagggaggtgagcccaccatttacaaatgcacacaggaggccgggtgtggtggctcacacttgtaatcccattactttgggaggctgaggcaggcagattgcttgaggctaggagtttgagaccagcctggccaacaatgcaaaatcccgtccgtactaataatataaaaaattagccgggccactgcactccagcctgagtgacagagcaagactccgtctcaaaacaaacaaacaaacaaacaaaaatacacacaggagaatgtgaggagctgagtagtacagttttctcggagtacacgtctattaaagggaagcagtaggaagtaaaatagaaaaaggtaggctagggccggaccatgaagagctgagaatgccaagtttagaaatttgaccttgagtcagtgaactcatgttttacatttaatcttttggttaccaatttttttttgtaccatcattggtttgatttttaaaatacagtcactttgttttctaaggattttatgatatatgttcaaatcttgagttaaaggtaaatagaacacagtttgggtttttttttggcatataaatggttgaatttcaaaattatatttgtgttacaaactttgtttttactctctgccttccagcatttgcaaataaccatttctctttcaaaggaaattctagtatgtattcccattcaataaaagcaaagagctgagctctatatgaataagaggtaaaattgaacatgaaaattactgagcaagattagtgggggatgaaatggatgaacattggggaaagctgtgatccttgttacctttgctatagtgcaatttggaatggcttctttattcctggcaattcctgacagcatttcttttaaacctggccacctttccattgccagctcgaccttgatgttagctggtgctgctactgcaagggctgcctttggcaggaagccttcagtcaactttctgggctctggttttggctctgcacatgccttgctgagaagaccttaagaatctgaaatgtggagggtcattttggggtagggaaatgtggtggcaactcttgagttttctgccacgatgtaacttaacagatcctcttgtttttccttaaatggtacaagggtttgcaccgaaatggtaattcatctgtgtctgtgatgctttaaaaaataacagtttcactaatgtgtcacaacatgtattatttatcattttagtaaatggatattttaacaagcaacaatttgcaaatttaagcatggcagttaacatgatctgacattaaaaaattaaataatctcctgccatctttgttatcagccttgcattaaggattttagcccttctgggagcttttatttttttgttgactctgactgatgatggcagattgtggtagtgatcagagctatgcttttataaattattttttagttggaacaatattggcatgtaacgtggactggcagaattaacattgtttatcattaccagtgttgttttgacagatattctcagttctttaaggaagcagatagggaatgtctgtaatggacatctgctgtccactataggttgcccaataatgagtcctggtaggttctaccttctgctgtggaagccagcagagttcaaatgggcattttctgttcttgcctcctaggaactgcaggggtggacatgcttcttaggcttagcctgttgactgcttccacctggagtttgaatctgaacagtgttagaaaatgcagggacaggctgagtgtggtggctcacgcctgtaatcccagcactttgggaggacaaggaaggaggatcacttgagcccaggagttcgagaccagcctgggcaaaaaagcaagacccagtctctacacaaagtaaacaaattagccaggcatggtggtgtgcacctgtagtcccagctacttgggaggctgtggtgggaagatcctttgagcctagaagtttggggttgcaatgagctatatttgccccactgcactgcagcctgggggacaaagagagaccctgtctcctataaaggcagcgacagttagtagtggcactagagttactaaaattatcaagattttcttcctggatagtcctggttgcacacatcagtgttactataggtggacttagcctttacttttgtacatttcgcactgatacctctaaccaccttttgtgcacatagcagctattataccccccatagcataaccaacctgtgtaagagaagagtataagtcagttgcttgcaaggaactcttaggggtagggagctcttgcctgggggaggtgggggtttctcctctttctgtcctcccctagtcattagagaaaggcctcaagagaataactcagagattacggttgaattcaagagggtagattgacatctcattgagctgcacagaggtaccagccaggtgctgctgtgggattagaatggactcctgagaaagcgttcttgagtgagtgtggtgtggctttcctggagtttggggatgtctgtgaatacagaggcaagtatcttcctctcatctgaaagccccccatgtggctggagctgcccctggggacagtgtatggagagaggacagcaaaaacgcttgacatttcctgtgggcctggtggtctacatggaggacagctggcctgagtctttttgaaagacttgtcctgcctgcgaaggctgcctgccagggctaggcccgcagcagaaagaggttgtgggtgaaccacagaggcaggagctgagaggagactgagagctgagtcaaagggcacccgttgcctgcatcaggcagcatggaggtcccagcaaaggggtctcactagagagagctggcatgtggactcctgcaaatggtggaagatattttacaggctgcaggactggaccacagaaaagtgggcagacctttccctttcctcacacttgccgcctttcattccttggacccctctctttttcctcactgctgttcttaggggaaaagcttgacattggataaaatgaatttggatttagactaaatagactttttaataactgaaagtttggctttatttaagataatattttctttttaaaacactgtctagaaatcagtgggtttttttttttgttttttgtttttttttaaagacagagtttcgttcttgttgcctaggctggagtgtgatgacgcaatctcagctcactgcaacctccatctctggggttcaagcgattctcctggctcagcctcccgagtagctgggattacaggcatgcaccaccacgcccagctaatttttgtatttttaatagagatggggtttcaccatattggccaggctagtcttgaactcccgatctcaggtgatctgcccacctcagcctcccaaagtgctgggattataggcatgagccaccacgcccagccaaaattagtggttttaatgttactaaatcctgaaatagctttccatgatgacaaaatcaatcaacaatctcaaccccagtagactggagtggattttagaatttagcacactttcccttatttatactctgcaggtttcaagcatacaacttgccagcaattactgtgttggctgagaaatttgaaattttactagcttgaacactaaatttgttgatgtaacatacagctaataataaaggtcacgtccccatattggcatgagggaccccttatgaattagcctgaaactttgcagcctttaatcatatttttctctcttttttcccttgagacggagtctccctctgtcgcccaggctggagtgcaatggcacgatctcggctcgctgcaacttcgcttgccgggttcaagccattctcctgcctcagcctcccaagtagctggaactataggcatgagccaccacgcccagctaattttcgtacttttagtagagacggggtttcaccatgttcaccaggctggtctcgaactcctgacctcaagtgatccacccacctcggcctccccaagtgctaggattataggcatgagccaccgtgctcggccatgttgttatttttggtttgtttgttgattatggtttaaaaaaaccacataacattaaatttaccatctttgccatttttaagtgtgtagtatggtagtgttaactgtatgcaacagttagtgcaacagatctttagagtttttttatcttgtaaaaccgaaactctgtacccaggaagcaattcctgattccctgcttctgccagcctctaccaaccaccattctactttttgttgctaagagtttgattactttcgataactcacatcagtggaataatgcagtatttgtttttttcttactggtttatttcacttagcttaatgtcctcaaggttcatccatgttgtagcatgtgacaagatttccttctttttaaggatgaataatattccattgtatggatagaccacatttgctttatctagttgtctgttggtgaacatttagggtacttctacctttcggctcctgtgaacactactgcagtgaacatgggtaagcaaaaatctctttgagatccttttggctatatacccagaaggggattgctggatcatcattctgtttttaattctttgaggagccgccaaactgttctttatagcagctacgccattttacattcccaccagcagtgcacagagattaccattgcttcatatccttatcaacacttggtttttttttttttgccattttaatgggtctgaggtgatatttcattatggttttgatttgcatttctctaatgattagtgatgttgaacatctttttatatgcttcttgcccatttgtatatcttctttggagaaatgtcttttgaagtgctttgcccattttttaattgcattagtttgttgtttttttgatttgtaggagttatttatatattccgggtattaatgccttatcagatatttggttgaaaatattttctcccattcataagttgccttttcactttgccctttaatcatattattattattattattattatggttaaaacattaattgtgtaatactgaaaagtttaggaaataatatgacagattttgatcaggtcttaaatatcttcccaataggccctatgagtaaggcataaaaagcttgaattaattccatagtttcaccaaaacgctcttcttcttaatcttattccttatttttttgaggcagagtctttctggcccaggcagcctggagtgcagtggtgcaatctcagctcactacaaccttcacttcccgggttcaagcgattctcgtgccccagccacctgcgtagctgggactacaggtgtgagctaccatgcctagctaatttttgtatttttaataaagatgaagtttcaccgtgttggccaggctggtctcgaactcttgggattcgagtgctgggattataggcatgagccaccatgcctggcccttaatcttgttcctatcaatctttccagctttaccttccccagcatgacttcctcttatccccttcctatgtccaaagattccctaaaaatattctagctctgtaccattccacacactgcttttttgttgttgttgttgttgttgtttttttttgcctgaaatatgggatatgtacctttccctcttgtttaaccttgtttttcagactccttctttttcttttcctttaaagactcagcccagatgtgaaaatgttccagtcagccagtcagctgcttttctctcctatagcctcttaggtacagcccaggttagcacacttgtctgaaagtattgtgaggacttttataaaccccctctctccaggaccatatgctgctagatcacctagcttagctttgcctttttattcctctttgtcatgggcctaccataatatctagtccataatatttgtgtactttagttttttatttatttatttatttttgagatggtggtcttactccatcacccaggctggagtacagtggcacgggatctcggctcactgcaacccccgcctcctgggttcaagctattctcctgccttagcctctgagtagccgggactacaggacacgccaccacgcccagctaatttttgtatttttagtagagatggggtttcactattttggccaggctggtctcaaactcctgacctcaagtgatccacctgccttggcctcccaaagtgctgggattacaggcatgagccacaacacccggcctatttgtgtactttaaacgattatgggtagaaagaaagagcaaatgcctttttagaaataagataacagaactttttaccaattgtgcttccaaatatgctttctcttctaattttatctgctaagattttggcagctaattgtagattttatgaacttacattgggttgcctttgtcttctgttataaaagcaataattagaggaaatgatccttttgagaggttgtttaatgaattctgcttgttttaaatgtgctgctttaaatcttatttcacgtaaactgtactaatgcccaaattatctcaccctagatcagcattgaaccaaagtattatgatgattaatttccttctgttaaatcccttatagtcttttctttggtgtgtgtgtggggtcaacaatcaaagaaagaatttattgactttacatttaatatggtttactctacttgattatattgttcaagtgtgaatttgtgtatggtataagattatgccatactgggattctattttctgttaaacaaatagctttgtgttttattaactgccagtgtttaaatttaatggtttaagatttcagagagccctttttgtaagtatttgaaagtttttattataatcctgagcctaaccttcttctggtttcactgcatccttctccagccttgaaacaagccctggcacagacgcaaatcctggcgtgcaccacctcttcctctcccccgctccccactctaacatgacaagaagtgtctgtcccagaagtaatctgattgtgcacctagagtacctgttttctgcctggggaagaatgcacactgctggacctagagcggtggcaaaagtgccctctccactgtgggggccacagtggtaggcacaacccttatccctcagccccattagttaattaagtcattttacctgcattaaactttacgggcagagaaaattcagtaagtcaccactaccaggtgactttcttttttatgttaccccctagcaaggcatgtagtttgcatcctacagaatataaaagatggggccagcatctattctgtgtcttagcagtgaacttcatccaatagatacttgatttttaaatactttcaccttgtgtcatgattaaatcactaaacaggaagtttcagcttttctttaaagaagtacatcctattaaaaatttaaatgtcttcataactgcttacgctcagtaaatgaacactaggaatctataaacaggaatctatggctctaaaaattgaaattttgggggctgtttcattctttagaacttgaaaacgccataggcaattagctataattcatttgcagattatttttgccatgttaaattaggaattttagccatagcaagcataacagacaagcacacttttaaattattttgttcagcaaaacaccataggcccttatatgtgtttgctggaatttttctttgtcaacaataaatctatatgtttctttagttaaaaaaaaaacagcaacaaagtgtttattgtagaatgtttactttttaaacaaacgtgaaaggcattggtacaaaaagggaaaagcacctaggatttggatcctcagtgggtccaggagtacagcttccttgttctgcagttactggaggcagtgtggtgaggggaaggatgtgggctttggactgagctgctgcttctacctgtgctatgactttgcacaagttaggagtagcctttttgagctttgttttctccttagaagatgactaagatcatgtttgcacatagcacatgacacaaactcatgatactggttttgttttttctaacattgtctcagtgggtcttcactgccttctttctacaattttttttttttaagggaatagggtcttactctgttgctcaaggctggagcgcagtggctgatcattgctcaccatagcctcaaattcctattcactgccctcttatatagtggataatgtgggcgttagtctcatgcagttaagagaacaggttcaaaagaagttttgaactgtctgttttattttcacaaggccagtcagtgacagagaaagaacttccacttgggtgtcctggctctgtgtcccatggttttcctactgaaatactattactgtgctatagcagaagaaagaaggctaagacagttctgtgcttacagtcaccttcagtttcaaatgtaatcatatcctgggggaggggaaatgaaactttgagtttcatctcccaaatcattcctttatttagaatcaaccggctgggcacggtggctcattcctgtaatcctagcactctgggaggctgaggtgggtggatcacttgaggtcaggagttcaaaaccagcctggccaacatggtgaaacccccgtctgtactaaaaatacaaaaaaaaaaaaaaatagccgagcatggtggcaggcacctgtaatctcagctacttgggaggctgaggcaagaaagttgcttgaacccaagaggcggaggttgcagtgagctgagattgcgccactgcactccagcctgggtgacagagcagtactccatctcaaaaaaaaaaaatagtatcaatgaattcaaagaaataaaatgtttttcatgtactcatggaaacaactatttctaaaattctaaatgaattattattattattattattattattattattattattatttgagacggagtttctttcttgtcagtcaggctagaatgcaatggcgcgatctcggctcatgcaacttctgcctcttgggttcaagggattctcctgcctcaccctccccagtagctgggattacaggcgcctgccaccatgcctggctaattttgtatatttttagtagagatggggtttcaccacgttggccaggctggtctcgaactcctgacctctggtgatccacccacnnnnnnnnnnnnnnnnnnnnaataacgtccactacatcagtgcataacgtccgtgccacacgggggaatagccaatgcgtatagttatctcctacgaatcggaccataagaatcttcagtgctcgggagtaacgtcactaacatcccgacattgtcagcaacgaccataaaagacgggacccaaactgctgtctagcacaatacgagatgccccccgccaaatacacaccgcctcaggctacgttcaaaataagggttagatgggtaatctcagatccaccgaaggcaatagagcattatattcccgcgagaggaaataacagttagaacgcgcaccgcctccaaccataattaaatcctcggcacaagggggtggtacaaaaaagggcttcggacccgtaaaaaaacaggacaaaaatggacttctaggccgccctaagcaaccaaccctcctggcgggggcaccaattcaacaagctcgtttgtcggcaacaatgtcaataaccttctttagcaaaatgaaagccttcctcatagggagaattttgccggagaagttaggtaacggggtaagtcccgatctacacccccatccacctgggttgttcgtgtctgcaagaatatatcgaccgagagccaatcaaaaaagccggacataccgtttctcacaatgctgtcatcaggggcatattcttttgaaacaggaggcatgatcaagatggccagagtcagtctccaaaacctttctcatggtagtgctagcaccttagctagtcaaagtattaggatgcaaggtatgagccaccgcgcccgacctctaaatgaatttttaaaactccagcatctcacaaatggttcttgaataatttttccttagcctgcagtgtttaagttgggttttgaaggttttgttactcaatagtcacccttttttgggtgtaagtttgtcctctactcctgagtaagtaagtgaccttagggcagtattaccatgaaacagatctcacaaataacattgataccaacatcattatttttggtcaaatgttaaatagttaaaatttgtcatcctagtctatattgaactaatttgaaataccttatatttaagcaaactttattgtttttaacatagcaaaacaattaataaaactttaaatcaattacacatgaaacagtaagaaagcagtgcaagattaaaatctctaggtaagtgttctatagtgtataagtaagttctgtagaacttcagaaaaaagagaggtcagtaggattcttagagcaaagtgtgattttatctgtactttgggtcagaataacttttctgattttttttattactaacatacctaaacacagataatgttaacattaattaagtgaccttagggcagtatcacaatgaaacatctcacaagtaacattgatactaacacaattatttttagtcaaatgttaaatatttaaaatttgtcatccttgtctatattgaactaatttaaaatatcttattgaaatatattattaattaattcatatcagacttagctagagacacctaatgttcaaaacagaaagtagaggtggattgggcccagttggctccagttgctcagaggatgtggtcagtgctgtttttgtacatcttgagctctgctcactctgtctgcgagtaggttttgcgttttgcttgttggctgtcttgttgggggtgggaaaatggctgcccataccttctgccaggtgggcaaccccaaagacttttcttttccagcgcacgtgtaggagcagcctgttggaggcatgtgcccatgctttagactgtcacccaggtcatgaggactgtggtttgaagagtgtgctcactcaactggctagggggtgagggcactgtgtttgacaactgtcaaggactagcgaggttcccagatgaaagggggtgatataccagaagaagaggcatgggtgggaaatgtgcatagcagtcccagccaatagctatcactgcctaccacatagtgctacaaaacagcgtaagaattattcattgagtgcaaatgttgggggagtgggggttaaacagagacctattctaagtgattcttgactgtttgtccaggtgtcattccttgttataggagttttaaaagcagaaaattctcaactgctcattcacctaatactccatgaaagtatatattcttgagtgtcctaagtgtgtgtcctttgaaatgtttatatatataaaagatattttaagtataaaatcttaaatatcttttacacttaaaatatcttttatattttatatttgtgcttttataagttaaaaaatgtgatcaccatgaccctctacttggatgtgacaaccctccattttataaaataattaccgttgaatcaaaatttttgctcaacgtatgctatccagttacctgtcaaagccaactgaatgaatgatgaaaaggttcagatcaaaagcaactggcttaacttcacggaggttttcatgctttaatttaaaatgtgtctatgtctaactgattatctctcacattttataaagaaatattgacgttctgtaaagtatgtagtgacctcacttctggctgtgtgggcaggtttcactgcaggcctctgaagcattgatattcctgtaacctttgaggcaagatgtgtgtgtagtgtattaatgagctgattgaagtgatgtacagtaatttcatccttgggtaaaaacagatgtgaaagattctgttttaatatttaatcagcctccaagcctctgttggcttgtttaagttgacctgacagcattatacctggaaacactttgaattaaactctgagtgcttgaccttgttcaaacagttgtaatttaataaggctgctgtcttggtggagatagtgtcgctaataggcaaatcctcttctgactgggattgttctgtttgtgagtgctggggttggagagattcagagattctcatcagtttgtggggaggaactgggatttgaagaagtaaaaacaaatctaaattaagaaagtgtcttttagaagatctttaaaaacttttattttaatttttagacatatagaagtaatgtttttaatgtcattttgattaggctcattttggttgaaaggaatggaaaatcatttgttaaaaagagagctggaaacttgtcagaaatcaaagaagtgctaggaggactgcatactcactctggctctccttgtcctcctgtccacccatccctccacccacccatccgtccctgcttttctctgtctctgtcttgggcgtcctctgcacgatagcctgtctgctctctcctttcttctgttggctccctcaatctctgtttcgtgtacttctctctagcccatagctcctctttactaatcatttctgttctctcatgccatcagtttgcaggggctcttggtagtttcagctctcttgtatcctttcagctctaagtcttgctgtcaacaagtttgtttccttgttcacgttccagttagctgggtctgaatggctctcctgatcttttttgtgccatatccaaattgcccatgctttccaaagcagggggagctgtggacaagacagtttttggcttgaaggaaagattagttggggcaaataccatgatttgcccaatataaatgcgtgtagatatatattttctggttctaagagtaccatatgcttactggggaaaaatgagaaaatttaaaaaactaataaaaatacagttaaaatctcctgtaaaccgactattcaaatagctaaactactttggtgtatttcctctgattttttttgcttgtttatacataaacataatatacacagtaaacatcccaaaattttagaatcatagtggtaacattttaaagatcttcatatctacttgttaccagtggcatctgtaggaatactctggctgtcaggcctacgttaaaaactgtggtaatttggtgtgaatcttttattaattctttccttttgactaatattaagtgtggcatcattaatcatgttatattatcttcactttggcttgcattacttatcaactcctttgagaagagttaatattattttcatatttcacagtacttgacatattgtctcatacttagtagatgttcagtatttggtctatagtttctgcttaatttttatgaaacttgatttctgtgagtgggcaaaatacattcataaggttccagctcagaagaaggaaaaagtaacaatgtatagcactaagaatattggaaaacaacggggaaatatgctaattgcttttaaacgaacagggattttggcagtattgtggtatatgaagggtctcctgtaggaagctgactggctcttctcttttaggagccctcccagggtggcattcattaccttgtcggattgccatggtccagtgtgggtagcagaatcctgagagacccccagtgaccctgccctttgtattatatcttcccctttgagtataggtggaacctatgcatgtttgagatatcacccatgattctactaccttgcttggcagagggagactatccaggtgggctgatctaatcacacaagccccttagaaaccatattctccagcaggtgggaagaaagagtgatctgaagcatgaataggatttgatgttgactgcgaagatgaaagggaccatgtgccaagcaatgtgggtagcttctagaaactgagcatggtccccagctggcagccagcaaagaaacagggacctcagtcctacaaccgctaggaaccgaattattctaacaacctaaacgagcttggaggtgaatttttcctaagagctcatggataagagcagagtctggctgacaccttgattttggctctgtgagaccctaagcagagaacccagctgagcctgactggatttctgacccactcagctgtgagctcatgaatgggtgttgttttaagccactgtttgtggcagtaagactaatatagtccagggtctggctaattcttagctttgtcagattttaacttgattttctgtggatatcaagggtggagctgtctctcaggggtagacttacaggagcctagctgaagaaactggtgtatggaatcaggaggccagcatatttatttgtttatttacctgaaaagtaaatgttccagggactgagatactccatgtggatggtcagtacattatctcccttaaggcagacctgtgtaggaggccaggtgtgtattagtgagcatggcatccaaaccatgagttagatgagcacagtttccatggcatcaaacacctgtctcacaacaaggatggccttctctatgtctggacaatgtttagatgggtactgccagcttctctggagactcactgtattagttttcaattacagtgtaacacataaccacaagttagcagcttaaaacaatgaaagtatattatctcacagtttctatgagtccaggcacaggtaactgggtcccctgctcaaggactcaccaggctgaaatcaaaatgtcagcagggatgtggtctcataagctcactggttgttggtggaattcagtgccttatggttgtaagactgaggtcctcttctcccagaggctgccctgccacatggccctctctacaatgtagcattttgcttcttcaaggtcagctggaaaatctcccacacacttttggtctttacaatctctgaccccctttaaaagcctagccctgtgtatgctcatagggagagattgtacaggggcccaaatcttgagggcattgtaaaattctgctcccacacttgctttcccctcagcatcccttgatgactggccagctttctgtttgacacctcctttctttagctgtgttaatatatccagtctttgggagtccaggcttggttggatatttcacatctctgaagtgactacatagttcttctcacattcagtatgtattgatttttaaaatttaaatttgtgaacttaatcacacctttatttctgtgatcctcccccctttagtaactggggaatgggatgaggaggaatttcttcatcttagtttcagaagtcttcacagcagtggcctctatttgtagtttgatggtctaaggagtttagattgttagagaacttctaccttcactagaattttgaagacgtaacttaaaattacacttactagatgtagaaactggggagacaaaatgagttatttgcacagttaaattattagctagtgaagaagggtttttatttcttatttatatcctgccttctctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaataaattaataagtagaaagtgttctctgagctccaggcagttgttgattgactgatggaaaaggtaggcggtaggctaatagacgatgacatccaaattcagctgttgcctctcagctgaacccaaccctgggcttctgctgccttttgctccttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaagcatttaatacgttgttgggcactagcggtggattaaggagaagagggctgtgatgggagctgtcagccccagcaggcaggagttagaattgtctggaattgccggtgtagggtgataataaaaagcaaactgactcttggtcggtttattactatttttaaattccctactgacaaggccctccctattgcctgcactctgagtggaccactccttccatccatgccttgcaatgccactgtcttgcacataagggctcaaaagtgtatgctgttgttgcccttctcacatttcggctgaggtgtatattttcattaaagaggattatgtagaaaaattggtttaataaaaatgatgagactttttaatatggtttgtacaccattaagagtgaaatatggcaaaatctggtctgaaaaataggaaaaaatatagcaataactgattaatagaaaaccataggattggctgggcacagtatctcacacctgaaatcccagcactttgggaggccgaggcaggtggatcacctgaggtcaggagttcgagaccagcctgaccaacatggtaaaaccccgtctccactaaaaatacaaaaactagctggacgtggtggtgcactcctgtaatcccagctactcaggaggctgaggcaggataattgcttgaactcaggaggcaaaggttgtggtgagccaagatcgtgccactgcactccagcctgggtgatagggactccacctcaaaaaaaaaatcttttttttccctttttatatttttgtctggatcctaaatattgggacatttgaaagatgtgcatatttagtttaagcaaattctggtggatttggttggttctctctgtagtaagagtagagaagaatggtagatgtgaaaagaatatattctgaaaagaatatgggataagagaaaatcaagaaggcaagaaaataatcatttccacccttttatctactttgaaatcaccacttttcttactttggtcttctgtttcctctataaactatgcttaagagaccagagtgagcagacttcttcgtgaaaacctgagcttgggagttgggatggtttacagtcttggcttcagtccacttttctgacttaacacccagacccctttccggctaaatttattgtctcctgttcctgctgggcctttctggagcgtccgcctctggagtgccctctgctcttgaggtcccaaactgcccatcccacacctacctggtcacagctttgcagtttaagtccccacatgccagtgactgcttcctttctggacccctttactgcatttcagcagtgctgtcaatccttcctttaaatttatgtcactggtttgtagggctcattcttccagcctgcagacgtcagttgagattccactgtgatcaaagcaggatatttaagttctgcagcgggtgggctgcaagtggtagaaatagttattttcttgccttcctgaatttctcttgttccattctcttttcaggatacattcctttcactacagagagttgtctgctctcactacaaacagaaccagccaaacccaccacgatttgcttagacataatgggcaagaactttcagaacatttggaacttttcagaacattgggtggtcttagagactagccagtacagaaatctcttgagagggtgttactgtgttccttctggacacctccagtttctgatttggctgtcctgtttgtcagcagtacatccttcatattgagcccaaaacctccattcattctggtgttcttcagtgcagtcacactgcttcgtgatggcttttcttcagtgcagtcatttgcttcatgtgacttttcttttttctttttctttttctttttctttttttctgaggcagagtttcactgttgttgcccaggctggagtgcaatggcatggtctcggctcactgcaacctcctctgcctcctgggttcaagcaattctcctacctcagcttcccaagtagctgggattacaagtgcccaccactatgcccgcctaatttttgtatttttagtagagacagggtttcacaatgttggccaggctggtctcaaactcttgacctcaggtgatgcatctgtcttggcctcccaaagtgctgggattacaggcgtgagccactgcacccagccatgatggcttttccaatgcaaaacattgcaatagttattcctttgaaccttataaaattactgattgttatgttttgaatatttgtcccctccaaaacttacattgaaatgtaatccccaatgtggcagtattgagaggtggagtctttaagaggtgattggatcaccagggctttgccttcatgaatggactaatccattcatggattactagattaatgagttaattcatgaattaatggactgatgggttatcatgggagtggacctggtggctttataagaagagtatgagagacctgaaccagcacattcagcttcttgccatgtgatgccctgcactaccatgagattctgcagattcttccccaccagtgggaaggtcccaccagatgtgaggcccctcgaacttggacttctcagtcttcataactataagaaataagttcctggccaggcacagtggctcatgcctgtaatcgcggcactttgggaggccgaggcgggcagatcacgaggtcaagagattgaaaccatcctggccaaagtggtgaaactccatctctactgaaaatgcaaaaattagctgggcatggtgctgcgtgcctgtagtcccagctactcgggaggctgatgcagaatcgcttgaacctgggaggcggaggttgcagtgagccgaaattgcactccagcctgggcaacagagccagaccccgtctcaaaaaaaaaaaaaaaaaagaaagagaaataaactccttttctttataagttgcctagtttcaggcattctgttataagcaatagaaaatgaactaagacactgatattcaattgttttagcctataaaaatgggaattttatgtgggtcaacctagtatattccccctgattctctgcttttccagctcatatacttttgtagtttagataacctcctgtcagttaaatcatgatataagttcttcgttccttttttttcctttatagtttaaaaattattttatgtgtatctttcctctggtagccccctgagacttgcttactgcaagcccacatgctgccttgactccttttccctgaatcaactgtgaattgttccgcagcttctctcctttttggtctctgaaccaaggtttcttaattagagtatccacaagtctatatgtgaagaggttgagggaaaagtaaccactggggacatgagaaatctgaaaagtaatagttagaaatggccatcttagccttattaaaatgtaagtaaggccgtgtatggtggctcacacctgtaatcccagcacgagaggccaaggtgggcagatcaccttaggtcaggagttcgagactagccttgccacaatggcgaaaccccatctctactaaaaatacaaaaattagctgggcgtggtggcatttgcctgtaatcccagctacttgggaggctgaggcaggagactcgcttgaacctgggaggtgaaggttgcagtgagctgagatcgcatcattgtactccagcctgggagacagagcaagacaacatctctaaataaataaataaatataatgtaaggcaaggccttttcccttatatctattttagggtttacccttgtgtatacagaaaaattgttccctgtccagcttattatgggctggatagcaggcagaactcctcagtttgggttagcattgcattaacagaactgccacatctttctggataatcttcctttgtgcataagctccaggctcaccttctctgcctcacagctgtgcgctggtttcccttagctttcttgggttctggatggatactggccttctgggtgagaagggggttctttggcaaaaggtgtttttgacataatttaggaccttcttaagttctacagcagacctaaatttcttcccccaagttctttgtctatatagagtactcagcactcattacccattctcagttctgaaggaaatcttatggagcagttgtagtatttatagggtaagcagagtgcccagtttccatgccccaccccaaaccatttagatttcagtcatgtatgtcaagggaggagtgagtacatttttgtggtcagctgcctcttcttttccctaacattctcactttttcatctttcctgctttcttgaggtcatttatctattgaataggatgtctattgaaaggaaaaacctcccctaatcgcctttaaactaatatttcttactgggcatggtggatcacctgaggttgacagtttgagaccagcctggccaacatggagaagccccatctctactaaaaaaaaaaaaaaaaaaatattagccaggcgtggtggcgcatgcctgtaatcccagctatttgggaggctaaggcaggagagtcgcttgaacccaggaggcggaggttgcggtgagccaagatcgtgccattgccctccagcctgggcaacaagagcgaaactccatctcaaaaaataactaaactaatatttctcttttctcaataataatggcatgaaaagaattttttctgtgccttttcaaaatcccaataccccctcgtggcatttcctatgttgaagttttcaacagccttatcaggaggagaaatgagcttaatttttgagttttagtgcttagggactctgtcttggcttctagagataacttcactgtgggcacccacaaataatatgtttaattttttttctaaaccttttgctgatggtcattgcaatattttcttgattttaatttcctgagttttcttctttcacattttttcttttttttttggtgatatttttccatattccattatctgcatccttctcactctccctgatttttcaaacatcatggactacagatctgcaacctccctggtaattcctcttgggtttgagaggaagtttgtcaagtactggaaacttgaacttgtataaaacagatgtcaccactcattttaatggaagaaggcatggagtaaatacagatagcacataacagctatatgcattctcttaaatttctttcccgatcttgggcttgaggtatttttatctaatctagtctacccttgccattttcaagatctttttctttgatacttgatagagaagtgtcttctgtatttttcttccttcttggaagaatatattttaaaaaatgtattttgagattgagtattttgtgaaacatctttcctctaaaatcctcaaagtaactttgcctctctttgatttctatgggtagtccagcggagagtgatacacataaggatatttcataaacactgcttgcattcctctgggatttgtgctcctagatgacagcatatatatgcatgtgattctgtgtgtgtaaacatgctttaaaaaatttattgaacatagttttcagctgtcttcactcactttaaaccttagtctactttctttttcttttttttttttttttgagactaagtattgctctgtagcccaggctggagtgcagtggcgcagtctcaactcactgcaacctcctccaggttcaaacgattctcctgcctcagcttcctgagtagctgggattatagttgcccaccaccatgcctggctaattttttgtatttttagtagagacagggtttcaccatgttggccaggctggtctcaaactcctgacctcaagtgatccgcctgcttcagcctcccaaagtgctgggattacaggtgtgagccactgtgcccagcctttagtctactttctgtttttacaattccatgccatgtttattgaaagcatgttgttggtttcttttgatgcctcccctgtctttcttctcatcatgattttaaaaattaatactttgtaatatttgagatttttatatctatgtcaagttaacttttcctgaaaaatattttgatacattttctagaatgttagtgtattgtgtttataacatgggggaaaatgtactgtttcatttttaaatttatttttatttatttttgttattattattttttaagaaacagggtcttgctctgttgctcaggctggagagcagtggcatgatcctggactcaaacaatcttcccacctcagctttctgagtagctaggactacatgcgtatgccaccatgcccacctaatttttaatttttttgtagagacagagttttactatattgtccagactggttttgacctcctgggctcaagggatcttcccaccttggcctcctaaagtgttaggattataggtgtgagttatcacagccaggtgcaataagtgtttatgattaatttaaaagcagatgctgtgcttttcaaaaattatgctcaattttttttttaatattacaaaggacttttagactggcttcctcctaaacatttcttcaactcctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtatttagctctctgtctgtattgtagaaagcttatttattatgtgagcattttgctttctcctatccctccctctttctttaacatcagttataacagctgtgaatacagtttataatatgagcagccatattcagtttttaggctttcaaaatcacaaatacaaaggaggatataatacatagtcctatattttatacaaattgggacacttttcttcatttcttatttcgtggcattgcctaactatagtcaagctaatgacccatgtagatgtagtgttgtacctggtgtccgtgtccctgtgaatgtgtcatgttgtgctggcctgattccccaacatcagccccagggagccagcagctggagcagctgtcatcttgtgaaagcagagtgtccttgttgctattgattgggttgttcagtcaattgcaaaaaagtggatctaactgtcaatggtagttatatgataatcctggagataaataagtgtcaagtgaagtattacttgaatttaggacttgaagagagagaaaggggtatgagtagttggaggggaagatttgctatgacaagctattattcagtgtggttattttgtatgacaggtaagtctacaggtatcttttgttagataaatcagaaattaagcattccctttgtaaactccaaacaagattttgaaacaccatggtccccccttatccacctccaagatctccagtggatgtctgaaaccactgatagtactgaagtctctatatattatgtttttcccctgtatgtaatacatacctgtgataaagtttaatttataaattaggcacaggaagaaattaacaaaaataagtaagaatagaacagttataactatatgttctattaaaagttatgtgaatttgttttctctctctctcaaaatatcctgttgtgctgtgtgttcacccatttttgagctgccgttgactgtggataacaaaccacagaaagtgaaacttcacataaagggggactactgtattctcataatgttaattgcttctagaattcacaaggattgaattcaacttgaatcttgctaaagaagtactttattattcgatgttagtccagcaacaacttatagtgtagaaatttgcccttttgagggtgaatacacaaaggggaaagaaaacttgtgtgcccacggtccactaacagataagcttctggaggccaggagtaaaccgccctgcaggggagccatctcccagggtttccccagcagagagctgtgcccagtgccggggtctcatgcttacctatttctctgtgccagtatagtagacctgttttcaagcctagcatgagccttaagtattactggctgggagtggtggctcatgcctgtaatcctagcactttgggagggtgaggcaggcggattgcctgagctcaggagtttgagaccagcctgggcaacatggtgaaaccctgtctctactaaaatacaaaaaattagccgggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccacaaaaaaaagaaaaaaaaaaaaagtattacttatttagtaagtccatagcattttgttcacacagtgtatcattgtgcttttctgtttcaaagtgtaattatttaatctagaaattttaagtcctgtgacagaaaacaaatgctgttctcacaaaatatgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgcatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggcccacacttgtagtcccagctactcgggatgctgaggcaggaggattgctggagctcagggattcaaggttgtagtgagctatgattgagccactgcactttagcttgggcaatggagcaaaaccttgtttcctttaaaaaaaaaatttattaaaacatgctcttactttggcaaaaatatatgtttcttcatagtgatgataatcataatgatacattattactatatgcagcttataagaatcagttgtctaatgtatccgtgtaagtttctctgtggttttaagaatcattccataggctgataaatgcatactctcttcaccccattgcacatccagcattctgaatttttctcacttccttgaatatgccatgttccatgcacttgtagatcttccatcacagaaggtgcctcatctgtccagaacccctgccatacctctgctccctttgtctagctaacgctcactcatcctttagatcccagtgaaatgtcacttgcatctgggaggactttctgactaggttctgagcttcctttgcattctgtttttcattgacataatgacatcacatttattagtattgtctcattgtaaaccccagtaaggcaggaactgtatctctctgtatccccaacactaccacagtgcctggtgcatgttaaattgcagttaatatttctagaatgaaagagtgcttccatccttcatcatccgtctttcagataaagaagtatctagttacctttgtcttaaattaaaacaatttcaaaaggttgcatgtgctggtggaccagttgaaatccacagctcccatattgctgctcattgccactgttattgatgccctggagatgatttaaaattcagttatgttgcttgtgatggtggtatttaaaaatctataattttggctgggcgtggtggctcatacctataatcccagctctttgggaggccaaggcaggtggatcacaaggtcaggagtttgagaatagcctggccaacagagaaaccccgcctctactaataatacaaaaattagccggtcgtggtggtgtgcacctgcaatcccagctactcaggaggctgaggcaggagaattgcttgaacccggaggcggaggttgcagtgagctgagattgtgacactgcactccagcctgggcgatagagcaagactctatcttgaagaaaataaaaaataaataaataaaatctataatttttatactcatgtgctattatagtgaccctgtgagacatcataatgccttaatgatagcttgtcttgtttttactttcacttacatctatagttccaaatgttttattgaattgtgctttatttgataattcatagttgtaaactgacctcatcccatatttgtatttttacaatctcaacagttttatcagggacatatttttatattctgtagcataatacagtgccttctgtagagcttagtttcatgtgcagtgatgtgtcagaatgaaatatctgcccagtggtattgaatttcatgtattatgatttacatattcttctgtgtatcaactggttttatattacccagagaatgcttatggtggtggttgagagttgtgtattgctattgactgtacgggccatagacatatttgtaggtatattaaatttgctttgtacttctcacacaattgatttggtgggcattcttcttaattatacttgatgggtgcatacataaattcattcttggttaaaaaaattcagatagtgtagatatggcagtggttcctttaatccctccaattatttatttaccttatatatctgggaactttgtataaaaactaaacactggcctggcacggtggctcatgcctgtcatcccagctctttgggaggcccaggcgggtggatgtcttgagctcaggagtttgagaacagcctgggcaaaatgtggcaaaaccctgtctctacaaaaaaatacaaaagtgacccaagtgtggtggtgcacacctgcagtcccaggtactcgggaggctgaggtgggaggattgcttgagcctgggaagtggaggctgcagtgaactgagatcacaccactgccctttggcctgggtgacaggccgagaccctgtctcaaaaaacctgaacacttctttgttatgtttctacaatttgacacaataattcaagtcagccaagcactttaaaaattattttgaaataattttagatttataggaaagttgtcaaaatagggtagagttaattatatataaccttatgcagtttccctgataaccacttatataaccatagcacagttataaaaaaattatcaggaaattcactggtataataccattaactaaactgtggccctttttgactttcaccggtttttcacctcctgtatttttctctgttccaggatcccatccaggatcccacattaccttcagttgttgtttctcctttatttcctgcaatctattaaagattctaatcctttctttgtctttcatgacttcagcaaacagttttagttggatgcttagtatataccagtcactgagattggtgcttgagggaagggagataaatgaatggatgagacatggcccttacctaatgaggtgagccaacacatagacaagtaatgctaaaacaatgtagtgcctttaaaaggcctttgtactatctccctagagaagagagagttgctgactcactgaataacagtgttgaggcagcattttcagaagaaatgacattgatctgggtcttaaagaatggggaaacttttccttgtggagaaatggagtggaagaggagttcatcatggacaggcaggggcatttggcatgaaagtgtgaaagactggcttgtttgcagactggcaaatcacttgataggaatggagcatagggtatgtgaagaacacagtgaggcatgaaactagaagagtagttacaaagctaccttttttcattactttttattaataaatatatcctcatatttgtagggtaagttttggcttaaattttttttaaatctcattattcatacttaatgagcatttaattgtaatcagtgtttctagttttaaactgcacaacattaagattgttactgtacttttggaaagaaaaagagaacaaataattatgcttagctgttgcaatagcatctaatagcatttaaattctgttaataaagaatatgaatttattctgtaatgcctattgggcacctattatatggcaggcactgtttgaggtgagagagatatagcagcaaagaaaagagaaaaactcctgctcttgttctaatatattctagtggtcctagttgcaatatgtttgaactaacatggtagttcagtcaacaagtcaaatgttaactgcctagcatgttatctagatgctcagcagatttttaaaaaatgaatagatatatgactgggtcttgaaggagtaaaagaatttcaggctgggcacggtggctcatgcctgtaatcacagcactttgggagaccaaggcaggcggataacctaaggtcaggagttcaggaccagcctggcccaacatggtgaaaccttgtcttttcaaaaaatacaaaaattagccaggtgtggtggtgggcccttgtaatcccagctacttgggaggctgaggcaggaaaattgcttgaacccgggaggcagaggttgcagtgagctgagattgtgctgttgcactccaacctgggtgacaagagtgaaactccatctcaaaaaagaaaagaatttcattgagtagaggtttgctggcatgagtaatttttgtttatttcatatgcattcttggagattattcttaggtagttagaacacattgaagatattatttcattgtcttttgacttcaattgtcaatctcaggtaattgtcttttccctggctgtctttaaaaatattttctctgggccgtgcatggtggctcacgcttgtaatcctagcactttgggaggctgaggcaggtggatcaccagaggtcaggagttcaagaccagcctggacaacatagcaaaaccccatctctactaaaaatatattaaaaaaatgggccaggcgtggtggcaggtgcctgtaatcccagctacttgggaggctaaagcaggagaattacctgaacctggggcatggaggttgcagtgagccaagatcgcaccacttcactccagcctgggcaaaagagcaaaactccatatctatctatctatatatatatatttttttcctctggttcttatttttgaagtttttgtacaatatatcaagatacagatttatttttatttattctgctaggtatctgaggattggtattttagttcaggaaaattcgcagccattatttcttcacatactgtttgtgcttcatcctctttttttgtttgtttttttgagatgaagtcttgctctgtcatccaggctggagtgcagtggcgtgatcatggctccactgcaacctctgcctcctgggttcaagctatcctcccacctcagcctcccgagcagctgggattacaggtgtgctccaccacgccctgctaatttttaaatttttttagtagagatgggatttcatcatgttggccaggctggtcttgaactcctgatctcaggcgatccgcccacctaggcctcccaaagtgctgggattaacaggcatgagccaccatacccagcctgcttcatcctcttttaatctcattttcagtctccaattaaacatatgttaaaatttctcactgtatgctctatgcctttaccctcttttgtgtttttcttctttttctgagctgtactcagtttactgattctctcttcaactatatctaatctgtcattagttatagaatttttatttagttatcaaatttgtcatcttttatagtttatagttccctgttaaaaccatttagtttggtttttatctctttgaatatagttaatgtcattgtttttaaatctttacctgtattttcaatatctgaagttcctgtgggtcttcttctgtagtttcttgtttctgctggttctgactcatggtgtttgttttttcctgtgcctgattacatcctggatgttgtttttgaaaaagtatttatagaaataatttgaggttgagaattttcatatgcttctgccttctgcctaggttgtacagtttaaggcctcctcaagccaagttcatgattcaggtattgtgagttgggctgcaaacctgtgtgcaggctggttacttacagttcactttccctctttgaagccccatttacaataggggttggtatccttgagaccccacctgcttaggctccagatgtcaccagaatttcacatcagctttatttcctggattggtaaatataaccccatgataaaagtggctctgagtgttgggtttacctcttggacttcctgtcctcaccaatttttgaccgaaaattcaaccctatgttgttagctctttgaattacctattctgtcctcattagaagagtgcctccagcatttattgcctaaacatgacagctgagtatttttagtttgattttttttttaacatttgctaataatacgttttcaaccagatcataaactttgtggataaggtccctgtctgctatttctttacccttctcatatagcatttaatacaatgataggtggataattggttctcttggccagttgactgatcaaggggcaattctccaaactctggtgatttctccttttcgttcgtaagactgcttttataccccaacaaagaaacttgttataatttaatagtggctgtgtccatttttcttttcttctctgctgttccatcccaaggtgggatggccccaattagactaaccactgaaaccctgggcataaaatggtgcccagggagcttttcttcatattaatttgtgtgtactctaaaaggaaagattatttggcttgctcataaatccaaaattttggtgatgaaaatatgtttataattatttcttttgagcttgatttgttgtggattttttcctttattttggtttaagatcaaatggtttcctaatgtgtatgggtcactgtagtctaaatttttttttttttttttttttttgagatggagttttgcccttgttgcccaggctggagttaaatggcgagatcttgcctcactgcaacctccacctcctggcttcaagtgattctcctgcctcatcctcctgagtagctgggattacagatgcctgccaccacgcccagctaattttgtatttttagtagagacaagattttatcatgttggccaggccggtctggaactcctgacctcaggtgatccgcctgccttgaactcccaaagtgctgggattataggcatgagccaccgtgcctggcctctaaatatttttaaagtatagatgtttttaaacttgtagctcctgagtgtgaactgtcccttgctgttttttgggcatctatcaaggcatttgttctaaccactgagtaagaaggacatcactaagggggttgtagctatacctttcttctttttatctttaattaacatgcattgactgcctggtatgttagaaacagacctgcctattacagtctcattcccttccatactcatccttgcttgtgtggctacctcccaagctaggactgcaagacccttatcactcctgcttactattggtttttgtgtccttttggcaattttctagtggctgcttgaactattggttgtcagattgacctgatttgtttcacttgtaaacaaaatgcttaagccactgttgatttttgtggcagctcagttgcttagagcaaggtgttaatgagacatcggtcataggtccaggctctgggttgactggtaagctttgctctggcccatggccacagaccctgactcccccttgccagctgtcttgcacatgtagctatggctcattatggggacacagcagggggtggagataagacaaggcaaatctgtcatctctgccagaaaagacaactcctactgataggtcagtaaccttttcattggaagaacagcacgttagtattagcttctgtagatgtgtctaactgagtctttttcttaaaataactcatgtgattgtatgggttgtctgcagcaagtttagaatactgctcacattttaaagcatgtttgaatataaggatggctttttagtttgtgaagattattgtccttaatcagggattcttaatatcattctctaaagtagaaaagtgagctttagaagtcaaatttgataaagctctagaaaacaactgcaaaattgctgttataaagaaacctgtcaaatttaggaagtgccctccaggagcccttcatcccaaccaatcctctcctaaaagaaaggaaaaaaagaagaaagatggctaggtagatggaatagtgatcagaaaaaaagaacttttctagaaaagcataccagtgtgctctttaccagagcattttagcaggtaatattttacaaaggacccagcagataattgggcaggttttttctttaggaacttagtgttgatggcctgaattaatctgactaggaatttagacatttcttcatgatatattttgagtccatagatgatctgattctaatgtgacttcagtttttaacttacatagcgttaagcaaaaggatgtgtgtgtatgtatgtgtgtttgttttacatcctaaaggtattacaggccccatggtaaactttttggctcaagtgaatccagagtttggtatatgtaacctccagtggtggttcatgaacaaacacttcatttctgtagtcatatttttttttaaagaataaaagtgagccaggtttaaaacttgttaagaaaataatagcacaggtgatacacagatgaagcaaaattgccgtggatggtctgggaatgcctgaggattgagaaacactggctgaattatacactgtggcagaagaaattataggcccttagaaacaggtagaggttattggaaagattcaagcacctaatgtttagttagaaggtaagtaagctggtttcttaagttcttgtttatttattgggtgtgggctcaggataagttagtttgaaatagatcttagagaagtaaatgcaagacaactttatcaatgagtcatgggcaaacaattctattattagaagtagtatagaaaaggagtaggagaagtagaagggaggaagtctagtattcattcatttatttattcattaattcagccactatttcttgagcacctggtgtatgtcaggcactgttgtaggcactggggacacagcagggagcaaaacagacaagtctctgccctcatgaaattcatttacatcctaatgggaagagacaaataatgtaagtgagtatatagcatgtcagctgtgagaaatgctatggagaaaaataaagcagagtaagggaattaaggagtgatgggatggggaggcattgcttttttaaatagtttgatgaggaaagacctctctaagaaagtgacatttaacttgacttctgagggaagtgagggagcattccaggcatggagaaggagtgttctagatggagggaacagcaagtgcaaagagcccttgacatgtctgagaaacagataagaggccagtgtggctggcgtggagagagaggggagagtcgtcaagtagtaagaggtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgatgaacttgatgcagagtgttagaaaaagagaagacttcaaggttattggcctgaataactggaaggatggagttatctatcactgagataaacagaggtaacagaagtaaaggggagagatggccatggtagaaggtggattacacctttaaatttttaaaacatatttttatttaaaatagccctcactccctggcccagtgcacacaaaggacctgatttgcttttaccctgagtttgtcactgtagatatcctggaatacttcgttaaaaactataaataaagtggccataatacggctcattttgttcagattctaaaaaaaaattccttcataagcagttggcttccaaatagcaatgcatgctgtcagtttggtgactaattgggttagaggttaatagcaaggcagtcctataaacatcaacgggagtggtgtatccaaatgaaagcttgcattaggcaacaattcaaagaatgagaatgactaaataccatgttacaagccaagtgaattatattaagagttttaactttgagagaaagggacgttacccctgaaataactatcttagttggatcttccctacttaatactcatagttgggttgtaaaaatgtaaaggttaccatcaaaacagcacttcttaaccatgaaattgactaactttgtaaaattagaaattctgttacttacttcctactatgctgattggacattccttcttttgccaaaagaacagaaagttggattttgtgccttctagccaagagaaccacacacctctctctctgtagaccagctaaatgcttcctactgctcggtgatgaaatcagatcatggaatcagtcagtttgctatactgaattttttttttttcagctgtgttctaattgaacctttggggaataaactaattcttaacatctgaaagtttaaaggtctgatactagaatttatggggtggtagaggagaccttttagtctctgtatccaaaccaaaatgtaaatttacttttatttattttttattttttgagaaggagtctcgcttaggctggagtgcagtgacatgatctcggctcactgcaacctctgcctcccgggttcaagcaattctccctacctcagcctcccaattagctgggattacaggtgctcttcaccacgtctggctaatttttgtattatttagtagagacagggttttgccatgttggccaggctggtcttgaactcctgacctcacgtgatccgcccacctcagcctccaaaagtgctgggattacaggcgtgagccactgagcctggccaatttctttttttattgtgggataatcattccatacttctccctcctctctagtccccacccccacccccctttttccccccacaagtgaagatgatttcctgtgctggtctaggattagttttgttacagtctgtctttataagaacatttcttttccataatccagaagcattttgtaaaacctatgcctggaaattgagtcactttttattgcttagattttcttcacagaaaaacataggttctgttggatgagtatttgttgtgaaagcaaattattaaggggtgaaaattgtctatacaagttgatgtataggaggatatctgaactggattagttgctcttttatctgtgttttcaaagctctttaatagtaactcttataacacttataacagtgttatcactattgtttgggcatcattccattctgctagactgggaattcttttataatacagtgcctgataggcatccattcattccttgaaataatgtattgagtgctcattatgtgcttgaaatagagtgtgtgcaggagccagagcagtcggcagaacagatgcagcttgtgtcgcatgtgcgtacagcccatggcagggtggggggcaggggacccagcaaacaagatacagataactgcgcagtacagtgccaatatgcacaggaacagtgactgtcccctacctacataaatgcatagacctcatatgtgtattgtgaatcctctataattgttgaatttgactttgaaattaaacacttgatattttagactagtcaaaaatgggatatgttattattttaataaaaacaccattgtatccagccgggcacagtggctcacgcctataatcctagcactttgggaagccgaggcgggcagatcacctgaggtcaggagttcaagaccagcttggccaacatggcaaaaccccgtctctactaaaaatacaaaaattagctgggtgtggtggcacacgcctgtaatcccagctacttgggaggctgaggcaggataatcacttgaaccctggaggcctaggttgcagtgagtcgagattgcaccactgcactccagcctgggcaacagactgagactctgtctcaaaaaacaacaacgacaacaaaaataacaccactgtatccatattgcctacaggagaaaatgcagatcacttattttatgtatgtgttgaatcattttaaataacctgacggaggtcctttcttgggcccatgcctctgcacatgttgggcatgttgtagttgtcgttactagcaagacacacctaccctttaagaccagtctaaatgccaccttgttccctccatgtaatctcagaacttctttaagggcaaggaccaaattacgtctgtgaaaccctagagtttgatctaccacttcacgtggaggcatgggacagaggttttgttaatgagtgaatgtatccatttaataagttccttcttcagtacactcttgagacctattctggctttcccaggaaacagctgaaggagtgacctccaatcaagtcagctctgtgtcaatccttcattttcggatgttttttcttccttttctcacagggtcataaggatcaaatgtaataatgatgtaagagttaagcgtattcaataaagggaggcagtggaatcatcacaatgttgatcatcacaatcaacattattattactgcaccactatagttccttgtaatacacagtccagaaatattatcacaaaatctcactgaggatgtcattgttctgggtttgacctagatgttgatgtaatgaacagttctctatcagttagtgtgttggcctagcacaggtgcttgacaaaggccctattcagacttctgtgcattacttcaaacccctccctttgctcccatagtatagtaatgaattaggagtcatatcttttgactggcaagggactgcctaaagcagatccctgcagattggggcctcactgtttctgtgggtataaagaacctctcgggagagcctgaatgatcaggagatctgaactggggagccatcggcccagcaggaggtgcctctgcttggccaaccagagcctgctgcaagaaaccttttttttttttttttttttggttctgacaggcttgttggggaaattgaaaatctcctgtttgaaagccagataatttaaaatcctttctgattcagaatctcagcaagtagtgaagggctaggttattgattgtgggaaatggggcagcctcaaagggctctgggctatctcagtaccccatctccctcacccctcacgcttcctcaggtttctctctcatgctagcttggaatggatggtgtatttcctacccagttgcctttgtttataagcatccaccaccgctgcagtagggtcaggaaactggcaatttcctcagtgatccttgcccttgaaccctatctcctccagcctaggaagtattcagaccaagtactcatgtgtgactctccagtgcttctggatagagaagaccctctgagctgccctaaactcgcaagagaatactccacaggcttatgtaagccaaaccagatcatgagtcagacatctgaactcatcaacaaaaagtgctccaggaaaaagaaatggtctacctggcatattattgtttgaaaatttattttaagtcaatcctctatttcattaagggtaataataatcagtctacaatgcaaaactcagggaaaagtaaatttcattttgtatagctgtaatataacattttttactctgctcaaaattcttgaaattgttaatccaactctataaattaggatatttgagtaaagtaagtatccattgtttgactgtgccagaagcaggagttaactttttctttctctggttaaaattatcacttacttgatagctaagtaattttttgaaagtctcttatatcctgatggtacactaaggccctgaagagagtataaaggtgcaagattcagtcccctctctcaagaaactagcagtatgattggatggataagatttatgcatgtgaaacagagaatgctagatattttgggtggtaatcaagtgtaatagtatgtgattttagttataagcgtgatgagtgcaggaagggagatgaaaaataaataatatttagtgaactccactactacagaataaatatttataatattttctatttcatcaggaagaacaatttgaatcactggcttaatcactggtggggggcctggtttttagtctgtgtcttaaaattcttagctcacttatgtcatttgtcatatgaactttttggagaaagaaatatttagtttttatacgtagtttttaagactttaaaggttttataaccctt

SEQ ID NO: 1275 - DNA, 6537 bp, Homo sapiens
gataatctccatttttgtcatgggactgttaaaaacgtttggaagttccaattctggtcttgatttcccagttaaagatgttctttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatactataccactcagggacagtctcgcaaaaagggacaccccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtag

SEQ ID NO: 1276 - DNA, 6222 bp, Homo sapiens
atggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatactataccactcagggacagtctcgcaaaaagggacaccccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtag

SEQ ID NO: 1277 - DNA, 32985 bp, Mus musculus
  misc_feature (1)..(2832): "n" at positions 1 thru 2832  can be any base
  misc_feature (3670)..(5514): "n" at positions 3670 thru 5514  can be any base
  misc_feature (21313)..(21608): "n" at positions 21313 thru 21608  can be any base
  misc_feature (28947)..(29113): "n" at positions 28947 thru 29113  can be any base
  misc_feature (31656)..(32985): "n" at positions 31656 thru 32985  can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttttcaacaccaataaacaagaccttctcaaggttggagttccctgcgagctgccagtcagctcccaccgggcatctgggcaccattttgtgcgctgcagccgttcagtatatacatacaaatgtcaaacatatttttgacttttcagcattaattaaaaccagggcgttatttgcatgtaataactgtttacttgttactttttatgaaactgaaatagtttacattctttcgaacatttcctgttcctgttggctcccttccccacgcacagatttctttcaaacgtagcccttaactggttgcaggttgatgggtggaaaatgtttgcttttatgaattaagctttcgttgctgctcctaattagtccccaagccccctttgtcatccccaatctctgagccctttgcaacttaattgaaggtctggccctgagtggagtgccacgggtgtagggtccaggtgatgggggcgggggcgggggcacattatagcatgtcgctagctagggaagtcggtggatggtgaaccccaggaggcattaggcactcaggattctcttcttcctccacactgctccctctcttgagaggtagcagggaaagaaaggggtgatcatgattctcttactgtggcccctctgctactaagaagtttttttgctttatttatgttgaggcagtctcacaccaggtatagtataggctggcctggaacttgttatgtagccaagattaaccccagatttttagtattggctctgcctcagtgctaggatcgcaggtgtgtgctaccgcacctaacccactgacatctcttagtgaattgtaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggagagaggcttggggggagagagctgtaggtgcgggctgatggcatcactgggcaagggataaacgcatcttgctgaagctgggaggttacagagctgaggggaggccccaggagtccagacagctccctgtgggcggggcttgtcagtcatacttcctgacccacttgagactgctgattggtcagggttgcagggtacacgtgtttcacacacctgatcaggacagccttcctacgggccccctccccctcctcccctaaccttatccccatcccccacccctgccgccagcaaccagagcccacatagtttcttgattgcgactcatggccttgtggcctggcaccatagcatggttgctaggctcttgcccagccagccacctcctgcatcttcctcttagttccctgcatcagagaaatgctcgcactgagcacctccaaggaaactggggacagctcactccacccatctttctcaaggtctcttgctcttggcccaaaacctgactccctttccagctctgtggttggttgagaaggcaaggagctgctggtgacctcagaagtggcatgtggtctgttccctggggcaggttgggaggtgggtggcagatgatgagttgtgtgtgtgaatcttgagtcctgcctggatactatgggagctgtggttacccagctcctctgtgagcctcagtctttgcatctggaaagttggtgcatttaaaatagttaatccggtctctatcatacacggggtagcatcctggggactgggggtagggtggggtggagatagggtgacactctggcccctgtgaacttagcacctaagagagagaaagtgagccagcaggcagattctgaagtgaactttgcaaagaaacttttacacaggtccaggggcaggaggcacatggagctggagaggggaacagctacatttagacactggggagggggatcatggtgaactggtggtctgtgtaacagattccacagtaagctccaacagtggttctggtgatgaccataacgttgagtttatgaggagcactgagactattcagagaaatctctaaggactgtcatgtgatctgtaaatgtctgcgtagcttgttggtgacaaggtcacaggcactgctcattagacttctgtggcttgtggcttgcactctggcttgagagaggctcttccagttaggggttggggacaatactattgcagatttttttcctgtcccagatccctggccagctctatactaagaagggccaaccacagaggccaaattgaaaatctccactctgtttgagggttttggccctggagatggaacccaggacctgaagcattctagacaaaccttctaacactgaagtcaacccccctccccctggcctctaaaatgtcacctttaaataaagtagctaggggaagtcctcattgaaaaggactacgtctgaaaaaggactctccagtacagacctagccctcagtctggagtcctggcagctaaggctccaggtatcagcctaccccaccccaccccacccccttcattgtggccctagaagcaatgaggtcagacagccactccaacttccccttcgtgcccccattggttgggaggaggagtctaggagagaaatgacctcaaaatgagaaggcagagagaagagtgtccccaaggggagtagaaaggaatctgaggccacctgccctgtgtctccccagactgtctgcagttctttttccagaaatcaagcaaatggtccctgggcctggggatgcggccgggctggctttcctaactcaaacctccaaggatagatgccttaatatttgtgtcctgggctctgctggccacctcagggaccttcttccagtgctgggtctatttcccagggtgctcggtactctcccagaagcccttgagtttggaggctcagctggctggctggcctggctgccttagccatgctcaggcgtctcctgtttctggagctagaattttcccttgagcaaagagaacaataagattgcctgtgtcctcttggagagcaggactgtgaaaactggccctcttcttagggcaccattaacatgacctgtctccagtagcctcctgggcatctctgggggccactccagagagacacaaatgcctgggcttggagtgcccagggggagttcccaagccactaacttgggttgagagtcagtccacagaggcaaagctggacgtggggaatggagcttgggtctctgtggagtcccatcttgtccccaccccacccacccaggctcatcttaaatggtaacggcgctggcctagacattggggaaacaggcagagagatgaagccctggacacagacagtgtacagcgtgataaaatgactaagatggtagaaaaaaatcaggcttgccctttgacgtacgtccctaaacctttggccttcaaggtagagtactttgaaagtacaccttcatctacttcctgcctggggaggtctctaacatggacagtagaagaaagagaaagagagaaagaggggggaaggaggggaggacagagagagacagagacagagacagagagacagagagaaaatggatcgtgagaaagaggtgaagttagaaatcagactatggtggccacatagcctatgggccacaacccatagctgcgaacaagcttcagatgcaacagttgtcaaaagtcctaaagccccaacgggaaagcctcaagaagaggagatagcgatgtgtgttggattctggcgatggatagtggccagagacagtttcagtctcactagtacaagaaaggcaaacaaaaccaagaggaattgaagatcttccgttgtgatagacagaagccggggcatttgggtgacgtgtgacctcacgtcactcctgatgaggtacgtgtcccaagagagtcaagatcggccaccacaaactcatcccgggcctctgaggtgacaccctcgctcaataccccttgtaactctctgggaggaagtttacagagaagagatgtagaaagagattttgacacatggaaggccatattttaaatggtaaagagaaaaaaaacacaaccaaaaccatattattttaaaagattttcccctctgaggaattttgaatggagacattgaagccaaacatctatctaaaaatagaacagggttctggaaataacagttgtgtctacagctcccagatcggccctctacagtgagggctgcacacaacagcaagaacttaacggtgacataagggggtggaccaatcaaagctgagacttctgccaagggaatacttagtagccattaaaaattgaagattatggagagcttgtaatggcatgaggaaagaaaacaagacgggggcctcagtggttagagtgctggctcctcttgcaggggagctgggtttgagtcccagcacacacacatggtggctcacaacaatcactaagtacagttccagggaatctgatgtcctgttctggtctttgagggtgccagatcacatgcatggtgcacatacatacatacatacatgcaggcaggcaaagtaaataaataaataaaatataaataaaaataaataaataaacaaacaagacaggtgctagaattggggaggcagagacaggtggatctcagcaagttcaaggccagcctggtttttacattgagttccaagacagccagggctacattgagagatcctgtctcaaaacccaacaaattaaaaaatgaaaagctatggatgttatcaccataacaactgtgtaaaaactgttccatccggaggagtgaaagagaaactccaaatgatggtggccgtctcagtcagtggaactgtgggtgggatttcttcttcttcttcttcttcttcttcttcttcttcttcttcttcttcttcttcttcttcttcttcttcttcttctttttgggggtggggttcgagacagggtttctctgtgtagtcctggctatcctgaactcactttgtagaccaggctggcctcgaactcagaaatctgcctgtctctgcctcccaagtgctgggattaaaggcatgcaccaccaagcccggcacttcttctttttaaataatgttttgtgttctcaatttttttccctgtaaagatcactaattgctctcaggaaaaagcacacacccatctttacctcaaaatcatatgagtccctaagtagatgatcacaaaaatatagtctcatagaatgaaggaagaaagccaaaagggccctgtgtagtcggaggacagctaaggccacacctcctgtggccttgaatgacaagcccaacagcttgaactacactctccctgccttctctctgtgatcacacgtgttggactactggcggctgggcccaggagggaggctgggggactgtgcatgcacctttcaccaattcctgccttgatttccccagggaagagtttcacgctcacaatcaccgtgttcaccaaccctacccaagtggctacctaccaccgagccatcaaggtcactgtggatggaccccgggaaccccgacgtaagtgctactgagccctagtcagggcaaagggtccaggggagaagggcaccgggggctgtacctgtagctctgtgtctccttccaagcactcaaagggtctcagtgctaaacttcagccgtctgggctcagcctcaggctctgaagggtcagcaaggagaccaagatggcccagactctctagggacagcaggaaagaggaagggcaccatggcgggcagcatttgggatgaggcttaggccagtctgctctgcaccccagctgcctctgcagtgatgaaggatgtaagggaacagctaccgagggtgccatgaaaccacatccccttctgaaagccctgcatcttcggagcccaggcacactggctacgggatccctgggcatccctgagaatagggatgcagtgagtgtacactgagcatcacctgcatttggcaattccctgtccctcagagtccgtccctcagtgtctgcagcagagggtggaatttgcacatgtactaaagaagcttttcatgatggctgagtcaaaaggtttccctgttctaggaggtgatggcccagtgtttgtggggaccagtatttgtgggggatatgctcctgcctcaggctgccagggcttgggacaggagggcagggcctgagacctctttctggtacccaggaaactcaaaggagcgtggctcgccaggtccacattagtgagagccattccagccaagagtcaggcttcgcccctcacttagtgctccagcaagtagttctttgaagggggggtggtgggaggcagagatggacaatggacttggggaagtcacgttacctcagggtcaccttctcccatgctctgaactgcaggtcttgggctgatcactttcagcctcatatttcttgtctgaaaaatgggtttgcacaagcaattgcctaggatactgatgcctaggctactgctgtgcacaggcaacagatgcatctgtacatggcaacttacagaggtgactgatgtgcagtcgcctcagccagggcctcagcgaccgaccgtgtatggccaggagacaggcactgagtgccttctctgtgaaggggcctgatctgatctgatcctggcccacagtgggtctgggagttggagggcagcatagagaggttctaagtggccaggcaatgcctgcaggtcccaagaatatcctgtgtacatctgttagccctgtgcttcttgaggcctgtgggtgaggatgtgggtcaacctgctcagggagtcctctgcacaccttgtcttggttccccaacccaccatagctcagctggccctttaaggaataagccagctgggagggagacagaacagaaagagatagatggggtcagaggctgggattgctgtgtggcctaagacacttcttatccctctctgggccttcttactagctcatttttggaacagagcagaagagaagggctattttccatgttactccaggttatcccatccttgggctgtgctaacttctgcctatggcctaactgacccagaaatcaggtctcgagttcctattctctagacccgacctgcttagtattacttggctggactcagtttccctatatacaggtggggacccccacaggcagcggcagcactgagaaacccggtatgcatagcctcatgcagtgtttccatgaactgactctaggagcatcctgcaccttggagaggtagagccactcctaagattgccttagcatctccaggcatcagtgcatctcccagaggtacaagctgagggtgtgggtctgggacttagggggatcataagagtcctgacttatcactatcatacaggaagtgtcacacacacacacacacacacacacacacacacacacacacacggctctcgggtttctgcagtttccccttcctccacttgccaacccctgtgaggtcagagcctctgtgggtggctagggctggtccagagtctgggagtatcagtcctgcatccctgagacccagctgtggcttctgtggccaggtcggtcccctctagtgccctgcagagtgtgcccagtatgcagccgggtggccagctcaggctgaggctgatatagtggcttcctccctgtgtggcctcggtctctgatggatccctttcagttaatggggactggttcaaacgcaggttgctgagctgaatccagctctgggatgggaggtggttcaggagctgggcacagcagcagtggccacagctgggggcagctaactctccaggcacagcaggtgctgctaccaaaagtgtgggacccagcttccatgcccttcgggaggctgaagggatggcctgaagcttctcttcctctaaatgcccacaaagcaatttccacaaatattttcccaggcacgggctgccatacctccagcactacccgccacctgctggtcccactctcctgggtctcacattccacaggagaaaggaggagacaggttttacagtgtccacggccctgccaaatctggtggtggcctcttcctctcttgtaccctcttcctccctccagctgctggcttctgccaggaacattcctgcctcagggcctttgcacagctgccacagcatgccagagttatgcctctgtgctggtctgcatgctccaccacaccagcgttctcttttgcctgtctgctacttgcacctggccccgaggatgcccacaggagcgtttagctgatattccttaagtaggtcaggactgagctgagtaaatcatttgttcgcttcaacaaagctaaaaggaagccatagtaggcaaagggtgggcagggtgggagggcttcctggttgaggttcagtcctgaaagggcggagggggcatagcagtgtgacctctcaggacctggtatgggcagagaaaatggcccagtgctatacctgggccttggagacaagtgaagggcggtgccatcctggcctccaggtgtggggaagctgagaacaggatgcttgggtccagagagacagccactcctggtcatcagtgcccccagagcctgggagcacccaaggaaagcctggcagatctgagagagcccgcccaagagaagggaaagggttaacctcagacctcccaactcccctaatcaggcccaggcctggaagccccagttgcagccctgggcgggagcctgctacctccctgccactggccctctgccagccagcttccctgcccagccaccactggttttcatctgctcacagggggccaattcacagcagaccaccccaggcccggcacccgcctgccatccgagcggctgatccgagtccggtgtaaatctccccacaggccgcagagcaagccgcggcagcaagcgcacagtggctgctgtgtgtgtgggttgcaggctacagggaggctgctgggaaactctggaccagcccagggtctgatggctggggactcaccttgttctcagggccctacccgactgtgcctctctctttctctctctctctctctctctctctttctctctgcactctctctctctctcgctttctccctctttctctctctgcaatctacctcctgcctctttgaggctagacatggagctggcctcttgccagccagagcccagctctcctctgtctgagtcggaggcgctctgtaggctaggcggctcactccaggttttaggatcaccttgtgacctcggccttgcgccttctctttcccgctgtgagacttgcagggggcagggcggctgagaggggaaagggagcttttcggagggttgtggccttaaggttatatgtgaggtccacccggcacagggatcccagcctcctcctgccccacctgccacagacaggaactaatcctggcagaggctcgcttggctcacgagacaccaggaagtctggcaggtggagggacccatgttagcttggttgggagcagtaatgaagtcccaactggattatttatgtatccttaggaaatctcccagtctagagccttggacccgtgtcacctgcctgtggggttcactaatggcttagctctgctcaatgggagctgttgacccaggagtgggaatcaggtcaaagcagggttgtcacctcctgtgaagttcagagcctgcggggctgtgtactgcttaggtctgactccacccttagggagaagggaggcagcgttaagctttttaatccccattttataaaaggaacagcggaaacctagtgggaatccgaaacattggcaaggctaccactgcatgatggctgtcttcaatgggtccggggccactggagtgtgctggctgaggtctgcctcccacgggcagggtcccaggcactcgctgtgatcagactccctgcttgaagcccttctccaggcatccttctccccaggaggactctattttgaccagatcatctagccctggggccaggggagggattacaataacaaccacttgacagacagggaaactgaggcccagaggaaagccagttagtctgcagtggttgtgtgcttgggactcagccctgagtttcaaagcaaggcagaacccttctggggtctgctgagaccctgtgtcctagttagggtttctgttgctttgataaaacaccatgaccacaagcaacttgggggagggggcggacttatcttacagctcttgggccacacccatcactgagggaagtcagggcaggagctgaaggctggagcctgcaggcaggagctgaagcagaggccatggagaaactgctgctgacaggcttgctcctcctcaagccagtcaggtggagtgtgtgtgacctgggagttacaactctttccttccctttactttttggtcccagtgcttgatctcagcaatagaaagtaactaagacacccagtcctgttcctctgctcatgcccctcccactgcgtgcagagagcactctgggctgggccccaacgccataaagagtctcgcaaccaggccccttcctgagatgggcttctgggagagcagcgaccagttgtcttatatcaactgtcagtccagcagtggctcttcccagcctcagtgtttccacctgtacaatgggggcgtgttggttcttgtcaggctgggtgcagcaggaggccgaagctgcctcctctctttccactgggggctggaagccagttggaccaatgcaaacttcttgtgatttttttaaatcagtgactctccaagggaggggacataggtgagcaggttgtggaggctggggggaggactaccactgaggcaggaagcacagaagggcaagacacgtgtgggtgagggagccaggcagctccatgctctcgctgtgggaaaaagaatgaaaggctttttctgcggccaccgcctccccggggcaccggccaggcatccttgcttccgttcagttctgctcccagcatgagagcctcagcctcgtggctctgagactctctggcgccctggccatgtggggtcagcagactcccctctgcccctccctggcaatggcttcgggactgcacaggcacaggaagcattcctggcggtgtcctctcttccagggagcctgccctttaccacaggagagtaatgggcaagacactgggtccctggagttagggatctgggccagcttcctagtcgccaccctggtctcagtgtcctggtgtgtcctctgcctcccctgtggtcagtgtgttaggggtggtgcttgtagctcagggtagatgtgtgatgcgtgagctccaggttatacctgttggggcccacccttgagcccacagttaccccgcgcctaccttcctgctggccataggaactgctgcaaacacagtatactgtgactcagagttcagcgggcgaggacaatgacaacaggcctgaggttttgcaccagcatccgcgtggccccattggctgccttagagctgtggttgactgagacacccagttccttgcacccaagctgactgctcagccctcagcctccgtccatccggtaggcttcctgcctgttgagatgccttggacttcatggtccctggcatctccagtagcctcagagctgccctttggcatttccactgagccagaaacaacatgagagcatcgtgaccctagccaggcatcctcagtgagccacaagcccctccttctgcccagtccctagccatcttgcctgtcttattgcagactttcaggggttgggtagttgtggggaggttggaggaggcaggccttagagtctgcagccagcgacaggtgcccccaggccacaccttccccttcactttctagagccttggagtggtgacagctgctgccaagcaaaccactggacttggctggtgcctcgtgagaggacagcagggttccctagctgttggccacctgctgaactgtgccttccgggacctcccgctcagtttctgaggcagtcctgagctagggtctgggcattgggcagagatgccagacaggaggtgtgagctcatatggacccagaaggaggcactcagatggctgtatattgaggagaggatcgagaggcagctacacccctaggaaatgtgacaggcaggctcaagggacatccaataatgttgctctctgtgtcatactagggtagctaggttggtcagggccaggtgaccagagctccctcccacagcctcacgtcctcacaggagtgcatgaactgtgggatccatggagtgtggagatctgcatgccacccctgggggcttctcccgactccttggcaacctgactgcctgagacattcttccagggagccagggtggcagtgagggcatttctgagaggctagtcgttgtccccacctcataggtgaggacactgagcttccgggattgtcactccaggagaaagtggcacagtcatacacaccctctctagaaagttccatcaatgtcgtctccctctgtggtttccattcacatgaacccaaagagcggctgagaggagaaacttgaaagccgatgggcacaggccctcactgacaaggggtctctgcagccagggctcagttctgttttagaaactcggtgtgttgtttgagaagtgaaagatgggtgactgggagtgctcgtggcacttagtgacactccaggtgtcctcgtccaggtgtcttcggccctcagcaggtgcacagccagcctgggactcctgtgtgcactgtgtctgggcagggaccagaagcctgtataccccctaataccacacctctaccctccttcctaaggcctcaaggggagacaagcttgagggtagctaggttggtcagggccaggtgaccagagctccctcccacagcctcacgtcctcacaggagtgcatgaactgtgggatccatggagtgtggagatctgcatgccacccctgggggcttctcccgactccttggcaacctgactgcctgagacattcttccaggcctgttgcctcagtattctcacctgtcagaccacgttggggaggtagttcagaggttaacatcacaacttgccggtccaatcagagctctgagtgtgatgttaagaatgaccattcttctgaggagagatcaggcagtctgaagtggcacatagctatgatccctgttctgtacagaaaatcagagttccacagagacctaagctagactccaggaagaacttcctagcaggacaaggcattatagtggctgatggactccccatgctccacagggcaccggcagaagatagaagaccagaccaaggccttccccgaccgctttggagacctgcgcatgcgtgtaacaccaagcacacccagcccccgtggctctctcagcaccacgagccacttcagcagccaggcccagaccccaatccaaggtacggaggagcagagacccttggggagcgggcagggcggtggataaggatccaggatgcagtccatctatcccaggccaagtccctggggaagatggatcccccactgtttatcggtggacagctggggcagtctgcagtctacactcgcaggtctcccgagggcttctctgtaccaggcctttgcccactccctcatcaaatgttcactgactcatgcacagtgcctgaccccgggatgagtgggaacagatgtggccatccctccctctgaagttcattagtccacggggacgcgagggcaatcctgcggtgtccatagagccatggcaactatgtccccactgtacacacagccctactacctcagctctctcacagtgaggagagatagggtgaggctatctcttcccactgctgggtgttagtcacaccagtagctttgataaaggatggcagtgctgcttagctcagtctccccatctagagtgacacaaacagagagccctggggtcagcggctgccccagtcgcacagatgaggaagctgggctgcaagcaaatctcccattggccccgcatggggcaggtgcctggccagccctatggccggcctcatacttctgttaggagccagagacaggaggctaaatgtagctggctcaggtcagtcaggggcagatgccaaaccacagaggcctgagggctagctgctgcccggtgtggtacctgtcccttctgatcaccagtgctggctcagggccactgtggcacatgattcagtagaggctgaagcaggtcggggccttctggtggctgagtctaatgtctccctggcttgtccttaggtgggcctgagagtgacctgaacattaggatcagagtgggctatatgctggtacctctgtcacctaccatctgcccttctccacactggtcattccatgggggtcaggcactgctgggaaaattattatccatgtgttctgtgcatgacacagtgtcagaggcatagtgccaccatctctccatgtgccaggaagctagcccaaggtaaggctaggccctgaccccagcatgcctgaacccatgggcttgtgagttggagatttggcatttgagccccaggccctttagataagtgttcagcatctccctcatgctcagctccaaccaggagtttgtccttatgtcaccccctcaggccagcacctacagagcctggcttagaagggatggggtctaagccagggacaccccagaggccagcaggttcctgtccattggttctcatgagagaagaatgcatgtttgctctgtcacagtgagagtgtggtatttggactgtgtgctcccaggagccggaatgagcttccacacagccctggtcctcacctagctagtatggcatggatggccagtccttctcttactgaaccctgacatgggattcttcagccaatgatagctccaaccggcgctttggtgtttaggagagggtcctggatgccctggggaagaagcaaactctcggccatcttgtcaacctgaccggttctagccctgcctcgcactggctgtgtgatcttaggcaggtcgcctaacttctctgagcctgtgttttctcatccacaaagtgaagaggctcctgtcacagagtggctttggcagactcacgcatgaagagtcacactccctggccctccctcctggtgggactcccctcaggatgccccaccacttccctcggagcctgttaacagccttgacccctagctttggacactgcaggcaatgccaagacccagggtcccccaccccaccctgctgcagacacccacaatgggggcttctcacagctcaaagggctcattcagctgtatgcagcagtcggggcaatttggagaaaataaacatttccttgagctgctagcttggcttcctgacagtggccccgacagctcagatttcctggggctgtgaagctgagcatgggcacaggagtctgaggaagctgctgagggtccgagggggcacctggggcatgtatggccccaccactctggaggggaagctgggacaatgaggacagagtcaggagggaatactggcagctccacatggcccaggctctcagctgcaggaccagagtcccactgtcccctcccaagtcttgtttggtctgcttggagagcagggtcccctgccagcaggcatctatatccagcatcctctcatcttgcagcatcctctcatcttgcagcatcctctcatcttgcagcatcctctctgcaggagatgggcatcagccatctccccctcccaggcctcaagacacactcaccagccaaggagtccccagtttttatttcagaacgctccagtggcctgcccctttgtctgttctcctcacctggcaccaagggcaacccttcatagtgacccacagccaggcccagaggcactgatgcccagagacccaaggagtgccagttacctgagggtacccgacaccctgggcagaacccaggaagtaggaggcctgagctctgattcctcaggcacaacttgatcatggccagagggcccacccagagtagtaccaaccctgctagcccaggactagggcctcccctggccttccatgcatgaaggagctgaggctgacaggccaaggctctgggccacactcgggactatgccctgacattgctgccagggtaccaggagggccctaggtcggggtttcatgttatgacaccttcatttgcctctgttgcaaaactaaacactagctggaggcacttgggggtcctgaccatcaggggtctggaattctcaagggggctccaagatagggggtgccaatcagcacacctgcttttgtgatcaggggtccccaatcccagcattcacatgggcagccacttctggggacccagagcaagggatgtgacagcaaaagatgaggcagcaagacaaatggaacaccgcagacgctgggcctggctctgtcatctgtgttttgagtttactcaatttgatctaggtccttgggaaattggtgcggagaggttaagtgacttgacaagggacacatgggagtgagagtcaaagccatggctccagaagccaccgggagagtccagctgcctccccaaagaggcagtagctatggggccagtgttgggacccaggacagggtgttctgtgaccttcatgccgctcccttgcttgggtcactgttttcccaccaatgggattagctttgcccatgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacactcacacacacacacacacacacgcacgcgcacgcgcacgcgcactggcctcagcagtaaacagagaggccttcggaagcactctggaactttcttctgcctgagtggggaatcagcctttctgtttctctgcctctggtttttcctcttccgaggccaggtacttcccagtctcacagggtccctggggactctattcacacccttgatcttgtcagctcttcaaaatgaggtgggagccctgtctggtgtctgtcctagcaggctgggaaagacacacaggaggagggagggctgtcccctctgttttgacccagagttccgctcactccagatctgcagcaaaagccctctgcacagggcacagccctgcacagcacagcctgaggaagagatccccaggaaagtcaccgcacagtacgagaaaacccacagtggtcttggtctgtgcacctgattgacaccccccttttgctgtgtgtccctaggctcctcagacctgaaccccttctccgacccccgccagtttgaccgctccttccctacgctgcagagcctcacagagagccgcttcccggaccccaggatgcactacccgggagccatgtctgccgccttcccctacagcgccacaccatcgggcaccagcctgggcagcctgagcgtggcgggcatgccggccagcagccgcttccaccacacctacctccctccgccctaccccggggccccacagagccagagcgggccctttcaggccaaccccgcgccctaccacctcttttacggcgcctcctccggctcctaccagttctccatggcagccgcgggaggtggtgagcgctcgcccacccgcatgctgacctcctgccccagcggcgcttcggtgtcagcaggcaacctcatgaaccccagcctgggccaggctgatggcgtggaagccgacggcagccacagcaactcgcccacggccctgagcacgccgggccgcatggacgaggccgtgtggcggccctactaagcaccctggagactctcgggccagccgaatccttccctccagcccgagactacaagaagaaacagactttggcctggtcccaggggccagagctggcagtggctcccagagctctgtccagccacaagtttgagcagaggatgtggggacctcccacaggacactgctccaacccaaatcaatgtcctctctagctgtgcatcccaaacccacctcttgtctccagccatgcccaggatcaattctagaatcagaggctacccctgcctgtgtggggagggcctttgctggcaagagaagctcaggctcagagatgtctggactttctctccctccctctctctctctctctctctctctctcacacacacacacacacacacacacacacacacacacactgccctggggaccatccatgcccatcaaaccaaagggaaactcaaacccctgggaaggtttcactcccctgaagagagagaggagccatatctctctttcacatacacacacacacacacacacacacacacacacacacacacacgtccccaacttgacttccccctggtcccaggccagcagcccctgatcagtcctaacttacctgaaaacaccaggccccagagcagactcatccggggtggcaggtccctaaagcaaggaaggcctcacactgtccagcatactccagcctgaattgcctactgggttctcagggggcagacaggtcctggccgaaagtcttaccatggggatcgatagggtggttagccctgcgcactaggtccagccaatctgtgctctgggccttgcctcccaggccacagtcctgctcccaacttgtttgtccctagaagcagacaactttgaaccaaaagcatctcagtcaagcatctaaaacagggggcagtctgtgtatacaagagcccacctcctgctgtgtgatgtcatcaggacacccccaccctcaccccaccaccagggtcctgacttcacattcttcacagaaggggacaagacctccaggaggccctgtggagtctctggtgaggtgtgcgatggcagagcagcatccaagcggagatcagatgtcctcttcagtctgtgggcgggcgattgtcagtgggattggttaaaaagctcttaccagagctggctggcccacggctggtttttcaaactgagtgagccccttagtgatggcctctgccttgtgcttggccttccccattgcctgcacctgaaacagccacccacatacacactctggtaggtcagggggtccccgacaatcctggacaatcctgagcagaatacctcctgttacagtgtctcttgtcccacccttactggaggaaaaaaaaaaaaaaaaaactctatctcttggaagtagctgaggtaaccttccagctccctgcacccagagggggccttctcacctcttctcaggaagcagctacgacccattgccctcctacctgcttcgctactggtccatggtacagactgttccagatcaccaagaaaggtactttcaggatcccagtgcctagcactgggtaagctaccccggacaactagccttccttatacccaaacgctggtcggtggaaatagaaagtcacccctcccccatcgcctctttctcatccctgattaacagtgaagtttgagtcttgtcgtgagtcctacagtgagcacaggcagctggggctaataaaaaaagaagaagaagaagaaaaaggagaggagagaaaaaaaacaaaaatgaaaggaaaagggtccttatttgcaaggctactttaaagtgctacttgaaagcacaggctagacagaaagcacaaggaacctagggggttgatacaatgttactgtaattgtgtgggtgggtgtcatcctttgtgacattgttaccctgaggtatactccctgcagtgagctggtcttcctgaagtgggcctgctttgcactataggctgcttgtatgtttggtttgttgtttttgtttttttgttttttttaatgcacaacttgcttgtacaggtcaactgtccatcttgggtactatttaactgtcaaacagaggaatctgtgtttgttacaataatataacagatgccttgaaggacccgcgtcaggcttctggagttgtgaaggagggtgggatctcctactcttgagcaggagagaggacattggatgtggttgagctggctgtgtggggagatgccccagtgctgaggagtctaccacccagctccttcaaggtggttacagagaacctggaaggccaccttcctggctgggctaaggccccagaatatcaggtgggccgtcaagattatactaatcctctcttccttggttgactatgttcatcgtacagaggcagaagccactgcatggtcctatctgtcacctggatgcagatttggggagggacagccaccacgttcatctcagcggagtcctccctggggtgggaacccctgttgagtgaagaccttcccagagtaagggggttttgggggatagggatccctctagagagcccctgtgagggagcaccacctctcacccatactggggtctgcttgctggaacacttgaagcagagaagacagaactgcaaatcggtcatttggagatgaggtccttctgactagcaaagagagctgtcatgccttccatggctccctggagctggtggttgccaagctgagaccatagcctgaaaattggggctgtggataatggtgtggggacctagcttgataatccccctctactcagataatccccccaccccaagcctgtgcccctgaccagatgggacatacagattttcctaagatagatgtggttctgtggtacccatttcagagttctaagatctttcccttttgtaggaccagcctaagatcaaccgccaacaagaagttcctgttttcccagcctagaccctggaccctttcctacccagtagcgccacaggattctaaccacaactaatgcaagacctgtccccaggtacacccagggtgggtcacccagcaggacccctccctgggttggaacaggaaactgtcttcacagcccacatgcttctacttggtttatctgagggtggacctgtaggtggccgctacaactgaagagcaaaacccctgactgtatttaactcctgtcacctgcatcccacttgtcaaaaggatacagactaagagatgtcccccgcttagctggaggcagctggaggaagccatgcagttaccactgaggcctgtaggggacggaagcactgacttccaggcagcagagagaaaggaacggttggtcccctcaccccaccaaatctcccccaccttaaaccccttgctttggagaggaatgtgggctgttattaggaagaactccccagcctcaggagagccgcccttgccctgcctggagtttcctcacccagcagtggcggtgacagtgacagtagcagcttcctgtctctgccctgcagagccaccctcctggtcacatgtaccagatgttagcacagtcacacacagaccttgagctcccaggccccaccagaagacagggacctggaaagaagagctgagttctgaggagaaagctttggaagccctcaggcaggctcccgcacttcccacaatcaaagggtcccacactgctcgcccaggcaggatgccagtctactgccagcccgggagccttgaggtcttcagtgtctcatttgagagtcaagggatccactgccttgaggatttgtgactggcatagtggcagatttgagggagctcccagaaaggcccccaccctgtggcaaagcctgcgatagctttaactcttgtcctgagaagtgcatatccttccgggccaccaagggaagagaagtctggatgggccgatgctgtgggacacgaggacaggggacatgaggacacaaggacaggacctgacccagacccagatctgcctccctcttaaccaacacccctccctgcccagactgcactcccacaaacggccagaaccccagcatgccttgggaagaaacagctcgcccctgcacaccacaccccagccccgagcacttcggtggctctgttcagctcagggtcataaatgaaatgagctgtcaaaggagccgagtgtaagaaccctcactggcagaaacccagacctccctcgtcccctccccatgggacccttgcagagagcggggtgagggcccatgtccccccaatatccgcttccacacctgtgtggtccaggccaggggagtctgggaagccggattccaagcttcctatttttagtttgcaactaagagtgggctgtttgttttatatatttatatccaccacagagtgcctggccgagccagccaggtctataaagggatgggcagtcatgatgctgtgggtccccgttccttgctgtgcccgccttgctggaacctaagcctccttggtgctctaatgcctgcctgccattggccacataaccctgctctgcctctgaggtcagggggacagtatcttcaaggctttggcctcaactcattccccaagtcccgccagcagatgagcgagtcacagcaaaacatagtctcaagacagacaggacagcacgagggtttggaggcggtggtgtgtcttccccctcagacaaaatggagagatgggtagatcgtaggcagacaggatggccttctccatcggggactcttgtggataaaggtattgagggtcggcttggggttgagcagaagaggactgtggtgaaggggagctggccttggtcatggggcactggggagccaagatgcggagtgtgggaaagagagtggggggccgcagagagaaacttgctagcaggtctcccattggtctgagcacaggaagaagctgtgattcaggaagagctagattacggacgatgacttcctagatgcctctaaccctgatgtcacaggaaggactccatgccctttgagtttggacaggctcccattgtgtggtcctggttgacttggaactttgctatgttgaccaagctggcctcgaactcatagagatccacttgcctctgcctccagagtgcttggatcaaaagcatgtgccactgagccagaccagggtggaatggagcttaacggagccgttggaacagtgttttaggagtagacactgttactgctcagttagccctttggggatttccctagccccatctcagtttcttcatgataagcctctgaccaaagccaaggattctgtgtccctcagtctgatccagccacaccagatgctccccgctgcctgcagatgcagatgcagaggttatgagaggaaaggcacaagttccccgtgttaacgtattacatttgagaacccccccccctttttaagttaggagctcatgtagcccaggctagcactgaacttctgctcgccctgctcccgctcccaaattctgagattatgggtttgaaccacacctgctaaatggtgctttttaaagtgacattatataaccctcaatcacggaaggaaaaccaaacaaaacagggcaatacagattcctaaaaggaacgtaagaaagttgaactggtaattgcgccctctttgaaagtgaccactgtgaacatttgggggttttcctcacatttaaacctttgtcttttattaaatattttagtactcttagaaacaaacatctttctagtcatttacactgtgcattgtttaccaatgtagttttaaaactagagcaagagccgggcgtggtggtgcacgcctttaatcccagcacttgggaagcagaggcaggaggatttctgagttcgaggccagcctggtctacagagtgagttccaggacagccagggcaaccctgtctcaaaaaaacaaaaacaaaaacaaaaacctagagcaagagtcgggtgtagtggctcatctcacccgctcagcactcaggaggcagagacaggtagatcgctgtgggtctgtagccagcctggccacagagtgagttcctgtttcccatagatcaagtctcaaagtcaaaagggagtccctccagagggttaatgccagccccaaggggaaacaaggccattttcattcttctgtgctgtgccttccatgacataattttactataaaaaccatcatcagaggagaaaggggaagtagaaatgagaaaaatgtcctttcttaaaagcagaagcgggaagaactcaaggctggggatgaggctgcacagaggagcacttctcagtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccctacccgctactcctcctcacaaacaagacagaggtgctcagacctgtactttcagcacctgggaggcagaggcaggaggatcaggagaacaaggtcatctccagcactagtgagttccagaccagcctgggctacacgaaatcctgtctcaaaaaagaaaaggagagaaaagataaatagatagatagagatatataaataaatagatgatagataggtatgtaagtaggtaggtgggtggatggatggatggatggatgggtagatagacagatagatatgacagacagacagacagacagacagacagacagacagacagacagacagagaagaaaggctgtttatagccctttcactttagagaacggcttgttttcctggttgtatatgtatgtgtgcatatgtggagaggtatgcatgagtgtgcatgcttgtgtgtatgcacatatgtatgtgtgcctgtgtgtgtggaggcatatgtgtttgcccatttgtgtgcgtgtgtgcatttatgtatatgtatgtatacacacatgtgcctatgtatgtgagatgccggctgaaccttccacctggctgtgtgtacagtgctatcttgtgtacggcgtggtgtctccccagctttgtgtcctgggaacctcaggatgtgtcctgacttggaaacagggtcatggctgatgcctttggtcaaggtgaggccatgatgagctagagcaggcgttgtccaagtgacagagtcagcatcaatgctgtcatttgccgtgctggaaaacacggacattcatgcacacaaacacacattaaattaaaataggcaaaattttttaatgatatcagttttttctaactatagattcaatgcgatcccaatcaagatgcaagtatattgttggagatgttgcaaactgactctaatgtttatacagtgttacaaaagcaaaaacaaaaaacccaggacagccagtgcagtattgacaggaaagagcaaagttgaagcatacatacagattgcttaaagtaattcttttgttttggtttggtttgttttggtttgtttcggtttggtttggtctttttcaagatagggtttctctgtgtagccctggctgtcttggaactcactttgtagatcaggctggcctcgaactcagaaatccgcttgcctctgcctcccgagtgctgggactaaaggtgtgtaccaccacgcccagtctgcttaaagtaattcttaaccactcttttaaaataaaaatgggaattcaacaatttttaaagagcagttttcgggtcatagcaaaactgagaggaggactatatagcaatcacacacacacacacacacacacacacacacacacacacacgagctcctcctccaacatcaatacagcattatcatttagaggcatgaccaccatagccacacaactgtccctgctgaagaaccaacaaggacagagcacttctgtccaaagtccttgcctgttccgtgtctgagagtttgctctcggttggcccttctgtgggtttgcacagatgacaaagatgtgtcaaatctctgtgagccagccactccacccttcaccaccttcagcactcagcccctgaccccctgacccctgaccccactcaatgcgatgatagttttcgtttcctagaacgtcacatacttctgacacctcacattatttagcctttctagacttagtaatatggaattaaggtgttcccatcctgcaggaattggttctcctgttccactatgctggtcctggggacggaactcacgtcatcaggcttggcagaggtgcctctacctgctaagctaccttgctatccacccctgctgtctgcttgtttataagaaaaattcattatgcccactgcgagggaactattggataggtggtttctcgttcttttcatggcttgatagtttgttttgttttagtgctgaagagcatttcactttctgaatacaccagattttctatgcattcacctgctaaggaacattgcagttgattcctggactgtgacaattgttattaaagctgctgtgaacatccatgggccacttttatgtatgtatctaagtattttactttttggagtgactaacaagggaatgaatgaatgaatggatgaatgaatgaatgaatgaatgaatgagactgtggcttgcatatgtcatcagtccaacatgtaccaatgcatgttataatacagatgaactgttgggagccgcgcccacattcgccgttacaagatggcgctgacagctgtgttctaagtggtaaacaaataatctgcgcatgtgccgagggtgtgctctgccttccccgtgacgtcaactcggccgatgggctgcagccaatcagggagtgacacgtcctaggcgaaggagaattctccttaatagggacggggtttcgttctctctctctcttgcttcttacactcttgctcctggaagatgtaagcaataaagttttgccgcagaagattctgggtttgttgcgtctttcctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1278 - DNA, 1855 bp, Mus musculus
cccgccccgaggcccggggtactaaccccgcgcgggcggccgcgtcgccgccacttgattctctaggatccgggctggggccgcggccgccgagtccgtggggcggccgcgcgcgccggatgcgggactagcgggcgcgcggccgaccgtcggggcgcaccccctcccccggcgccgcccctccccccaccccccacgctggccgggccccgagccgccgccttcccgcctcccgcttcccgcggctgcggccgcccgcgccctgacggccgcggcatgcgtattcccgtagacccgagcaccagccgccgcttcactcccccctccacggccttcccctgcggcggcggcggcggcggcaagatgggcgagaacagcggcgcgctaagcgcgcaggcgaccgcgggccccggcggccgcacccggcccgaagtgcgctcgatggtggacgtgctggccgaccacgcgggagagctcgtgcgcaccgacagccccaacttcctctgctccgtgctgccctcgcactggcgctgcaacaagacgctgccggtcgccttcaaggtggtggccctgggggatgtgccggatggaacggtggtgaccgtgatggccggcaatgatgagaactactccgccgagctgcgcaacgcttccgctgtcatgaagaaccaagtggccaggttcaacgaccttcgattcgtgggccgcagtgggcgagggaagagtttcacgctcacaatcaccgtgttcaccaaccctacccaagtggctacctaccaccgagccatcaaggtcactgtggatggaccccgggaaccccgacggcaccggcagaagatagaagaccagaccaaggccttccccgaccgctttggagacctgcgcatgcgtgtaacaccaagcacacccagcccccgtggctctctcagcaccacgagccacttcagcagccagcccaagaccccaatccaaggcttcttaaacctgaaccccttctccgacccccgccagtttgaccgctccttccctacgctgcagagcctcacagagagccgcttcccggaccccaggatgcactacccgggagccatgtctgccgccttcccctacagcgccacaccatcgggcaccagcctgggcagcctgagcgtggcgggcatgccggccagcagccgcttccaccacacctacctccctccgccctaccccggggccccacagagccagagcgggccctttcaggccaaccccgcgccctaccacctcttttacggcgcctcctccggctcctaccagttctccatggcagccgcgggaggtggtgagcgctcgcccacccgcatgctgacctcctgccccagcggcgcttcggtgtcagcaggcaacctcatgaaccccagcctgggccaggctgatggcgtggaagccgacggcagccacagcaactcgcccacggccctgagcacgccgggccgcatggacgaggccgtgtggcggccctactaagcaccctggagactctcgggccagccgaatccttccctccagcccgagactacaagaagaaacagactttggcctggtcccaggggccagagctggcagtggctcccagagctctgtccagccacaagtttgagcagaggatgtggggacctcccacaggacactgctccaacccaaatcaatgtcctctctagctgtgcatcccaaacccacctcttgtctccagccatgcccaggatcaattctagaatcagaggctacccctgcctgtgtggggagggcctttgctggcaagagaagctcaggctcagagatgtctggactttctctccctccctctctctctctc

SEQ ID NO: 1279 - DNA, 1230 bp, Mus musculus
atgcgtattcccgtagacccgagcaccagccgccgcttcactcccccctccacggccttcccctgcggcggcggcggcggcggcaagatgggcgagaacagcggcgcgctaagcgcgcaggcgaccgcgggccccggcggccgcacccggcccgaagtgcgctcgatggtggacgtgctggccgaccacgcgggagagctcgtgcgcaccgacagccccaacttcctctgctccgtgctgccctcgcactggcgctgcaacaagacgctgccggtcgccttcaaggtggtggccctgggggatgtgccggatggaacggtggtgaccgtgatggccggcaatgatgagaactactccgccgagctgcgcaacgcttccgctgtcatgaagaaccaagtggccaggttcaacgaccttcgattcgtgggccgcagtgggcgagggaagagtttcacgctcacaatcaccgtgttcaccaaccctacccaagtggctacctaccaccgagccatcaaggtcactgtggatggaccccgggaaccccgacggcaccggcagaagatagaagaccagaccaaggccttccccgaccgctttggagacctgcgcatgcgtgtaacaccaagcacacccagcccccgtggctctctcagcaccacgagccacttcagcagccagcccaagaccccaatccaaggcttcttaaacctgaaccccttctccgacccccgccagtttgaccgctccttccctacgctgcagagcctcacagagagccgcttcccggaccccaggatgcactacccgggagccatgtctgccgccttcccctacagcgccacaccatcgggcaccagcctgggcagcctgagcgtggcgggcatgccggccagcagccgcttccaccacacctacctccctccgccctaccccggggccccacagagccagagcgggccctttcaggccaaccccgcgccctaccacctcttttacggcgcctcctccggctcctaccagttctccatggcagccgcgggaggtggtgagcgctcgcccacccgcatgctgacctcctgccccagcggcgcttcggtgtcagcaggcaacctcatgaaccccagcctgggccaggctgatggcgtggaagccgacggcagccacagcaactcgcccacggccctgagcacgccgggccgcatggacgaggccgtgtggcggccctactaa

SEQ ID NO: 1280 - DNA, 23107 bp, Homo sapiens
caaggggatgctgccaggcgaaacaagatggtgcttgtcagctgcttagacgctgccgtggaggaagcacccagcaagcatctgctgccgttttgatgatttccactcctgctggcgactgctttaaaggacagccctagcctgcagaggtgtgatggggatctactgtgggagaaggggggcttcctggaggaggggctcctggactgggcttcacaggacagaaagcattgctggcagaggctgtcctgagctgaggctctgaagagtggggggcagagaatattcaagaaatactgggaacagcagcagcaggaagaagtggtagtgggtgggccctggggccagcagccctgccttcttttctttctggggcccctctgaccagcggctgatctttgctaccttaaatcagggactttcaaaaggaaggggcctcagtgagcagactgtgcagaggggaaactgaggcgtagcaggactgggcccaaggtgacggagtgggttagagccagagctccccacgcagctcttgctctgggtaaccgaatgaaagaggctttttctgaagaccatcttctttcctcaggcactggaacttctgtcctattcccagtgtgagagccctggccctgtggctctgagactctctggcgccctggccacgtggggccgccttggctcccctctcccctccctggcagtggctccagcgttccacagtaacaaggaagctatttccgaagtgctgttggactcccctcctccgggaagtctgccctacggagggcaagggagcatgtggtgggagcgtgggttccggggtcagattacctgacccacagcctgggtcccggaacaggcgctcagcgtcggtctcatggtgaagcctcggtggccccgtctaaacaatgggaacaaaagggaaagtgtcaggaaaagagccctgggcttggagtcgggggatccgggtgtgaatcctgccttgctgctcaggctctgtgttcctcacacgacttcagcatcctggcctccacaccccggtctccagcatggggatgatagttctgcttcctttgggcatgagcagagataaaagcgatggtcatgatggtggtgacccacgtgactggaaagtgtccacaccttaggccagcacctcaacccacaaagacagtgtgatggggacaccgcagctcggggtgggggaaaggagtgtgacttgagtgaggccaccagactgcaagtgacaggacccgtcctcgaacccaggctggctgtcaaccccgccctcttccgccaggccgcaggagtaactgtaaacactctttgtacatggtgtgactcagaaacaggggactttattctcctgtgacgaaagtaacaaggcctgaggttttgcaccagccctattggctcccttcaagcttgtggctgactaaaacacccagatcctttgcactcaggctgttgtcggatcagtctgtggtccccacgtccacccggcaggcttcatgcctgttaagattcttctgctcacttgtcccccagctcatccacatctccctgccatttccagtggcctcaggagcaaggacaacatttcctccaaggcctgttagggctgaggactcggtctggaattggaagctctggccgtactgggcctgccctcctcagggtagcagtcaggtgctttccacaaggcatctcctccccatccgctccaggccccacccatcccacttgcctcgttcacgtgacttgccccatccccatgggcatctgagtttgcagccccagctccagctaaactcgcccccagcccatgttttcccctttgttgccaagggccctgggaggcagcagtgggggcctggccagagaccaaatggtcttattcctgccaccaagtgtcccatggattcctggtctggggcctcattggaggagaaggtggggctccctggttcttggtgactggctgagcccctgtggctcccaggccccctgctttctttctgaggctcccagatacctgtttgagcttccaacagggatgcgtagggagcttgggggcctacaagtaccagaatccattgcgttcccattctgaaaatcagaaatcaggcccatgcgaggcctcgggctctgtcccctcatgccctacagtggtcgacaggcttttcccacttttcgagtccccagcaatcacttgttcaggccccaaaaagcgcagtgagttctgttttacctcccacctacatcttgcctcttctccctctgccaaactagaaaacgcacatgtcattctagacccaaggccttaggcaaaccttctcctcccccttaccccctcccacatttttttttttttttttttttgagatggaatcttgctctgtcacctaggctggagtgcagtggtgtgatcttggctcactgcaacctccgcctcccgggttcaagcgattctcctgcctcagcctcccaagtagttgggatcataggcgcccgccaccacgcccggctaatttttgtacttttagtagagacggggtttcaccatattggtcaggctggtttcaaactcctgacctcactcaggtgatccgcccgcctcggcttcccaaagcgctgggattacaggcgtagccaccatgcctagcctccatcttttctaaagggtcccaggtccaggaaatcccaccccttgttcggcgtgtggcctccaacaagcttcctcgcctctccgcagttgcagttctcttacttgtaaaagagggcctggccaccctgcctgactggcagcctcccaccaagtcacgtgaggtagaatggccgtgaccgtgttagggttgatcagccgaaccctggagtgcacagtcctccaagggagccgtcctttcctcgggtcagccctggagaagctgcagccactagggggtgcgaacagggacgttcccgggagtgttgcatgtaagggaactaaaggggaagcttgagaaggactgaaatgtgggtggagaggactgcggagtgaactgtgcctccagtggccagcaggaaagagggagagcagcgtcattctcgccatgcttgttgaatcccttccgtagcagggaggatccccagggttttatgggaactccgtcatttctgtggggctggattactgtccccattttgcagatagggaaactgagtttgagctccaaggtgtgctactaagaaagcaagttacagaatgacacacccggactgaggctgttcaagagagttccatgagaagcctactttgcgttttccattcatggaagatgaaaaatgtctggaaagaaactggtcacggtggggactctggagaggagcttagagcggtggacagagccttatctgtaatgcttttatttttgtaaatattcacgtgttgcttgtgaaatgtaaaattagtaattaaaaaagtgtgtgtggcgggggaggtccctgcaagcttgatatcactccagaagtgtccctcggcctcagcaggccgcaggagggtgggagcctggccaccttgaccctcccagcacctctgagtcctcggatgtgaggctgggattcttcctgtgtgggctctggcagatagggagtggaaaatgctggcagttttctccaggtgtgacatctcgtcccctgaccccagcttccaggcagagatggctgtctagtccctcatgcaagccccctacacctctgcccagcatcctggtggagttatttttctgcctgaggcccagagagaagaaggcatgttctggggatcccagagtgacttagggctggaaaagcctgcagtcccctcctggggccacctcccattgttcttgtagacatgggagacagtgtgcaaggcaggctgggatgctgggaggcagagggtggcagtgctcctgggttatctccctgcctcccttgggggcatgagccactttctcatgtctgttgcctcagtttcctttttttagatctagggtccttgttccgttgcccagactgggatgcagtggtacaatcagctcactgcagcctccacctcctgggctcaagtgatcctcctgcctcagtcatcccagtagctgggactacaggcttgtgccaccccacctggctaagtttttcttttttcttttttttttttaatttttgtacagacaggggtctcgatagttgcccaggctgatctcaaactcctgggttcaactgatcctcccatctcagtctcccaaagtgctgagattataggcgtaagccactgcacctggccctcagtttcctcttctgccaaacagtgtgttgtagaggtttggatcaccgtgtgtcgtagaggtttggatcaccacatgtcgtagaggtttggatcaccgcgtgtcgtagaggttcagatcaccgcgtgtcatagaggttcagatcaccgcgtgtcgtagaggttcggatcaccgcgtgtcgtagagcttcggatcaccgcgtgtcgtagaggttcggatcaccgcgtgtcatagaggtttggatcaccgcgtgtcgtagaggttcggatcaccgcgtgtcgtagaggttcggatcaccgtgtgtcgtagaggttcggatcaccgcgtgtggttgaggttcggatcaccgcgtgttgtagaggtttagatcaccgcgtgttgtagaggtttagatcaccgcgtgtggttgaggtttagatcaccgcgtgttgtagaggtttacatcacagtgtgttgtagaggtttagatcaccgcgtgttgtagaggtttacatcacagtgtgttgtagaggtttagatcaccgtgtgttgtagaggtttagatcaccgtgtgttgtagaggtttggatcaccgtgtgttgtagaggtttagatcaccgcgtgttgtagaggtttacatcacagtgtgttgtagaggtttagatcaccgcgtgttgtagaggtttagatcaccgcgtgttgtagaggtttagatcaccgcgtgttgtagaggtttggatcaccgtgtgttgtagaggtttagatatgtggggtggcacataacgaccattctctgttcagaaagtcttttgacaacctctgtgaagaggctggcggtgacctcagggttctcccagcagaggcctaaggtcagacctcaggaagaacttcccagcagagtgaggcatttctgtctccactgagactctggggaagcaacggctgatgggcttcctgtgctctgcagggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggtacggcacggagggaggggctgcagcggggtgaggtgggggtggagggcctcgatgtggtccaatctgccccagaccaaaagcctgtccgaagatcagtcactgcacccccttgttttgtagaggagctgctggtgctcattggcacctgcagacggttcctgtgggctttctgtgtgctagccatcattcgttcactcagcaaacactgacattactgacacatgcctggtgcctggccccagggatctgcataccaggagttcactgtgcctggggaaatggggttaaccccatagtgcccctattaaaattggggcatgacttgtccaaggagccgtgacagactcgcccctgccatgtacagtttccccacccctgccccacagcctgcgatttttcatctgaaagtggattggggcggatgcctccacccagggctgggatgacattcaaatgacattactgtactcacacaaactttgcacactgttaagtgacattccaaccctagagaggcacatagcattcctgggaaaggtctcccaccctgcccagagcatcctcccaaacaggaggagctgaggtggaagggaagaccgagctggggtctccatctccactgcctagacggatacagcaagcacagttgcagccaggcctcaggcaggtcttctggagtatcgaggtgcctggcgcatagtagccgctcactaaacggctgccggctgcatctctcctctgttctctcagtcagtgagctggggacatgggaggctgtgtgcacagccggcccttgggctaagtggggtgccaagggtgcttggtggccgggtggacagaggcaggcagctggctgccgtcacggactgtgcccattctttctcaattccccagagcctggttagaaccccttggcagatgaatgaattgagaggcctaagaggttcagagccaccctcgggtcacacagcccatctgtgaccaggtccacagtctccacagtacctgctcccaagaactttctgtacttctgaggggacagataaaggggcctggaacagggctgccaaccggtctgcctgccccacccccttttccggtgccacgctgaggtgggggccgactgggtctctctactgacattgttccaggcatagtgctgcagccaggggctggatgcaggccttcagtgtgaagagaggacccctccccttctggcctgggctcaggacttttggccttggtcctgctgagacgccaaggttgggagaagccccaggcccagcctctctgagcccaggagctagtgcatttgagactctcagctctcgagcccaggagttggaggtctgctctcaagaggtagcggaaggagccctgcacgctgtgctcacgcccacccctgccgcgtagctgcctctgcttctgctacccatgggccagcatctgtcgaggtgcagtagcctgagagccagcctttctctgccatggacagagccaggccaggggatcggggctcagcgggggagccagaatccaggaggtggggtgaacagtggcttcctgtccaccagcccccatggaaggagagcccacatctgcccatccactgctgggtgggcacagcttgggaatcaatgcctggccccacggcaggcacagctgctgcttccatcctgggctgggaggaaaggagcccagcctgtgtggggcagtggctgacttctgcttctctgcctgctccctcctgaggcctggcccagtccctcgctagccccccacagcactgggccacaggcagccaggcatctccatcctcaggcccatcccctttgggtgagagaaagggcctcggatgaccaggacagggcgagcatgaactctgcagtcagctggaccaggctaggaattcaggctctgccaggcattggctgtatgatcttagacaagtcacttaaactcagcctcagttttctcatctgtgaagtggggagaaggaggtccctgacaaagaggggttgctggcagacctaggcttgggaagtcactctcacaggccctcctccctctgccctcggactccctcctggggatcccccttgggacaccccaccaccacttccctcggtgcctgttaagtgctttgaccctccaatattggtcactggcaagcagtgcagagaccccagcacctcccataccccagccccagcccccagccgcagccgcccacaatgggggcttctcacagctgaaagggctcattcagccaccatgcagcagcccggacaatctggagaagaaaataaacatttctttccactgttgggattggccactcgacagtgccccgggcagctcgggtttcctggggctgcgaggccgcagggtgggggtacaggagctccaaggaagctgctggggggtctgagggagtgctgagggcaggtacttcccccaccaccccggaggaggggtggtggccctgaggaaagaggctggaggggatggtggcaggtccagggaggcccagcccagcgccctgcagcccgcgtgagctctgaggggcacagtcctgccgttgtatcctgcggtccccatttgtttccttcgtcttgagaatggggttcccatcaggcggccagcacccacttccaccccacccatctcagctgtgctgacgtgcccagcacctgcaacaggacctctccccccgaggggctccccagatgaaaactggcagccaggtgcctcggaggctctcggcctcaaggggccgggacagccaagtgacctactagggaacatcccagatgtcccagaaggcccccgccacccagactgctgtccccacatcttcttaccttaagccaggagcatcactccgttcggatccacgcccagggccagagtacgctgctgagggaaacataccccagctgacttgggaagaccccaaagccccgagaagttccaagtcccagccgaagtcacacacacctcaggctcatagctctccgtcctcagccaagcctcggcgtggcaggcagagcccactccggctagcaccggcccttatcctttggtgggtgacacagaggggttgctgggctggacagactgcacctctggaccactgctgggggctcatccacctcccccggctgccagagtagaagggaggccctgcaccagggcctcaacttggcagggccctgaatgagccagttctcctgggtacccagagtaagagacaccacagccacagtggccttgcaaagcctcatggacccctgctctgtgcccagtgccattctaagtactcgatgtgaattaactgaatcctgatgaactgttatcgtctcatgttttatatggggaaactgatgcgcagagaggttaagtgacttgcccaaggacacaaagctagtaagtgtccaaaccaggataactgtccggctccagaagccacacagtaagccttgatcctgtgctgcctcaaagacgggacagctccctctcaagtacgtgttggggctcaggaccagaggccctaggattgtgtgccaggtccaatgtgctgtgtgaccctgagggaagtgcctcaccctgtctgggcctcagtttccccatcaagggtgttagactcaatccctgagcccctttgaatgctgaggttttgggggtctgtgatgacaaaagttggggacagaggatggaacacccttgccttggagcccattgagaagccacattcctgggggagcaggggcagagtctgggctggacactgtgaccaggttggggtctgggtccccaagtttgtctgactgctgtctcactttgctgccaaggcaggttagggtggcatccagtcactgtgtggccacgagtcggctccagagacacaggcccagggtgaggtggaggccagagctcctgtgaactcagtgcccacaacccaggtgtgagcgcacagaacctccgcgtgctgcacctgggcaggagaggcacgtgtgtccccagcagaggccttgtgatgagaaccagtcctttctctgccacagagactcagtcttgctctctctctgcctccattttcttgtcttcaaaagcgggttccaactcccagtctcacacggtcattggagccctttacacatccacggccttcccagctgttaacatgggccggtggggagaggaacctgcctgggcagggctgctgggaggcctgagctgactctgccctcagccccaccaccgcatcctaggcctctcctctgcgaggctgggaaggaggatttaaaaagaagaatagaccccctcctctgttctgttgctgctgtgggggggctcccatggcccctcttggcccggggcacgctccaaccagcttcccggcaggtctgtgttcggagtcctggcgggggaggccccgggcagcctagggcaggaagaggagagccaggtctagaactaggggtcccccagatgggccttgggaaccagagcccaaggtcattcttcaggaagccctcctggggttgtctcgagctggaactgacctcttccctgctgtcctccaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgtggaaggagtccagtgcccggtttctagggctatgcatggaggtggggtggggtgggggagaggatggagacctcctgctgttgcccaggaggaacaggaacagagacacccagcaccttcatctccttgcttccaacttcttcaggaatggccgcagagaccaccctggccacaggacagccggtgaggcctgctcctgtatggctgggaccccaggagagcatcaaataggtcttcaaagtgccacaacccttccaccaatcatgagcgggctgtgagtcttcccagccgtgttgggaggaattcctatgcctgttcctcagattcacatttcgggagggggcagaggcagagggagagtccaagtgccttggtgagaacccccctctgaggctcgtgtttcaagatctgtggcaagctagcagcagtggggattgggagtaagcggcaacttcagtgcccccattttgcagatgagacaactgcggtgcaaagaaggagtgtcatcaaggtccatgtctccctggggttgtccatggctgaactgggaccacagcccaacaatggtagcatgggtgtgatggtgtggggacctggcttgacagcccccctcccaccttgccagcaaggaggcctggtccacttgggatttgtaccaacacacagcccagagcctggccagttgggatttgtgaagggaaatttttacaaaacagaccttatttttgagtgatgcccaccgacttcaaaaaccactcccaaagctttgccctgctcagtttggttggtctgcctgaaactcagctcccaacaagaagcttccatttccctagcccggcatccccttttacccaaaagacagcaggtccatctctggacaggacctcagccgtggctacagaacttctctgttggtctgctctgggcagcctctgccagggttggtcctgaaacggcatctacatggccaaaactgtttctatttatttggggtcactttgtaggggatggtagcactcctcaccaggcacactttggtgccacagcagatcggagaggagctgtgccctccagagttcctgactcaaatctccatcacctgcaccctagcaggcacgaaccagcacacccagcttgccaaggggaaactcaaggtcccgagaagtctcagcttgcctgaggtcccagggctgcgggaggaagtgctgcagtagccacagcagcctgcaggtggcaatagggggcggcatccctgggcagcaggtggagagagtggacatcatcccctttggacaagggtgaggagaggctgccttggttacagcaagaattcaggtaaggtattaagaagaacttcccaacctcaggtgactcattcccgaaagggccagctaaaggtcttgatgtggggaaggttttcccttcccgagccgtgtggcagtgggaggtccctgtccctctctgagtctccctttttggtcatacgctgaatgagcaccggccgtgtgccaggtgtggagtaggaccccacaccccataatcgtctgctttgggacagggtgtacctggcttgaaggcagggttgactttcatagttttacaaccctggcctcctggaccctgggcccagccccacccatgtcccctgagccaccagcaagagcttaggtcatgtagaagccagttcagattgaggaagccatttagttccacagcctgggagcccctggactccagaattccgctttggaggctctaggagtcctgttgatctgggctggactttgagtccctccagtttcttcagcccccacagcttgaggttggcccagatgggcccaatgatggacccagagagccggctgtggcctgggggctcccagaagtggcctcctgtggggtgaagtggcccagatggacccgccttgccggcccctaggagcagccctgccactgttgggctgtggccatggggatggctttggcttttacactgagcaatggatgtcctggcagtgaggctacaggccagagatgacacattcccacgttagggcctggtgagggcttgaggagatggcgcggggtggggccagtgccgtgtgtaggggagggcagggctggatgcagacccagccctgcctccctcctcagccccggcctctcctctgctccagactgcacccccgcataaatgcagccccccagcatggcccagagggcagctctcagctgcaccaaacaacccagcctggccacgtgagtagagaatacacctcagtgggtcggttcattttggggtcgtaaatgaaatgagctgtcaaatgggacgggggcaggagggaggccagagtgaaagaatgaactgttcctggcagaaatccaaaatgcccctcattcctccccatgagggctccagagctgggaggggtgaggggccacatcgccccgacatccgcagccacacctgtgtggtccagtggctggggaagcctggggagccggatcccgcgcttcctatttttagttttgcagctaagagtgcgctgtgtgttttatatatttatattcacccacagaaagggcctgccctgggcctggcccaggggacctatcatgggaaggggagtgcggcagccctggagccggcctggactaccctcctttgtgcccaccctgacggctggcagcaatgtgggctctctggtgtccaaacacaccatttgggccacaccaccccactcagctcattgggctgggtgtctttgaggccttggccagaattcattcactcattcaccagacacagagccccaccccaccctcaggtgccagacaccaagaacaaggtgaacaagtcacagccatggcctcagggatctcacagggcagacagacaggaaagcaggttgtgccagcccagtgtggatcagggcaaacaagccaagctcctcagagaaaatgtctctcccccgagatcagatggaaagatgagtaggaatggatcaagcagagatgtggcaggagggaatcccatgtgcaaaggcctggagaaccaggtgtcgctgagctgggaggatggtggggcaagtggcgcaatggtgatgggaggtgggagaggatccatgtcaggggtcagtggcacgggggagccaagcggagatgtatgtgttggatgggagcaccatcatggtgcggactggggatgagggtccagagacctgttcacaggctactaaaatagtccaggcaaaggagaagcctgtgcagaatgacagagggaggagctaagaggtatcttagacatcattagcaccaaagtcacaggaagggcaccatgccccaaacctcaggtttgaatgtctctcaatctctcagggttagtggcatttcatgtgccactgggggcaaggtcttaacaatagtctttattatcacccagttggcaattgccccctccctctccaccacttcacaagtgaagccttatgtcctgcctcagtttccttatagaaccatgtgaccataccagaggccacatgcagcctctcctctcagacttgtgggtccaggacgctcagagtccggccaagctaccccactctccttcatggtctgaaaatataaagattatgagactctccatctgcggttcctgagttctatatattacattttaagtaatatttttagtttttatttttagacagggtctcactctgtcacccagactggagtgcattgcagcctccaactcctgggctcaagtgatcctccctcctgccttggcctctcaaggagctagaactacaggtgtgcaccaccacacctggctaattttttttttagaggcagggcctcgttacgtttcccaggctggcctcaaactcttggcctcaagcaaaccttccaccttggcctcccaaagtgtcgggattacaggatgagccaccatgcccagactaaatgacatttttaaatgacacaaactaatatataatcatgagagggaaagtagacagtccggattaccaacaaacacacgagaaaaatgagccataatccccccctccaaagataaccactgttaatatttttaggcttttctcccccattcagatctttatttcctataaatatataaatactttttagaaataaacatttttctagccagacacacactgcgtatacaggttatcaattaatatagttaaaaatagagataaaattaatccagaatgaaatcaatgcaaagatgggattatggctgttttctgttttcttctttacagttttctaaaattagcacacttgttcagggtatagcatatcaaattctagacataaatgtccaagcagaggagttcaaaatcatgcaaggactacctcatctgtcattagctgaaacaccacctcttccaggtagccttccctgataccctcatactaggtttgatgccttctctttatctctggaataataaaaataataataataatagttaatacttactctgtgccaggcactattctaaatatttcaccattttttaacccagcccattgaggtatgtattatcattctccccatcttacagatgaaaaaaaactgagaaacaggttgggtgcggtagctcctgcctgtaatcccagcactttgggaggctgaggcaggaggatcacctgaggtcaggagttcgagaccagcctggccaacatagtgaaaccccatctctactaaaaatacaaaaattagccaggcatggtggcacatgcctgtaatcccagctactcaagaggctgaggcaggagaatcacttgaatccaggaggcagaggttgcagtgagctgagtttgtgccactgcactccagcctggacaacagagtgagattccatctgaaaacaaaacaaaacaaaactgagaaacaaggacagaattccacctgatcctgacgaaggcagagcagtcgctgaaaatattaagtttcctaccaactaaaagtattggaggctcaaagtaagaatcaagttgactttaagaaaaaaaaaatatgacatttctacacatacttgcttataaagattgatcaagggggaggaaaaaaagaaaaagaaatgagaaaatgtctttttaaaaaaacagaggccctttctctgcgtctgagagggatgcctctacctttctgagttgtgattctaagatttcacaaagcatgaaatcaaaaaacagaagtcactgtgactgtctctgaatctgtctggaaacccccagcccattcttccccgcccaaggcggggaacttcatgaacgaggcctccccggagctaggtccgagcctcttcatggcaggctcacccccctacccaaatatgcccacagtgggaatatctgcccaggcatcagtcttgccccgccacaaacaggttctatttctttttccatgaaaacaactccgtcctaaatcactgacgcctgaaattaggaaaatacaaggcctatattataataaaactattttaacacagtggggccccttcggtggtgggagcggtggccaaagactctgcagccccttccatttgtagcccctggaaatgctcagagggatgagaaatttggttttcattagcggcgaatgtgaggagctctgtcgctctgaatggacctttgattctggctggtggtggactctttccagggcctggtgagttttgttttgttttgttttgttttcatataaaatgggctaggcccttccagcttatatctccctgtactacatgagaattgggcaacgccccactctcttgacttctaaagtcaacagctggggccggcaggagaggcacccaggaccattcgcctttattgactctgaggttttattaaaaatgttatgtttccttgaggcctgtgccagacccaacaagcagactggccagtgagcagctggcagaggccagggggtttgcactgcctggaagacaacccaccttgacctgccttctcccactccagtgacccccagaaatggcctctgccttggaatctccacagaaaaccctatttcttcccctctactttgagcaaaagaacattggcctgctcttttattcattcaacacacattggttaggcatctactacagtggcgggtgcttgggatgcagctgcaaacaagtcacacaatgtccttattcccctggagcctacaccctaattggggagaaaggccataaacgaataaatagatcacatggctacagacagtaatcagtacacaaaaaaataaaacaggagaatatgatggaggaagactgggagttggaaggcatcattagataagatggtcagggaaggtctctcagaggagctgactgtggactacataaacatagccaggcatagtccagtttcacccactgtaccagttgtggcatcttgactacagcagatcaacactgtctctggaatttggtatgcagctaccaatttggtaaatcctttcttcctgatatccaacagcagagaggcactagagcagtttacatggcagggacagcagagcaccttcatggtccagcctcaggactccctcactccatcctccatcatggtatcatttaattgactctctgttccacatggctggggaggcctcacagtcatggcagaagacaaaggaagagcaaaggtgactgttgctatgttttaccaaagagactggtggcattttgaacttgagagagatgatttagggcatctggtgggagaaatttctaggcagcaaagtgttcaagaggtgacttgggtactgttaaaagcattcagttttattcattcacaaagatatggtttggagttggaacttatgtttaatggggaagcagagcataaaagtttggaaaagttgcagcctgatgatgcaatagataagaaaaatccatattctgaggagaaattcaagcctgctgcagaaatttgcataagtaatgaggagccaaatgttaatcgccaagacaatggggaaaatgtctccagggcataacagagactttgtggcagcccctcccatcacaggcccagaggcttagaaggacaaaatggcttcatgggctggggtccagagccccactgctctgtgcagcctagggacttggtgccctgcatcccagttgctctagtcatatctaaaaggggccaaggtacagctcaggctgtggcttcagaggtggaagccccaagccttggcagcttccatgtggtattgtgcctgtgggtgcacagaagtcaagaattgaggtttgggaacctctgcttagatttcagaggatgtaactggatgtctaggcagaagtttgctgcaggggtgaggccctcatggagaacctctgctagggcagtgcagaaaagaaatgtggggttgaagcccccacatagagtccccactggggtgctgcctagtggagctgtgagaaagggccatcatcctccagacctcagaatggtagacccaccaacaggttgcactgtgcatctggaaaagccatagatactcaacgccagcctgtgaaattagccaggagggaggctctaccccatgaagccacaggggcagagctgcccaagaccatgggaacccacctcttgcatcagtgtgacctggatgtgagacatggagtcaaaggagatcattttggaactttaatatttgactgccccactggattttggacttgcatggggcctgtagtccctttgttttggccaatttctcccatttggaacagctgtatttacccaatccctgtacccccattttatccaggaagtaactaacttgcttttgattttacaggtgcataggcagaagggatttaccttgtttcagatgagactttggactgtgaacttttgagttcatgctgaaatgagttaagactttgagggactgttggaatggcatgattgattttgaaatgtgatgacataagatttgggaggggctagggagggaatgatatgttttggctgtatcctcacccaaatctcatcttgaattgtagctcccataattcccatacgttgtgggagggacccagtgggagctaattgaatcatggaggtggtttccctcatactgttcttgtgatattgaataaatctcacgagattttataaggagtttcccctttaacttagctctcatcctctcttgcctgccaccatgtaagacattccttgctcttctaccatgattgtgaggcctcccctgccatgggaactgtgagtcaattaaacctctttcctttataaattacccagtctcgagtatgcctttattagcagcgtgagaatagactaatacacccaaggaatctcttaggtcaggtttccctagaagcagatcaagaggtggggatttttgtggggaggactttcaggggaagtggaaagagggaagcaggacacagcagagaaagaaagttaatctatgacatccctgggctggaggccagcctcattctggtctcatgagggcctttggagcattaattacagcactgacttgtcccctccagatagcagactttttgtgtcctcaggtaagtcagttggcaagacttgccacacccccaaaggagcataacctccatggtgagatgtctactgtttggcagagagcaattctccagagaagggggcagatgtgagcagtttgcagccaatgctcacacaatgttaacatgacggacctgggtggtagcgtggggtgtcaagatgatcaaggacactgcagtggatgctgtgggtgagcctctcaacagacccccttcactggacagttgctcccatgctcctgctgctctaaacctaaggaggaaaaatggcaagaacccaagatgctttaataaaatatatggctgggcacagtggcttacgcttgtaatcccagcactttgggaggctgaggtgggtggatcacctgaggtgaggcgttcgaggccagcctggtcaacatggtgaaaccctgtctctactaaaaatacaaaaattagccatgcatggtggcgggcacctgtcatcccagctacttgggaggctgaggcaggagaatggtttgaacccaggagttggaggtttcagtgagccaagatcgtgccactgcactccagcctgggtgacagagtgagactccatctcaaaacaaaacaaaacaaaaatgtatgcacaccagagagtggaagataaagcctctgaaaattcagggtcccccgtattgatgaagatcttaaggaacctgtgatctgaggcatgccaagccatcccctctcagaaaaaaagacaagttgctgcatttgcacctctaccatacagtaggatgaaaaagcacccccccaccccaccacgaagatatgtccatgtcctaatttccagaacctatggggatattaccttatttggaaaacggatctttgcagatgtaattcagttaaggatctcaagatggggaggtaatcttggatgatgcaggcaggtcctaaatgtaatggcaaatgtccttataagagacatacagaacagaggcacatagggaagaggaggaggccatgtgaccacagatgcagattggagtgatgcagccacaagccaaggaatgtctggagccaagagaagcaggaagaggcaatacacgggcctcgtgtattgcccgtgtcagccctgccaacatcttggtttcagacttctgatctccccagctgcgagaaactgtccttctgttgttttatgcccaccttctttgttctccttgaatttcaaagcagcatataccacacttgggaatgctactctgacctatttattaggcaattcagaaagctttcagttctgagacaaagcaaaagagaacgctgcataggtccaagctgcagtgtgagctgc

SEQ ID NO: 1281 - DNA, 3809 bp, Homo sapiens
gccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacggtcccaggcccagagaagatgagtctatggcatcaggttcttaaaccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagcgcagctcagctgcactgcgttccgaggtgaagtcttgcccctgaattttgcaaaatgggaaagtgggcgcttgccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgta

SEQ ID NO: 1282 - DNA, 1248 bp, Homo sapiens
atgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactga

SEQ ID NO: 1283 - DNA, 94381 bp, Mus musculus
  misc_feature (2681)..(2700): "n" at positions 2681 thru 2700  can be any base
  misc_feature (11224)..(11290): "n" at positions 11224 thru 11290  can be any base
  misc_feature (28032)..(28051): "n" at positions 28032 thru 28051  can be any base
  misc_feature (37054)..(37178): "n" at positions 37054 thru 37178  can be any base
  misc_feature (44115)..(45641): "n" at positions 44115 thru 45641  can be any base
  misc_feature (47999)..(48255): "n" at positions 47999 thru 48255  can be any base
  misc_feature (59012)..(62394): "n" at positions 59012 thru 62394  can be any base
  misc_feature (63574)..(63720): "n" at positions 63574 thru 63720  can be any base
  misc_feature (70645)..(70664): "n" at positions 70645 thru 70664  can be any base
  misc_feature (85078)..(85097): "n" at positions 85078 thru 85097  can be any base
  misc_feature (93428)..(93447): "n" at positions 93428 thru 93447  can be any base
caaaggtttttctgagggaaacgtggaggtaaaatggagtggccaattatacaggcccttaatgaagccaacttttcaataacccaccaacaggttcccgaggaagaatagcaattttctgtatgcactcgtgatcctgcacagcagccagagacccaagatttgccgcagagtgaggctggttgtagccattcaatgcctcttcaggttgggttttgtggttgttgtatgttttaaaggcggctacgttgacaattgtctgaacctcaggatacagtatacctataatggtccacttatcgtactaaactgcgtctctgataaatttataggacatgggccctctttctttctttctttctctttttctttttctttctctttttcttcttctctttctctttttcatagtcgggtaggggcagtgaagtttgtctgccctttgcacagaagggaaccccgtgtcgtttgaagtgtggtatgtcagcagctcggattccacgggagaataaaaacatgttcttcaaaggtgtcatgccaggttaattttattcatttgtaattcgcaccccagtgaagacaaccacgagcacactttaacagcccccatattttcagaggagattttttttctcttattcaaagatttttgtatatctgcttgtttcttgtttggagggggaagcctgctatctgcatgagccctggctttggcaaattttatctagtcttcagggtgtttcataacagaaaaatagagtcaactgttcagtcttggggttcagtcctgggagctggcccgagagacttggaaagattaggattcgatggttagatgcacccttcagcttaactccaaaggacccagcagctcttccttggccagaggaaagatcagcattcgatgatgcatttgacagtaatttcaggtgaaatggatccatgtaaaacagtctacttacggactccagtttcctacagcagcaaggaggttttgaacgcctaatcacacttgattcctgatcgatcctcctcacctttatccatccattttgcactctctgtcgcttgctgtgataaaatactttccaaagtaaactttcagtaccatttgcttttggttaagggtaaaaatgcctgatgctccaagccgcgcctagcgcttctcgtcagctagggggcgctcgctgcccgtgtcatggctgcggtgccttggccgctgtgcctgggaacccgcgtccatcagcacatccggctgcggcggctgcaacagcagcggctgcagtttgtgtcgctgcaaaaatgtcttaagcgtgaagttgtaatattgattttcctgcagagatttgtgcaggacaaaatgagaatataagtttgagaaatctattttcaagccattggcatcgatttgtaaacccctccttacctggcaggtggggaggcggttttttcttttcctccaatttccttttctttttaaacaattaaaattgttattcctgaatgagtgtttttctcccccttggtctgtccatggtcttgacattctaaacattttgttttgttgcttaagcattcacagtccacctagggagtctgggaagagctgtcatcattttaggggtggcccatcttagtgttccccgggggtggggtgggggaccactgtgaattgttgctgaaggggtcgtggacccaagacaacctgatagatggtgatcctttcggctccgatttgataacagccctcaatcccatcttctccaccgcgagtccacggaactaagggtgcaagcaccctttccctaacgatatagcataattcaaacagtgcgggtgattttgtttgcaagcagtgtgtgcttgctggggccagtgcgccttgcacctcagagagttcccttcatagatggatgtcacgatgctccaccgctcccccaaacatgtgatttagtgccgggggatatgtatgtgttgatggtggggtttctagatctacgatgtcttagctttagagtttgtgagatgcacagacagcgcagtgaactggagtcgtctgcgcgagttcagtggataagctgaagagcttgccctgacacaggaaagtgctttattctaacctgaaagagaaataaattaggtcagacaaaagccttagctgtcatcggctggaggaagagggccagccatttatctgatggtgtctctacttcatttaatgtttgcgtctggccagttgtaagcataccgtggaggcaaacacagggtaactatgaggaatataggacctcgcaatcttgggtctgggcaacggtttgtagcctacagagaactgttttttgtttgtttgtttgtttgcttgctttgttttgcttgcttgtttttaattcagtttatgggaagccccaatcatttgccttggaatttggggtccttcccatactgtgattacacaccaacacagacattcaattcgttaaaaaaaaaattatcaggggtgataggacagccggcagctagacgttttcctttgagagcctcttttttcatgaaggaaggactctttggctgcctggttgggcctttcttttagcttaaactctccaaggattttggtccccaagttaatgctgatgtcacatctggggaggagaggtgaaaaatgaactctttttttgggnnnnnnnnnnnnnnnnnnnntgcttggttttcccgggatgtgctgaaaaaaaaaatggctggaagcaggctgtcagctgggcatagctctgtgccctccctcatcaggagctagggagagagggggaacacagcagcctcttggttcctgtcagaatggtgctagattgtgagcagagctgtgttccggggactctggatggtgttttgacatatgcaagtcttttgtgtagttgctgatattctagaattttgttctctctctctctctttctctctctctctctccctctctttcattcttcgtggcagctgataatttgcttgggtgtggaattagccagctcgaactatttactgcaatgcaatgccagaccacacaaaattaagtaacttcaaagtaaaaaaaaaagagggtaaaaaaaaatcctctgttttgctgtaactttttacgaccttgttctagtgaactgctaaactacaaatacatttgtgatccacgctaagaggccttgtagaacagcatgctgagggacttaagaaagcaagtgccaatattacttccattaagaagtactcagacaggggcactgctgcaaacgaaagaagaccaagttggagtcatgtttaaatttctaccctggagagaggaggtgtgggaaggagccattgcccttgtaggcttcttgctgtctgagtatctggatccccgtagagacaacctatctccgctgtacccatggaaatcctccccctgtatctttgaaaacccaaaatgttaaacaaaacaaatgctctcatttggccacagagaacgctcttatatcaaatcattgccagccctgttgtggctctgaagatggaaggcacttgcagtgtcatgggcaaatgtgtttaaaaggtgttctaccgttgatggtttttttttttttttaatcctcccttccttattttcaaaaggcagctgttttatttatcaaagccgattgattcattgattcattctcatttgtcccgggcgtaggttttcattttaactttttggtatggtgagggtctatgagaatgcctgagtgtaaattaccttattccttctttagtctcttcttagttttgaggggatctagcctcctgaaccgtgtttgtgtgcagtgggagggaggggcttggactaatcctgtagagcattttagaagatgtttagaggctgttcttaatcagtctgactttcccccaaggtgaggctgttatagggcagtctgtgcggacaggggtcccctgtctgctgtccccatcacaggatttccctacctagagtcaatcaaccaaggctgtataagtgaggatactcctgtagccaggacgtcttcaaggctcagaaactccctacctccaggctgactaggttctatcatgccccacattggtcatgtcagccccaatcctggtcagtttcccagaggagaaacccactctgtcctcacgtcccgacctgactgatttctctccgtctttattccacttgtcagaaatggggaaggtttcaggttgggtgtggtggcgcacgcctttaatcctagcactcaggaggcagaggcacgtggatctctgagttcgaggccaccctggtctacagggctagctccaggatagccagggctacatagagagaccctgtcttgacaaacaaacaaatggacgaacaaacaaaaaaatgtaaaaatttcaatttgagtagtgtgtacacataaagcaggcagggtggcagcctggagtgtgtgtgtgtgtgtgtgtgtgtgtgtgtgtgtgtgtgtccctattcctccagggaggtggcttctggagggtcttaggggaatgcagggaagtgacacctgggacttgcaggacttctaaaccctctgagcgagctgatggcctgtgcagatgtggtgggttagaatgtataggtcttgtactggaccttgttatttaggtccttggaggaccctgctggggacctaaccctttgtggccccaaagggacaatcctctcagcatgcgcctcattctggcttccatctcctctctgggcacttcattatcccctcaggtggagaacttcataaaacctctcttcgtcgtcgtcctagcgccttgcgtcatccagccgtagatcattttttttccccaagaactgactcttgctttctcccagtcagccctcccccagcccccatggcgattattttcccttggatctaataaattaaaaattgatgggagctcagaaagtgtgctctgccgggtgccgtgtaggtggtgttactgttgctgtgtctcttggtgtcttggcccctcctgagtgtccacccagaatagaacaagaggctccctatgcatgggctagctggccaagtctctagcttcctgggtagccggcataaagtctccagtcagaggaggcagagctcggtggatgctgaacatttcttgtaaacatgcatgcacattgtgatgggggctgtgacgctggcagtacactgttttagcaacctgtccctcacccccaatccttccttactgtctcctcctaccttattgaaacagtactaaccgtgagttagctattaagaatagagatttggaattgaccagaggcaaaggggagacaggagtccatgatgtaccatgtctgcagcaatgtgtgtgtgtgtggtgtctgtttgtgtgtctgtgtctatatatgtgtgtatgtctgcagcaatgtgagtgtaggagtgtgtgtggtgtgtgcctgcagccatgtgcgtgcaggacttgtgtgtgtgtgtgtgtgtgtgtagcagtgcacacaccccatggcctgaggacagctcatcttttggctggaattccctgaggggcaggtgcaagatagttgttgatggaccagggcaggcagggtcctaggatctgtgtgacagagggactttcaggctaggtaatgccctctgatggaggtttggtggctgcttggctgagccagtgtgaacagctcctctccatttctgtcttctgtcccaaattccttcccagcggagctgagactggggaagtttgccttaggatcaagggatcctcttccacttaacagtgatgcctattattatttgtgaagcctgatttcattgcctctaaatgcgtttaaccagctgggaggaggcccagccttgtaaataaaatgtggttttgttgtaaaagaaaatctaactcttctctctctctctctctccctctctctgtatttgtgtgtatgtatgtatatatatttgctcacgtgccttaaatttaatatttgaaaaccctctccaatcctgtggtctcttacatttgagcaagttgccggctgcatccgtccattcattttcctcctaatgagtcaaacatcttagcaactgctgcccctgttctgatcgaggtgtgttgagggtagtcatggtttgcaggctgcctgacgcttggagcttttcaggaaagcacgtatcttttcaggggaacgcttttcggccttacttgttaaggctgaatttacaggatgaggttgagggagggggccagtatctagagtttgagcttggaatggctgcattcatctgtctcttctctctgtgtgcgtttgggactttctgcctgtgtaagcagtggctggatcctccgaggttgattcggagctgggagatgcaagtgtctgggccagacgtacatcttcagttcagggcaggcaagcagggttcccagagggacagactccttgtactcaggtcttggccaacaggctctgtcccttttctttcttccattattggtacagttcttagaagggacacacagacacacagacacacacacacacatgcacacacattacatgcccagcccatatctgcctgccagcggaaatgaaaccacagcctttggtgtgtctctgagagcctctccctgagctgccaggcccagtcagctgcctggtccatctactctaacacagaagttggggttcagtgggactctgctgcccgagtgaaggtggggaggggggcgttgaccttgccaccttcttcaggagagaatcattagcaacagggacccacacatggcctgggggcggggagaggaaagcccatgcttgacattggcagggccagcctgatgtcacaggcaagcgttttgcttttaacatgggaagagggaggggaggtagtttttacgtttctcctgatttcttttcctcctaactcctttagtagtggaagcccagatctacgttctgagctaagcgtgagctggcacagcttgtctgtctgtctgtctgtctgtctgtgtgcctgcctgcctggagggctttgggtactccagttggcttgcctctaaagggaaccccagcactgcagtgttataaacagtattggagaccttcaaacccaattactggggctcccagggcttactgcaggagggtagtgaaaagacagaccgacagagagaagatagacagacagacagacagatacataaccagatattacagaggaaagaatgctggtttggagtgagtcctggtcagaggaggagtggagctggaaggatactgtggacagtcatatatggcctttactgatctttatactggtctgtgtttctttggagttacaacatggatttgaagttttgtggcctgaaacctcctcacagggaggaggatggagctcatactatgagaactgtccaggtgggtaggcgtgactgaaaaggccaaaaataatgatattattaataataatgatataataatatcaataatatcaataatattagtagtaaggaaggcagactcaattaacaggcgaaatggagccctttgctgtggaaagagagctacactggctggagatgtgggtttattatttttatcaaaggctgtaaggagcagaggccttgccaggcctgctcgaggcgggcagtggatccctcccagggatagcacccctccctgcttagtttgaattctcaatttcaatttcagtttgccccccgcccatccccattttgttttgcttctcagtttatttcctttgtccctttttgtttcttttctgaccaaacaatattttgacacccttctcctatgtctcagtcggtgttcttcctttcctgtgtgccgggcgggcacaatgcatctgtatatttctggaggactctttgcgcagtcctctcctttggctctgaaattatgtatatgtaattggtaattaaaggtgcaagcttttcaatataaacagtattgctcaatgttagattattaaagggagaggaggcaccgaataattaccttttccgtcctgacaagcggtttacgggaaatccagtctctccctcgaaccttcagcttgaaggttgtgattacattttaaccatggcagggtggcttttcataagataaatcggtaaattaattacgtagcattgtcttcgagctccttttaaagtaaactccgatttcttttttcaagtgtaattaatggtttctgggcggcgtggcgaggatggcaccgttacctgtctttttttttttttccttttttctctttcccctcggttgttgttattaatgatctacagacaacagacttaggatttacacacacgccgggtgtttctgaactgccatgttttccggtgcgtgtcttctacgtttaattcacagagggccctgcctgcctccccggtaaccacgggcagagagagactcaggctgtgaatcccattggtggtacctgcccttctccctgcacggctccagctgccctttctttctacatcacctgcctcaggttctacacccggtgttgcacacacactagacccccccctccccagcaagcttatattcagaaaacatagaacagtgactcacatgtagcattggagatgccacaggcaaatttgcttcagttttccacgttggctctggctccttaacaaccccactgccacggaatgtctcttcctctttcccaccctcttcagttcctctgtgccaatcactatccattcctaattgctgaacagcttacaatttatctccctcctcagtggcagacctgtggctgtccccagctcccatgaagacctggccactcgtcttcaaggctgacaccgaagaatcctagccagagtcgcccagaccctgaggggaagacagagcccccttgcccacttcctttgatttattgtggcactttgctgctgagccttctaagggtcccttgagggagtggctgatgtttgaagcatttattagcttcaaaaatatttaggtcctgtgccccttccagaaaaataacataaacaacaaggggggaagtggagtgactgctgaagaaatttaaaaacatccagcccattgaaaagtgtggtttgagagctgccaagaagtgatttttgcagtctgaagaggctgttttctttctcggagtgaaaagaaaaccgaccgacagaaaggctgaggtggggagttgatgagcagtgagaattttacgagggtctggaggtctgagcaggagcgcagggtcgggggtggggagggggcgggagggggcaggaggggaagccagggctgccttttcggcttgcttttcccttccgagtccccgagcacctgcgcttcttcctctgggcaggactggctttccagtgcctgtctgggtttctgttttccagtttggtgcctggccaggactcaggtagaagaatgtgagtaggaagctcatgaatagggaagccctgaacgtgaatgaaagctatggggagaaggctcgtctccagctggagccagggcttgggacacagtgttacctgttaccttcctagtccccagccaagccgcccattggaataatgtggggccgggggttggaggcagcttaaggaaggctgaggtttgacttcccaaatcattgatccagagccagaacctccctgagtgacactcacatacccagaagtgcgagagagttgtcccccagctgatggtgttgtgggcaggcagggtgtgcgtgtgtcatgcgtgtgtgtgcacatgtgtgcagggcatgctctagggagcccaaatcagtgctgttgtgctgacctcggggctatgatggtgaactccggtccctggggggatgtggggagccacagaggctggcagtcgaggggctcgtctctcagtgggaaagggtggaaggaaccagtctgtgatgacctaagcccatctcttgtcttctctgccccttccctgtctcctttctgtctccagcagaggctgaccatgtggaggctaccatcctcgaggaagacgagggtctggagatagaggagcctagcagcctggggctgatggtgggaggccccgaccctgatctactcacctgtggccagtgtcagatgaacttcccgctgggggacatcctggtttttatagagcacaagaagaaacagtgtggaggcctgggcccctgctacgacaaggtcctggacaagagcagtccacctccctcctctcgctctgagctcaggagagtatctgagccagtggagatcgggatccaggtcacccctgatgaagatgaccacctactgtcaccaacgaaaggcatctgtcccaagcaggagaacattgcaggtatgacgtttgcttacctggtggctgctgaagctgcctccctagctgctccaactccctgacttttaagcactgattctcaggaggtccagggcttttcaaaatggcctctgggtcaccatctggggcttcccttttctgagggcccaccttccaggtgactctccggggaagacaaggtgaagaagacctgactgttgtgtgttggctactttgcttttggtgagaaaatgctgacttgtgcttaatccagaagtggcctggagcacgagatggaattttggaggttggcttggccctctcttcgttggtgatattggctcagcccctggctttggagccaggctcggtttggactctgtcatttccaacctggaaacggtggcttcctcatctctaagatggagtccagaaggacccacccccaccccctttgtgtcgattgttgaagaacgcaggtgattctgagtgtggtagtacctgctaggcccttatgcatggcacttgtctacactcttctcttcggactcagtttcccctgttgtgaaaaaaagggggtaggccctcttttcatgagcctgcttcccattttgcctgaccctcaggttttgggaatctgtctgatttcgacttcatcttgccttttgactttgggctggatatcttgagaattagagccctattttcctcttttgtgaacggggaatgaataatcctagcaggccttgtgtgatgatggaggaaggggggctctggaagagctttggcaggagaactctcgtggggggtgtccctctggctgtgcagcagccagatggaaaactgtggagccagtcctggaggagtttgggtcctgannnnnnnnnnnnnnnnnnnnnnnnnnnnnnnnnnnnnnnnnnnnnnnnnnnnnnnnnnnnnnnnnnncattgtatcctcttggaagtgatacaaagcatgggccaggacctcatgtcacctagaggcgctcagagtcactgtaagcccagctccaccacacacctcagttgcttacacttgagctccagtttatccacctgtatactgggagaaactggacagtctgatacccccacaggcataagatgggcagtggggagaatctgtggaccagcttggccttggcttggctttctggtgggtgtcctggcagcgtaatcaggcctggggcagacaggcatggctgcacaccacctccaccattaaggcaaaaagggtgtctcgtcccttgtctgtgttgccaggcataccacttgggatagatttcaagagtgtggggacgcctgcccggcgtctgcagtgcacagcagcctttgaggggtggctggtccctacttcactttcatctgctgacccagcctcaaaatcctcattttatgttgaaggtctttcccaaagagagcctgcggatcaccgtggggaagtttgcctaagaaagcaactaaatgtgatttttcaaaaggcgcttaatctccccacagcttcgtccttatccttccattccctctgccccccacccccaccccgtttcctcccctcgtactgttaatggcccacagtatttttattttatgcgtgacgggagatagccttggtccgtctgctcggagtcggggcaagaggagcgagggaggagtggatttgttcgttctagaagaaaatatgtaaaataagcctttggaagtctaaagagctatgtttgttcaaagcatttaaaatgttattctaatcaaaggcacaaagcactttgcatgccgtgtcagctgcatctggccattcctcttctttcaacccatcccacccttcctttctaccccagggtctcctggtccttcctcacttgggtaccaacttttcttcttcttcttcttcttctttttccccatttaacagaaagaaaagattaaagaataaaacatcagtggctcaaatgtataaagtaatttaatatggtgagagcattaattattttagcttaattgaattccgaggaccccgcagtccttgcagcttggtagacaaggcctgtttattatttctgtagattaacagtaaaggaaacacagataactttcagttatttattgtaaaataaatgtgtcaattcatgtgtaaagcaagctgctcaaagataattgagtctttatattttaagaggggagctaggaatcacgggcccttctccactcaggcacccggaaatccttccagctgctgtccaggcccctggcacactggtctccatgggtcccctgctcctgtctcccgcctgtggcttcagggtcccttccctgctgctctgtgccctgctgctgtctccactggccttgatggtccctggcagccgctggtgagcaggtggctgctgattcttgggactttgctcctagctggccatcatggctgagtccttggtggggtggctatgctactggaatgttctgaggtctgcagccttcactttggtggggcagcctttcctctcagcctgacacttgtagaagcagggccccagcgatgggtagagatgttgttctgtaggtgagagtccccctgtccttaactgtgtctccagggtgggagtggagctggggtttggccagtcatctaaccaaagtgtggttgacccagtccctaccctttccttggcaaggtctttctggagatagctatagtttgtgatctttttgctgttttaaatgacagagcagtggttctcggctttcctaatgctgccacctttgaatatagttcctcatcttgtggtgaccccaaccataaaattatcttttggtcctacttcatagctgtaattatctgcgaatatgtaaatatcttaggcaatccctgtgagaaggttgcttggcctccaagggggttgcaacccacaagttgagaagctctgtgggaggattagaaaggtacagaaaagattccataaagcttgggtcctagaggacattcattcattcatccattcattcattcactgaacacctatgctgttccccttaggagggtgtccctcagggagtatgtgaggaaattccagccctatctttcatgttgctacttggcttggaatcttcttgctgctcccctgctatggaagaggaggtcccggatgcctggtttccagggcagcctagggatgggggtgatcataagcaaagtctgtggctggagatctgacccaagggatgcctgtgatgacaccactcatggaggtgctgtgtgtccctcatgactccttcttgtggcctctccctgcctctgttaagaactctgctcaggcactaggtccgtgtacctacggtgacctgggtcagggatgaggaaatacaacattggtggggagtgggggtggggattgtttatgggagcgatggagagaggaaggggctcacttgtctggggtctggagctgtgtaggaaagacaggatggaaagctaccccactccctggctttcagaatcagcttccttatctgtgcctgcagctaaggatgattgcagcctgcgtgtgggtacctgctgcaggggagggcacaggcatgatacacgtgtgcagtgcgcatatgttggcccctccccaccccggcctgagatcatccaccctggcaatctgcttcccagctccacacactctttggtttttaaaggaatggcttcccgagagttgtggaagcgtcaactggttcctgaggctcagacaccagaaacaatggcagggtttagacagtcgggtgagggttcatgtccacccgtctatctggtgccatgttgtgacgtcattcagtacctcatcctgggaaggggacagggactgtggtgtcccctgggctgaatccaggcacccccagaccctcggctggtctgagggtgagtcactcctttcctcagtttcctcctgcatccactctttagcatcctgcagaggactgaatgaaatgagctccaggatataccacacggcgcaggtcaagccagagacagactgcaggcaggggagagtatgcgcccggcttagcagcgatggggatcccactctctcagtcctggagctgagtctgctcctctctgtggattctacactctcctcagaatttccttagatggcctccaaaggaaattggctttttcttgttatcaccttgtccacaccccaaaggatagccagcagggagggagtctgctctctctctcagctgtcttttccttccccctcaatgaaaaaaaagaaagaaagaaagaaagaaagaaagaaagaaagaaagaaagaaagaaaacggactaaaaagaggacatggctgatcccaaggggctgagatttttattatagatataagagagaatagacagaggcagagatagagacagtccagaaagaacatgactggaccaagtcaggcctgaggagagaaaggaagcaagcgaagaaacaacaaccaagatggcagcctgggccaagagactggcataaccaaaacagctgagttatctaggggccagggaagccaggagaagagaaggcccagtccagttcctgggcaggagtttaaggtaagggttgccagccaggagaaccctataacaggtagggactgagggatgctgggagaatatggaggccagggtctactttgataagttaacaggcacctcagccagttgtcctgggtttgagacctaatgcttctccaagctcaaatgtcagttttctgaaaggtaagatttagggtagcagtgacaggaggttccagatcactatagaggcgacaggtggctatcactatggtgtctttctcagaagcctgagcaggggcccaggatgagcctgcagagccctggtatagacagggcttggcttctggcctcagatgctccttgctggagggaaggggtcctgatgaaccccacgatttacacgctgctctgagaatattcgctgcaggctatgtagaaaactcatagtgaaaaaaaaaatgaagacattactttggatgtgcgagaaagaaaataagtggctcgtgctggaagctggagataaccccacttgcaggatgcctcaaaacacttgcgtttgatctatttggagttgttattttccctccaaattacgattagttaaatccatgtatattgtggcatggattatctctctctctctctctctcttactgttaaatcgccaacgactaattattagttctgtctctgcagtgaggaatggcccatgtctgagggacagagccctaggtgaagattgggggttgggtgcggatggcctgacctcagggctcaggataggatgtctgcacggtggtccaggcagagttcacgccagactcttctttctcctccttgtgtttgatggactttctgacttaaatttcaaacctcccaacagatagagctaatccaatacaagttgaaggacttgctgcagtcacacagggaaggggagtcatacctggctggcctggctcccttgggtagatgtctttagggagagggaagtctgtcattgggctggcagatttgggaggcagcaggcagtacctctgtacttcatctgggatgacatttgaatcccatgctgacgtctggatgtagccaaaatcctcaggcccccaaaacttgacccttgcctgtgaaggctttggagagaggcagaaggcagctgagcaagctgtgaggtgtgaatttccacgggactgggttggaaatggctttttttcccccatttatgaaaatgttttattttatacttattgtcgcaattatttgcaaccccacaaatacaaatcacttgttttattttgtggaactgagggttccagtaagtctagttactcacatctgggagtctcagccctctgtacaactggatgatctttgctgccttccagggtgggcggtttactgtggattttatctgatattgtgtgtctgtacacccagcctctagaccagtagctgttgttacagggttactcagaggaaggttggcctcagaggtgacactggaagaggagctggcagtgccaccacagacttgtcggcttgtctgaatttagctctcatgatcctgagtcaggacagatggccctttgccagacatcactgcccagtcccgaggcttggggccactcgtctcccagagagggtcccatgtcacctgtgacagctcgtgaaccataagaatcaagaatcagagcggtggcaggggcggcctcagctctgagcagtagtccaccgtttaactggacttttcaaacatgggactgttagaagggcatctcccagctcctttagggatgtatctttatttgctgaatggtgcgaattggcccattcttagggaagtagcttgagaaaggaggagagggaagagagaaagagaaacttggctctgggggagaatttaaccacattcactctgttactgtttgtttgtttgtttgacagtagttagcagttgaatagagtatttatttatttatttacttacttacttatttatatagcgtgtgtgatagggttcattgctgctgctgttgttagtcttatacaaagctgggggggatgtgtgtgcccatgactgtgcaaacaagacggcctggccactcctcctgcccatcctgggtcatcttttcatgggagttgaggcttccgttgttgggattttagtttaatgcatgcctgtttagtatgtgctgtgtgccactatttccaagggccctgtaaagaagaaacctccatttaatcttataaacacgtttggtaggagttaacctgaagcccactttacaggtgggaaaaacaagtgcagattcctcttggttctatgtgctttctctatctgtttctctatctgagggattctatctctgtcctctgaacgctgcaaatcagcgactgctttcgttttttgtaggagaggcaacagagccagggtagggcctaagtctgtgggtggttcactgaaacctggcttctgctctgtgccccggaaggagtcttcactgggccatctcctcctacaggacccagtgggtttaaactaagttaggtataggcttatttgctcctagctgggcagcggctgctgcctactagaggccgttctgagaggaagaggggcctggaggagagcgactccacgtgttctgtatatatctgtggttatgtgtccactgctggctgtgttggccctacactaggatcataaccaccaggtggcttcagggtccagggagagggagggtcagactggtgggcagggatctgagacctggagggagtattcttgtgtggccttgactaggcccattctctttctggttcccctgtcttctaagctaaaatatgagaaggggtgttaagtgggggtggggggtatggagaggatcaacagtacaggggagtggattgctgagaggaaaaggatggacctcctgctaagcctcataccagggtggtggtatccaaggcttcccacacagaaaactcagacctggatcctggagtagacccgtggtaaactgtttagagtgcttcccaggccccggcaaccccccagtccaaaccagccccacctaaggacttgtgacatagctgtcatctgtgagctagagccagggggctgtttccattgaccttcaggctgttagtgtgaccttacaggaacagggcagctgtgggtatagggaccagccccattgaaaggcagagccatgttaaatggctgcagtcccagtgctcgggctgcaccccagtgatgacacaaattagtcctagttagcatccaagaagaataaacctggtttccctcgaactgtctgagtggcttcctttcagctttcccaagacagaccagatttctggagagggtaggggtccagttagggacggctcttgaggttagaggccaggacggctcttgaggttagaggccaggttaggtcttgggtttagggtgctagcaagggtctggattcttctcccttaataagagataggtgtgtcctctcttaaccttttcccatctccagcaaatggctggaaaaccgtagcggtgtcctagaccagaactaagttcttacttggagttggagctgggtctgccccacccccaccccacccgagttcaaagctagccaattaaggggcccaaacagtgcggtcttccctgcatcattggcttgtaaaactttccctgccaaccaggcgactttattccctgggaagggggaaaaaggcatgtaattttcctgacctggccttttgctttggggaaaatgggaaagaaagcgattttcgtaaacagtcttgtcgagcggcaaaggaggtcagagtctgtagactgcaaagcaggggtctggaaagtggcccttggttgtggtagcggtccctgaggtttcagggtgttttgaggcctaacgggggactctggggtggggatggacatcaaaatcttccccattcggactttgaacttcctcaggcccttgccacaaggcaccactaatgcaatttcccttgctcccggaacctgcaacttgaaagactcatctcctttcccgcctccggccgccagcagcccctcccccacccggcctcaagtcctccctgtcctggtccacgtggtgtgcaccttcagactctgtcttcctggagggcactcggaagtttgggtccactgacaccagttcactcagcaggagaacacaatggcctcccttggagccagccgtcccgtgctatggccgggcacaaggcgcgatgtgcacccctacacgttggtgactgcacccgggcctcccaggggcccgccgggtctgctgaggacctccgacgcgcaggttgctttcgggccttggggctcttcaggtcctcttcgggccattcctgcccgccctccccgccgtgcacgttgattgcgccctgggcgggaggcgagcggggccggggccatgcataattcccgggcttaatggagcagctgcccgcgcggggcgggtgcaggcgcagctgaccctgcagccgtctggcctcgcggggcaggcgcgctcctttcttcccagtctgcttcggccggggtcggggaaaggggtgggggttgggcaagccgaaaggccactcctggggggagggtccgtccttccagtttccattcttgcaacttttgctttgggcttgggggtgggagcatcgagtcgtagccgctcggatccgctcctactgaagttgcagtgcgggtttccgcagagcgcgccgaagtcccagactccttttttccccttctttccttttatgtgccccttcctccacccctacctctaccccggcaccttggcggccccaagtccagccgcagtccagcaagcacaccgctggctccccgccagcctctttcccgggctgcaggagagggatggaggcggggacccaaggtcaagggcgggaaggccgcctgccttgcggccctttgtgcacaggccgcccctccccccaccgctctccccctctgcccaccgtgactgcgccaagtcgagtgacccctgactagggggattgtatttcagaagctgctggaagctgccattggcctcttccctgaagccgccactgcgaggggcagatctcacagcccttgtgacttttgtcctggctcctggggccactcagggaccctctcccccgccctcacttttgcggacgtcgatcagatgggatcttaagctcaccttggcctaaggatccaggtgagcccggaaggccggggcctgagttctctcctgcaagcttgagttcctgcagggcagccaggcttgccccatagtgggagatcaggacctcttgtttctttgaaacactcggggacaaaagttttctcaattgtgcgggaatgggacccgccactggggtcgatcggaacgcataggattactgggaatagagtcagctccctaatcaacctttgccacttctcttaccacaccgctagagagaatttgtatgcaaatgttatcttgctagaatttctggtcctgtgtcttaaaagttggcctcgtggttgaagctctcccagagctggaaaaacagtacccaaaaaccgtgtgttgtttgcctgtgaatttgccttacctgagacatcgtttgcagcataggattgggcccaattctctgttctccatttttcagaaataggtctgagctagactgaatcgatacattataacagtaggtaggcaaggtggtttaaaaaatgtgtgtccacgtgcacttaaagtttgggcctgatggtaggctgtgccttctgccctgtctgggttctgtgtcaataataccttcctggtattttgagagaaagttgatcttcaaaagaaaaaaacaaaacaaaaaaaccaaaacgcacaggtttagctaatccaaacttggagcaactggcttttctgatggagtctaaaggtacttgtcaatttatttgttgaaaagccttggggaggagtaagtccttctctggaacggaaacccgccagtcctggacaggaagggtttctctctgcccgaacttgctcctggatttctcagacgtccatttatgacagttccaacaagacagaaactgcctttggatatctgtaaatacggctaaagatcacaaccctgccttcagagtgggctgggaggaaaaggccagttctgtgtcggattaatagttatgtacctgggttcctttacagaaggaaagatgaaacaccgtgtgtgtgtgtgtgtgtgtgtgtgtgtgtgtgtgtgtgtgtgttcttcccagtcaagggagatgagcatccagtgtctttggaggctaggtgtgtgagagagaggaggagggttcacagttcatacttaatggccaccaccccaaggagaaggccagctaaccacttgtgctttccttactttccttactttgacaactcaaaaggaattttaaaaattatacatgattctccctcacctcgatttgagttaagccttaaggcctcacagtggaaggctttcctctagggctgatgcatcgagcacccccatccccgcccctcttctatcccccctcccccatccttcgaggtaagggtgtgtagatctttcttgcctcggtgccagtgttagagtgacagagcgctgcctggctatgaggtcctgagccctgagctgtgtcctcagggcacaggtggcttggcttggctttgttcaggagccgtgtgtgggaggtgtgcatagaaatggagccctccgtcagctggatctccttgcagttcagccactggggttggtagctgaagcggcggcgcctgcaacagcacccctgcccacccccttcactttcactgcttggagaaatctccgtgttcctgtaggctttcccacaacgccgctccccttgatggcactgcttaggcatttgataaatatttgttgcttttggagcatcaggtgttacctcaaggtttaggcactggggtggagtctgtctgggacctttgacgcacagcctggcttatccttcaactgtccagggccatccagtccctcagctgatgcctgtatctgtagaatggggatgtgttttttttactaaccagtctccatctatataggagcataagcgagtggagcgaagctacggctgatttcatagacatcataccagcgagactgttattgtttgggccctgggggcggggtgactaatttgcaaagaggaaaggaatccaacagctgcttgtatagggtgttgtttttaatgcgaagaggaagcatttgggggctttggggagaggcttacggcataccacaaggaaacgcccctcccccacctccattcacttcagaggcccttctctgtagctccccacttccagctccttattttttgggaacgtgaagagattcattatcttaatacctagtggtgttgctgttaccctgacctgaacaccccagaacatgtcctcttcccctcctgatactaggttctggccgcggaagggtagggagcgagatgggggtgagggtgtgtatgtgtgtgtgtgggtataggatacagacttgggtgaaatgtatacagcaggcagccttcaaatgtgtagtcttgctcaatgcaggtgaaaaggaactcggatctggctttcctttctctgccgcctcaaagctctcagaaattagcatctgtacccattgagtccgcagctggtggctatgaaatggtaccttccttcactagggagaagccggtctccagtggcctgcagggggccaatgttttaccttttttttttttttctttcttcagtttttatattcaaagaagcttggtttcttttccctctgccaatgctgggtgacccgaatccaagttttaataataacctcttgctggacccgaaggctccaggctaattctgctctttaggtctgctgaccttgctgtgcatctgatgtgtttgtcagcttcggtttgggatggggtgaatgcgtgtgcaccctcagagttcctgttccacccgctggactggaggtgggtgggtgggggatcgcagatagaagtagaagactagatctgtaccgtaccggagggtaggcttgcagccaggcgtgtggcacctgtaattgaatccggacctgcgttccgtgcaggcctgcaaggatgcgcaagggaggtatcgaggttctaggctctctgtgtggctgaatcgggcatgaaaccgtcttctgactccgtggagcccaaatggtgtgtggagaagccagggagcagcagagagcctagaagcccgtgcacgttctgtttgcacgagtcggctcttgcatcttttgttagtggcggttccttaattaacccgcggattagggctgccttcttttgacacgtacatatattttgggggtataatattcttgttctcctcaaactcacaaccggaaccgctcaggagcctccccagggagctatggcctcttctctccctcttgtcttcccagcttttcccttcctgttcccctcctacccacccttcccttcaacccaagtgggcttgtagctgagtggaggacgggcgtgctacacacagctaaataaatcatgtttacgcttggcgttcttggtagtgaaaaagctgttggctgtttccacttccgtatttctcagcatttgcttcctacctgtttttgagtccatgcccagaaatagtagttttgtcaaatgaggggataatgccagccagccttccctgctgccaaagaagctgatggattttgcaaaaacagagtgacgtttttttagtgacaccgatttccccccctgccccctcaaagaaattagggtgtagaataaggggtatttaaaatgcacatggagcaggggagggaaggggaggattcctagctgcttctactggggtttgtagcaggcaaggttagagaaggaaggtctgggtttttgttgttcgattctctcagggcagcaggcacccgtaggaggtgtagaggctgttctgagcccggaggagagctgagtcaagctcttttcagtcccaagacttcattttctcagatttggagatacggtgcaatgaattttttttttctttccttctgttcagttttgggtctgtttagttccggaggctttcagaatggtacttgccgaattctttctctgaggtaccagtaaggaatgtcaccctgggcccggggtgggagcctgtctgcacccaacttgacagtcagtggttctgtacagcatgaggtacgcaagcctcccgcctctgcctttaacccgtgatgctgttttaggggcatgtgaaaaagtcactctcgtgatgggtcctgtctgccaggcagagggcttcctgggtaatcaaagccaactgcaggcttgtggattaaaaaatgaaaagaaacgatttcaaaaccaagcaagtggcagataaacactccgcttctggaggaaggtgggacctgatttctctggaagattcctgcaggaattctgtccatggtcaggcacatcagccctgttgcaaagatggccaggaagaaaaaaaaaatcacaataaaatcaaagtaggcatgctatgctttcccacaatttctgatgtaaatattttgtagcaaagatggtatttccattgaggactgtgcagccagcatctttaattacattaaatagtggcacaagtctcagctgaacgtaagcctccggttaggtccgctgccgtgggctcgctagattgacttgtaatcatcaatattgccggtgttaacgtgataaccacgtttattaaatttatcccacgaagtgttaatttttatgtattttgttgtgcacacaccccacatgacctctggtatgttagaagatgaaaatgaatttcatgtcaaaaaaaaaattaaagaggtggttgtcagactgctttgtcccccttaaaaggaaatgggtgattttttttcattttttaaaatttttacttatttaattttttttttttttttggccatcaaatgctactaggttgaaaagcaggctcacaatatgtgtattaaataccatccacgtacagaaaacggaggtaaagagacgacttggttgaacgtaattacaggcctgctccgttctttagtcagtgacatttcagacctagcttagaaacagaaagagacagaaagagcctgcccttatgtgaggcaaagcattcaacccacattctgtgtccgttcgaaagaggcacaaagagatgacagggtggaagttagctaagtctagaggagagctggattaaaaaaaattataataggggagttcaattgttcgtaactgacgcacgcaatacaaactaagcgtgctgttgagggctagcagggaacctctttttagaattgattcctccccccaccaccacctgaactttctctttaccaagtttacttctattccgtctgaaacaagaaaccctgctaacccagaggctgggagatcacttctgtcttggtggagttttagggtccggtctgtagaaggttcagctccacatgtgtgcagcgtgctccatgctctgggcctgagtcactgcgtgaaacccgtgttggtcccttcctgtcctttcgttccttttttttatcggcctgtgctattttctttcctaattctccaggatcctcacggttcagacgtgcatctcctctctcctcattctgtgttttccccaagcagaagctaaggttagagctcctgacaccttctaatcataacggtgtcctgaactctgcagcttccaaacccatttggtatgggatcagacttttgatgagagacaagttcattgttttcgggttaccagtgtcaggcccagtggatgctgtctaggatagaggagtccttcgtttaaaactcccaggagtgcccaaatctgacaattcatttcctgggttattgccctctggtcacatgacttgctttcattatggatttcctcccaactccgcctcctgagctgtaaaggaaaggaaacacagagacttaggggcacatgagcaagcttgtcgctggagtctggtcctaactaagttttatttgtgaatggactgaagggtcctgacctgtaagtctcaggttctttttttcttggaatgcaaacagtgtacttagctgttgacttccatttttaggcggtatcttcatgggctctgagcccgtgcacacacacgtggtaaactgtttgttctggaggcaaaaccgagatgaagtttctgaagttcttgactgactggaatcagagggccgactctgataagggctgatgcagccacacagcttttggctaaaaggcctagcgtgggaaacagggactttctttgctaggcattggctatttttataggtaagattagagactcttgtcagccccagctttgtcctggcccctgtagaccccaggtagatgccttagcctgcccatgtttctgacacagatgtatgtgtgtgctcctggtgcgtgctggcatctctagcttctctctctctctctctctctccatcacagatgtgctcacccgagtttctctaactagtaaaacacatggccttcccctctggtgtccctaggccatgtcattctcagaatcctggaccctggtttggcggggtatgcctgccaagatcacagtggatggccgctgcttactgttctgcgtgcagcagcctgaagccaggctcaggctttagcagccattgaatgtggctgacatgcattccagccgttctgagagctccaggctccctcaagagaagcaaaagaagaggttctagtttcaagtttcctcagcaggtgcccatctgggggctggaaccgtgaggctcaaaggactgactgtctggcttctccacctcaccctgggtagatctgaggagaggctttagggtcacctgacaccttcctgacatgtggactatcctcccgctctgccctcagagcctttggaagctgttggaagattctggaacaggtggtgtagcctcacctgtctttggctttgggtacagaaaggggatctgcttgccccaggggatttttagcagctccttgttttgaggaagttagaattggcagcagtggaaagaaacaattgctcctgggccttgggaagtgatgctgtgtggaccagctttgattgctagatgctgccgcccgagaggatggtctctcttccaacgctggcacggggcagaactcgggttttggtgtgccctcacagggtgcaaccctttctctgtatctcttaacctttccctggaatgcctgtcagggagttaaaacggtgtggctctttgtcagttacagggatgccagatgagggaggagcttgggggaaggcggcctggctcaggatccaaaagaagtgctgctttctcttagggtgcccctgagcctttcacactggctgcaggagagatgcccagctgtgcgcgtggggcttgtgagtggtgtccccggtggtcatttcaggaagaggtagtaacagtcctttcaggctcagtcatgagcagttgcctgtggcccttcaggctgtggcctgacatattcttccttgtcatggacacacatagaggccttccctgagtccagtcacaagcagtggatgatgggaaaatgagacaaactctcccatctgcatccaacattcggtcaccacctgtaaggtcaccaacccttgagcgccttgagtccagggaaagggtattgtgggtttgaacaagagggggcgtcctgctcagatggaggacgtggaagtgagagctgggagccggggagccctcaaacttttccccagagtttctaggttgggcagttgctgtgagcctggctagccttcccctgacttgctttctggctctgccttggaggcctggcctggcttctgggttttcattgttgttagagcactgggtcctctctcctgcttcgttttgtctctgctttcttatttcttacaaatggaagaacaaaaagaacgcacttgttgagcttctgcgccccagacctgggtcgctttgacagtgagtgacagagaggctctcttaggatcatttctagtcnnnnnnnnnnnnnnnnnnnnatttctagtcctccggcctcagctactcccccacccccaccccccaccccccacccccaagcagagtgggagagaggttagtgatggcaggcccagaccttgtctggggagttacacagggcctgtttccattaaggtggcaccccacccctttgaaataggaaattgccaacatggatgtcattggctgctaattaggtgaattttaactgcaggatcattttaccagctaataccgttatgatgtgcttcctcgtgacctgtggtggagcccttactgtacgagctcagcctcagcagcagacatctaggagttggttgctcagcttcctctgagtggctgctggctttctctgttcctacttcgtgtgttcacaccagggccagtgagagcagaccctgagatgcccaggccgtgggcaccagtgcccctcatccctatgtggcacggtcccccaattcttgggcctctggaacagaccagaagcttcgtattatgatttgtgcctatctacatggtaccaccacggggcatcatgcttttcaagtctaatctgccctcacctccatcttctctctctaccaaaccggaaaaagaatcttaatttcctgtcgggctgggaggaggcgggttagagtcaggataatgactcttaaatatgagcaatgcgtctggttccatgttatttttcctctaccctcttaatacacagcattttttatcatccttaagacaaagtagctggcaaaatatttaagtgatcagaaacaaatgtttttatttgcctgcgtgcgaattgggttatctgcctatcttgtttacgaaatccggggctgccttcccgcacagtatgctcgcctctcgaatcttccccggctcccatttccatatttctgcgtgcttgttctttgttaatcacttggcaagcgcttatttgaatattaaaaatttctttaatcatcaaacgcaggagcacagtctcatgaatattcatattctccccccctcctcagactggattctagttcattaccccgcagtaaaagccaaacagccatcaatcgctctcattactggctctggcgttttgattggctgcctgctgcccatagaccttttttttttttttttttttttttttttaaatttcccttctcctatgagctgtcttatacctgccaacaactttaaaaaaaaaatcaacaatgcaagaataaatttctctggttgaaaacaacttagcaaacttgtcaaacagcccttgtagcttgctgggccctctcgggacaccagaaccacaaacctccctcctcagtccaccctagtcccaccaaaaaacaaaacaaaacaacccaaaaaaacaaggagaaagggggtagggaagaaatagaattaaataaataaataaaaaagagaaacttgagctcagagagatgaatatttgtcaagagagttgacgtaagtttcatttgcataatgactttgtacttctgcattaataaaatttgcatatgaagccatgttaattactcctgatcatgctttttgcattcatgcatagtaattttctccgacttgtgagaattaatgtcttggcacgagggggggaaggggcgcggggactgtcaggttccctcgccagagtccctcgctcacacgcgctggcgtggatgtctgtctccttctttgatctctgactcatttctgcactatcagtaggagttctcgccttaaaaaaaaaatgtatccgttgaaaggcaccagtagggagaaaaatagacttctgtacggtatgtgccaggccacctcttggggtaggaacatgggatctgtcacctcccagttgcagagtggcggccctgggaaggctgcaccgggaaggcttggttccctcaatcggggctgggcggttccaggcattttttgtgtctacaggctcctggtggtgggcgtgttgctgcttagtgcgcatgtgcagggcatggagcccagcatctgcagggactgcttgcaagggaggtgggcttcaagctcccttcaagtgcctcacccccaggagggcaccaacagtgatcttgtcctctgtttggactttagccatcataccagaggccggtttgggagaccttttgaatattccttcgtaggtggcttaaataccaagaagtcagtctgaccttgactttggagcaccgttttcacgttttttgagaggggcaatatatccccaccccataggaatgttttatgcttgcatggcataatacaagtatcaattttttatttctttttccctaattaaaatgtacttttatgataaaactgaggcagccagggtttcattaagctgtccggatcctacaagaagctgagttagagcctacatccctcccccacataccttgatacgtatgggtctgtttggactggcttagactgcaaaagaaaggtgtcttttaaaagaagatgtgaaattgtagtgtgcgtgttcttgctgcgtctgtgtgtgcagtgaaccgtggcacacaatgaaggtcaggacagttgtgtgggttagttcttccttcccatctttactcgggtcctgggggaaaaccctcagctgctgagccatctcacaggccctggacttctggaacttctgggaacaggacccaagtccccatgcacactagaaaagtgctccagcgctgacttccccacagagagctttttaaaaaagcatcctgcgaggcttatagggtgtcttccttgctggagcaggcttccagctgtgaggaggactggggaggggtagggcagaaagttccaggtctggaaataaatgtaaggatggtagtggccacgtttactaggtggctggctctggctgcagagtgccctgacagtccctttaaaaacacagtgactagccaggtgtggtggcgcacgcctttaatcccagcacttgggaggcagaggcaggcagatttctgagtttgaggccagcctggtctacaaagtgagttccaggacagccagggctatacagagaaaccctgtctcgaataaccaaaaaaaaaaaaaaaaaaaaaccaaaaaaacaaaccaaacacacacacacacacacacacacactcacactcacacacacacacacacacacacacacacacacacacacacacagtgactgagacagagagagtgaccacttgaggtcacaggctaagaaatggcctaggaggaatttgaacccatttttttctgtctctgtccgtctttctgtctttgtctctgtttcagtctctgcacccctcccccacaggctgacatctctcagtgggtcaggtacagagtctgttagcagatctcaggagctgtctgttctagatccaaggccgggcatcccttccagtggaaggctgaggctgcaaagtgggtcagggacaggcttagagacatggccctcacctttgatttccttttaaaatgaaggtgcacctattgtgaaacttattttaattcgctccatttgtggctttggatttttatgtacgggattgcgtagccatcactactgtttaattgatcacacccccagaagaccacataacctattggttctcagtctcccctccccccagcccctggtaattactactcagtctcctgatgtttggctgaccagaagctcgccacggcattatagcatggtggcttctctcttggtttttgcaggagttggatttcaggctccctctgcgtgcaaagcttggagataagctgtgtctaggggggacttctagtggggctgagattgctctaaaagctctacagggaccctaccccctcctgcccttggagcagatagccgttagtgagggtctcacacccaatgagggcctgtggccacctgtctaacccaagtgttaccacctggtgtgggtgtgtgacttcatcttgacagaccctggttcaggccaggggcgtccttctagaaggccgtggaggcttgcgatttcctttttgatcctcggccattcttcccgtcagcgtcgactgtgaggagctcctgtgggcattcgcagccatgaggtgtggtgctggctgagttatggcctttcgtagaatcagaagcctctcgctttcactaatggatgggctgaggtccaggctgctcgctcagacttcctccattcccatgtggccattggatacagggtgggtaccctggtcactttactccagctgcagctgtagaggtgggaagggagcatggccaggctctggagaccgtgccacgttcatgctgcagagtgcttgatcgtgagtctcagttcctccctgtggagtggcaggtgctccttcctggagatgactttcaaggaccttgagctctccgcggtctaaagggacgaatcccacagggattcaaggtcattagaggacagggtcaagtacagtgtccgatgcagtgggctttgaggcaaacactggcctcccatgggtaagtttggcctcaggttgtacttgcaggaggcccataggacagctgtgatgtggctttttgctcttgttttggtactgcaactattcttgggcttattgaccaggcccatttggggctgtgtgccagggcagaaacaaccggtgccttgtatgagtatatcactgcctcagcagggtccagcagggtcagtgctggcacaggcctctgggccggacatcacagtgcccgagctccaagctctgagtacccggatcctgcatttacatggaagcagtgggatttttgaggaggctcgaaactgctacggtttgctgattcctgcacttctggcctctgttggagtctgtgcaatgagtgtcctacgtccttgtgttcaggagcgtgttagggacccgatcagagaagagggggcaggcacctggctctctgagagcctgcgtgattctgtggcggggtatggagtagtgcagatctgcaggtgccaggaggtgagttctggcctgcagtgcagacctggtgaggcttagctgcccagcatctttgttgatggtttcttcttcttcttcttcttcttttttttggtctctctgatgcttctctgttcaattatttacccagggaatttgggcttcttcacttgtggttttggcaagggcttcacacaaatgttttgccctggtggtctcttaaccaacgtaagataaatggccaaatcaaacgcaggcctcgctggcagtggaggctcaatgtggggccgggtggaggcaggacagcatcctcaccggccctgttcattgctgtcactggctgtccgagcagggagtggggactcattcccaaaccagggtggagacgttgagacgtgtctgggccatgctaggtttcttgtggtaagagaggaaggagaagctcagggcatcctgggagcttccgaggcttgggtgctgcttgccagggtctggagagaagccccaggcaaccagctaggcaggaggctcatcagtgtccaggcccttggaggtagacctgaggtggcggaggcctgactaaagaacctataccggcattagtctcctgcctctttcaaagaggggtcgctcatattttgagaccaaatcctcaagcgaagcccactctagtttgttctgaaagatccttttaggggatcttaactgggagtggggccccgacgggccttctctgtgtgccaaccccttgcactagggccctcaaaggcagccctctcggcccccagaaacaatttggcagctgcaggtgtagcccctgctaatgtcctctgtgcaccccttctcgcttgcccctggaccccagttgtcatccccgtagggctggtgtcctcggggccgaaccctctcagaggctgtactgtagccctgtgacccggggccccctcttgtgcctcaagtcccttgtgcagtccagggcaccactgaccagtcttttctattgttttttctccagggccgtgcaggcctgcccagctgccatcgatggcccccatagctgcctcctcttcccaccctcccacctccgtgattacttcacctctgcgtgccctgggcgttctcccaccctgtttcccgctgccttgctgtggtgcacgccccatctcgggcgacgggactcagggtgagggtcagatggaggctccctttggatgccagtgtgagttgtcaggtaacagagccgctgcggtgggggaggtgggctcccgggatggcgggctgtgccctgggccgagccggggacccaaggtggggtcccagggggggatgtgccccccatcccccactcaaaaagcttttcggggtgggggatggcaacagaagtgccaaagatgtcaactgaactgtaacctgtgtcggttcccagggggtcaaggggccgtctcccccgtatatcccccaccctcgaattctgagagtctcactcccagaatgcactgcccgacctccaaatttcatctctttgggctgtttagccgaagtttaattggataacacttaacatctgaagttttcttctgccccttgcctctgccgccctgccacccaccccagacaagggtgggagaggattcctgggctgtctgtgtacagcgctggagccgttcaaagtgctgactttctctttgggacaatgtgttgcccattaacttagagggaaggaaaaaaagtctcaaagaggagccttttaaaaaagctgtggccacgggtagccgtgaaagattgtgggcgtctggggcagggggctgtggaggtcagtggctctgggtggaccccagagttgtcccagttacctctgccgttgttggaggcccgtgagaccccgttacacaaagggcatccccagccaggtggcgacacagcctgcgtagctcccctgctctgactccccacaaacatagacttctgtggcttagggtccccacaaggtcgaggggagaaagccctcccccccgcctcatggtggggcctggtttgcaacacactgtggcttaaggggccaggatgctgacacaggctcacgtggcaagcagctgtggcctggtttccgtggccagggccagagctgcggcgctggggtacattcagtttgtccctgccacacggccaggcacgttgcagcctttctcttgactcaagctgtgtgaaaggaaaactatttttattgggcaagttttgcttttcattgacgctgtctcagggacctttcttattgggagctttggttttgcacaagaagagcagcccctgatccaggatgaggcctccctggtcttcctgccagtagggtgtttctgcagtactggcccatactcctgctatggcaggtggctatgttgttggattgcccatccaagtctgggagctctggttccttccttgagtgcataaagcagagaccaaagtcacccaggaaggaactgaatcagcttgctaggaagctgacttcccttcctggtcagccccgaggtgactgaggcttcttgtagcttggaagatcctgttcaccaagcttggggtacctgctgggctgggccttgctctttggcttcctgttatatggggctgcaaccctgcagccctgtactcaaatagtgggggcctgcactatcaaaattaagcctaaatgcatatggtcaggttgtgcatgtagaagcatgacctctttgtcccacgtgctacaggggcaagcttaatcttcagctggccctctgtaggaactgccaaatcggagttgcgagtctttcctgtgcccatgagtggaaggggcaaaggctagggggctatggctgagcctctttggaggattgcgctaaggcttggggactagttcctttagcccagtggaggtcagataaggtctgcagggccttgtcagccaggggagtctggcatcagtctgccctcacacaggctacttgctttcttagagtagagcagctgtctgtcctgaactaggcatttggttgtgtgtcaaggctttaactcccacattacagacgagcgtcagagcctgaggtctcgaagctcaaaccggctcattccttagttcgctggcggtcctcaggcacagtttgtaagccacatgtggacacaggcagagtcaggtgtggtgggtccctcgcctacctcacagctcacagaatgggctttggggaccatgtcctgaggctgatgggagggaaggtaagaacacagaagtggctcccatacggtacctggttcaccttgaggtgcagaggctgccatagagttcagggctctggggcatccggtccacgtgtggcgattgccgtgcaggggaggcgagaagcagtgagggtctgagccctgggacctctcctggaccggctcctgagggacctgctgtctttcttcttcctgtactgttccttgtcattgttctgccttgttagcatcgcctgtgtgaggctctaccgctgtgctgtgttttcagataaattttgacacattcaagtatcctcttccagtgggttttgtccctttggttctgttcctggcactgggctgtttgctgaagtgtttttagtgcctgtttaattagtagctgcagaggaggcataaaatcgccaggaaccctcgaggaaggaggggctgtaaagacggaacactgcagtactcactgcgctttgtcccccttctgatcagggtgctttgaacccatctcttcaaattaactcaggaagcctgagtttcacacaggttaattgcatgcccacgaacacactctgggttatttatagaagggtgtgatttcacaggagagaaaactacccggacaagccaggccctgccaggacccttcccccatgcttcctgcagatggttacagctgcgagaaggggacaccggggcccatttcttatggattccacagagatcctatgtggtttttgagtcaggtgctccaggcaactaaaaggtcttcccctcagaggtatcaaggtagctgtgtaatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgcatgtatatgtatgtatatatacatatgcatatacatacacacatatacataatatgtatgcatgtatatatatgtatatacatatgcacacacacacacacacacacacacacacacacacacacacacatgaatgtaatattgcaaaataaggctccgggagtgtatctgtggattagaacaggttggggtgttgtgggtctgggcccggctagggccccaggctccattctgtcctcaatccttccctgctttgagacatcatgataaaaaaagtggccttcagaatatatcagactgtgttcatgagtgaattatgtagctaggtttgtggccttacccaggtcattcattcctcgtcctttcttttcctctgttctctcatctgtgaaatggacgtaaggatcgggcatgctctacggctgtctgaggtcatttagggcagacattcagaacgatgctctgaatctaatgaacccacagacgttatgattcatacgcaagcagtaggggtttcgcaatctgatggtgctctgtgtctggcactgggtgggagcttcccttaaaccacatccccggtttccatgcttaaaagcgtttagcctcttggctggctccgccgtgcaccagccttaggaggtggaacgggaactgagaaccttcattgcatatttagaagctgtaaatggtcatcagccacagtgattaatgcatgtgcttggcgaagttcaaggtctcacgcaagaacacacagcatccaggctcggggaagtggaagtgtttggatttaatagagggagtcacttgcagtcattagtatatgctggaatcacagggcaatcttgtaaagttaaattcaatttacttttctactgaaattgtgcttgctgtgttatttaactagtctggggtttcttggcttgggttaaagggacaataaagataaaagaatacctgtaagtaaataacagggtttaacgggagaatctctcgtcttctcctccttcagttatatcccagtgttcgccctgtgttgatttttatacccggagccctccaatgggatgcctcggatcagaccaccctagctgtggaggcttggtgcaattaatacagtctgtctggaaagtggtcttatttctggaagttttatgttaatgatatggtctgcacgctgcacatttcataccagaatgaagagcgagctggagtttctttctgggctgggtttgattagcagcggaggttccctgggcagccgctctcccagaggacagagattggcagtcctccccagtcctgccagggcactgcttggtgggtgtggtgtactgggtgctggggggagggcgtgtcgttcaagccttcctggggaaggaggggccgtgtgggcgcagtagggaggtgtgtgtgtaagcctccagagggaggtgacagatggacttttgagttcctctgcactgtaatgcttttttttttggggggggggtgctttctgcgtttaccacgtccccgtgtcaatggggctggctcagtggaattattgaaaatttagagagccctactgggattgtagttcagttggcagagtgtttgcctagcatgcatgaagctctgggttcagaccctagccccacactgtgtaaagcaggtgtgtggtgccagccagttactcacacttgggaaacgagagcaggggggattagaagttcaaggtcaacctctactgcacaacaggttcataggtcaggctgggttatgagagaccctgacttaaagacaattagttagtcattagtcacttgtccctttgcaatgccaatatgacaaagactttggtagtgtggccccatgactgacatttaccacgtgttccacaattcctggaggttgtctcctaagactgactctggtgtttgcgttatctcaggatggctccgccgtagctgctttctttctgggcctgcccaagacctgcacagtgtcctccctgtcttgatacacgtcagcagagagctgccggccccctggaggttgacaaggatttgacagactgcagaaaaagaccactgttcactgtccatatagcaaatctcagccttcagcaccaacaggggccagagcggttgcagtgggctccggggagggactgcagctggccagcggggtgggactcaccggggtgactaccttcagatgaaagaggttccagcgacacagacgttactacagataccatttcggcctctgccggcctttcagaaggcagagctaaatcaaagaattctgttcaaatctgtacaagatgctgtttttctgccctgacaggagaggcatttggaagagcagtttctttttctttctttctttcattctttcttcctttttttttttttttttaatagctgtcttaaaaaggagtttggctgtttagcacagctggtgctcattacgttatggactggcaatgaaatagcatgtgtaattaatttttaatgcagcgctgggtgcagcactttcaagcagttagtggatgtgaaggcccagcactggctgtggacatcagagacctcggagccaagcagccacgggctcctttcaaggggatttgacattggcaggagaggctgctcaccaccctccgtgcggaggggagctcgctcagaagtgggtttgttttgggtgacccaagggtcaagccaacccttaccgagccaggattagggggtcctgattggacatctcatctgacccttttggtatccagacggataaactgaaccaggctggaggaagacaccggaaggcacaagtggctggcagaactgacttggctctatgtctcacagtctctgcccactagactctctttttgagacagcagcttttgtatcccaagctgaccttgaactcatttttttgtaacagtatcttctgatccttgtaacagaaggtccttgatctgctgatccttctgttaacttcttaacttggaatgttgggatttcaggtctataccgctatgccctgttctatgtagtgagtgctaaggactgaaccctgggtttcatgcaacctaggacaagtggagaaactgaggcacagagaggaggagtgagctctacccctggtgccacatcactagtctgcatcctggtctaccttgagttcacattgagagctagtgagggacatcctgttatccaaaggagatgcttaaaagccaacttcttcgttgccaccagattcgatgtcctgggcaccgggcttggcagcaggtaacatttttgacagcaatgaaccccaagtaattggtcttgggactctcatgaggtttttggcctctgctgtgggccacacccctctgcatgttcctgttctgagactgcatgtgggcttggcttgcctgcatggttgctgtccagtctaccctgggaactgcagcatggagtcttgtttggattaggcactatgattcacaggtaccagatcggggacctcctgggtcctgttctctgtgccattgagtctgaatgcatggccctgggctgcccactcctcctctctgtgccccagtttctccacttgtcaaacggggcacaagtaacccctttgggaagactcggagacacttctgtcagggtgtgccagggcatgagggagcaggccatatgaccttggctactgtgatgacctagcattcatggaagggggtggggtagggggtgggaaagagccgttactcttactgcttttggaactagctgctgctaatccacaaaaaaaacctactatgtgccagctctgcccctcgccttacatcctaaccttatctttcctccaagaacgggtaacccctcgtcccactggggtacccactacttagctaagagttacaggccacccaaccgaggtcacacagcacaaaccctgcagaattaaagaaaggtgcaggctgggctctgctgggtctccaagctgtgctgcctctgtctatcccctccgtcctcccattgggctgtggtggctgcttatacctgcctatcagatgcacaacatgctggtggaacagcagctgcacttagacatggtccctaaaagggtcctctgggttctttatttcactgaccaccatatttgtgtctgaccctggcctagacatgggacccttgggtgtgtgagaacaggtgtgtgcctgagactcctgacgtggaaggcagggaaggctgcccttccgttctgctgggccatggcagctttgatgtgggtcttcatgcatgactggacttaagggggacacgaggaagaagagcatggaagagacagcgaccctgatgaggaagggacgcacaagacagttttggcaaattgccctaagacagttttttgggtttctggtgtctgggtgggaatccggcctgccccaggctttgtgctgcctgcctctcttgtgtttgtggtagggcctgcaccttgaggagtgcagaacactggtgggcatcctggggtctgacatggtaaggtgggtcatgcagggcgggtccaaagtcaagccctctagggagaatggcttgctttcttcatctgggtggagcctgtccctcagcactgagggagaactgagtttgctgttgtggagtggcctgggtgacaccttgaacattgctgtggcacaaggacatgaggatgggatttcctttcctttcctttcctttcctttcctttcctttcctttcctttcctttcctttcctttcctttcctttcctttcctttcctttcctttcctttccttcttttttctttgtctttttccaagacagggtttctctgtgtagccctggctgtcctggaactcactctgtagaccagattggccttgaactcagaaatccacctgcctctgcctcccaagtgctgggattaaaggcgtgtgccaccactgcctagcgatgaggggatttctaaaagtcataattataggtaagaattactgttttgaccacccgcccacccttacttctagagattgaacccagagcttgctcaggtgacccgaatggcccatgttttctaaatctgtggctggggcagagggagggaggtgccaactggagatgttttactgtgacgccgagtagctgaaaccatgaaatctggtttatctaagtcatgactggccaattgaatccgaacaggagagggaagaagccgtagggtccccccactgtgaggtgttccagtctgctttagatcttcgaggaaccgtggcctggctagttctgtggtcctctctctggacattatttaataagtgttaggaaagggcacattacctccgtgtgtggtcacaggtgacagaggcagatttccctttctcatctgggtccttatacctagcggcgtgtccccagacacggtcaggctgttgtctgcagtcccaatgtgcatgggtccatggttctggccttctgagttttgaattcagacagtcggtagggacactgacatctcagatgtagcttgattggtacagaacagggtgtctgatgatagcttccctgagtctgggtgccactgcccttcttgtcacgtctccctggcaggtgcgggtagggagaggtgcatgtgacttgtgacgctcctacggggccctggataataagaccatctgtattttatcgttcttgtagaaggggtcagaggactccagtcttctccaaggagattaatgcaaaactgaacttactgtctgcagaaaccggcagatgggatcggttcataaaactggacattaattattgcctttcttaataaggtgatgacccgctgatggggtgaagcttgccccaccgggtaggtgtatgtatgtatgtgtcggtgactcagggtgagtttagtctggacttagttaatttagacttggtctctttgctctgaattttcttgggtttttatcaactagctcatttattctgtatttaatcataaaagagaccatcgattgatggcctgtggtatgccatgggcttttttttttttaattgtgttttgagacagggtctcatgtagcccaggttagccttgaacttgctgcttccatctccttagtgctgggtgtgtgttcccatacccagtttttgtggcgccgggaatcaaactcagggtcttctgcatgctagacaaacaatattcccagcccctagagaaaggaatgtcacaatagttcaaagataggatctaaaatacctttttttaaaaattgtgggtaaaatatatgtaagatttacaattttgatagatggtcactactttgctgctgccgttgccaccaccgccaccaccaccaccaccgctagagccttcatcttgctaggctatcactaagctacaaccgtagccttgatttgaaccatttttaagtatgtgctactatgtagccttcacctccttacatctctggaactgtctcctctcaaacaacctggtctctcattgaacaatagctccacctctcccctcccagctcctggaacccaccattccaccagctgtctctttgattgacacagggactttgtatggaatgcagtgtactgcatccgtgtgtgtgtgtgtgtgtgtgtgtgtgtgtgtgtgtatttggctcattcatggtgtagcaggtgtgaaattgtctttccatattaggactgcgtgctagtcccttgtgcgggtggcttgtgtttgctctttttgctcttccattcatccatcagtgggcacctgggcagcttctgtcgttgcctgttgtcaaccctacagatgtgtgtacatccactcaagggccggattttagttcttttgggtgtgtacccagatctcgggatcgtaagtgactctgtgcttattgtttattattgttgttgttattatttattattattaactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagaagctaaaaatagctggacacacatttgcctataatctatttttttttaagaaaacataattatttttgtaaaccagctctgagaaaacaggagtatttttagcctgtgtcttctaggatactggacgtcatcctaggaagagcatgtcagagcccaccagagtgtggtaatgtcagcatgtcgggcagtgacccctggggaaacagggtttgaggagccccgtcctcagccctcctttgctgagagaatggttctcgagagtcagactgtggcttctatggctgatggcggctggggacatcctggtttcacctggacaggtagctgtggcactggccaattggtagctggctaagctcgggtttgggcaagggagagcttgtggtgagactagcctggcctgctacctcagcagacctgcaggagagatgagggcttgagggaaaagtgttccaagccttcttatggggagccaaacattgcctcatgtaatctccccgtttttcccactgcctctgccagggtcaatgggcctggcacaatgtctgtaataaagagctctgtgtgtgtgtgtgtgtgtgtgtgtgtgtgtgtgtgtgtgtgtgtgtttgaatctctgtgtgcctgttaacgcgtgtttatgttggtgtttgttgtttgtaggtatactttgagagtatgctcttaggagatagcacctactgaggcccctcctacctttctgtctggtactggatgtctttggtacaggcgtgtaccgacatggccgggcttagcattgcagcctgctgtgaccttggtgtgagtgtgtctctgaagatagattttcttccccgtgcttgctggggaactcactgtaccgaggccaagacatcatggtcagttcagagtgtggccacccatgagcatgcatagggagaccaaaggctttgaagtggatgttgggttctcaccctggctgtgacgagctgtgattgcgggtgggtgagccaggctgtttcctcatctgaaacgtaggaacagtgccaaccaagtgttccagtcaggcacgacaataggacacatgcttaccacgggttttacgctggcactcctagcctgtctctgagaggaaggcagtgccatcattcccactttacagatggggagactgaggcacagagactccagaaatgttcccgttgagtctttcccagttgtgatacactccctgcctcaagcagcagccggctttgtgtcactgttacattttattgttgttataactgtaattatcatacccaagatcgttacggcagccgtttcctgggtggagatattcctctcgctgccccagccaaccttgacttctagccatgttcttcctttctgggcatctcgtctttcatccacggactccttctgctgttgttcccgacgcatgttcatttgaggtctccgtctttctgctctaattgagataatgaacacagtcctccacccccagaatgggagcagaaagtcaagtgcaaagtgacggttgccatttgctgacctcccctttctttctctcttagtacgcgtctctttacgaagggattggctggatgcaaacagctcataacctatggatttatggagacagcgagagctggctttataagctcggatacctgcagtcagcgtcctgtctctttaagccgaggctccgacttgccgtggtattttacagtgcctggtttcatttatgctggagccagacttactatgtgagcgtcgtccgcatgctggaattagtcttaagcttgcttctgtggcgttgccaaattccatgtttgtgttttatttagaattcttttcacggccagccgattctgtgccggcacacacaggcactgttgcgccccatggagaaaataagcaagcttgcgttttctttggcagaggccgcggccacaatagactgtggtctctgaaacattttttaaaagctattttaacccataacagatgcataaagtcggctcaggcatgccagttttcttagttttaattaaaaaataattacagtctaatgggatgttagtgacacatttggatgaatggtcggtgacattatctgcaacttataaattagtgcctctcccttggctggggcagggctggggaagatttggggaggtacatttgcatatctgttcttaattgcagggtgggagatgggagagtagcatcccctgggttggagacttaggggcagggacagagaccttggtcagtggctctgaaacccagcatgtgtgacacaggcatctggtaatattcttcaagctccatctgacagaactcacctgcaaagtcctcacatatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcagcctctctgtgggtgctgttcctgcttatcctgccctcctggatggaacagttcccggcagctacagtgtgtagcttgtctctctccagtagttgtggggagctgtgtcatcctaccctgggagatcaggaaggttccctttatctgtgcctttgtgcctggccctgtaggctgcttctttggcgacaattccaggggcccctgtgcttcattaccaggcttctttcataggtaccacccgatgtgttctaaggggggggggggcaggacttgccccaggccactgggctgagccaggacctgcctgcctgacctaactcctcactttcccattgaaaactgcacggagccacaccctgtggctcccaacaaggtcgagaagactggctcggagtctttatttttactttccgggtggtggaggggggcgtggtgttagtgtcgctggtggctcttcctgttgtccggggtctaaaatgagtgtttcttagacaatgttttcccgagcccaaattcctcccgagtaaaattaagttcttctattaaaagcgtgagtcacaccagcccagatgagagtggttttgacgttcctcgaatttttttggaagggaaacatcacattcatgctaatccttgcaattaaacctcatcgctgggtaatccgccagacgcttggtaacctagccctctgccgtccgtccgcgtacggtgcctttctctcctttgctgttgcctgcccagagtttcttcctctgttctgggctcatcagattccccgagcatggtcttgggtatctaattgccacagatgattaatgtgtggttgataaggctccatgtctggctgttcatatgaattctaaggagatgggagttcatttctgtctctgaactgggtgtttgctcccccactaggggttttctgctcagatcggggtggaccccaggcatccctgacgatcaagagaagacagaagggtgtcactgggggtgggtttggacccgctttggggaaatgtagccaggctggtaaggaattggataatactgtagccatgatatcaactttcctgagctgtgtgtttctcttactgtgacctctcaggtttatgctcagctactgctaaaggtctcactgactctgggtcctttccttgcgagttcctgttactgccaatgagatctattccgtcagcctgaggaccaacctgggtgttcctggttcctatgtgtctaggtcgatgtttggctgcagtggactgtccctggttgcttctcaagcccaggtcaaagcagaaacccagtgtgacagacagcccaggtcagatgcagtggggaggctgtttctacggtgttggcttcctgttctagtcctggaacaaaggttggcatagttgaggaatcctggcccctggaaacatggcagctgtcaaatgaaccggagttgtgtctccacagctttgggtgcagtctttgagttctggagactagggggacgtcttgattttatgtctcttttctcagagagctgctgcagctcacctgctgctcctgtgaagccttgggtaggaggttctggtgtctgacacctaggggagacaagtcaggggtggagagggtgagtgtagaagccggtgactgcgatggatgggaaaggctttgggtttggaatgggatagagtgtggtttctgagtttggaataacacttctcattgggatgtggggagcggggtgggcagggattcgagttcatttacttgtattaaaggctgaggcttcctcttttcacgagtaagaagcaaaagcccgagaaagtgatgagaaacagcccggaaaggcagttcgtttactcattaaatcttctataaaataaataaggatttagcatgaagggcccagctgcagggtgtcctggagggaggaggggacaagtccgacatgaacctcactatgggaatggaccagtaggcccggactgtgtgcttctgctccagaggccaggtcttagtcctggaagtaagaacaaatgggtatgagtgtccaggaggggtgtgtgcacacatacacgtgtgaaagcttgcgggtacattagcagtttacatgtgaacatataacatgtgaacatgagtagacatgcttttatatgtacggacatgaataagcaggcatgtacacgtgagcacacgtatggaaacgtgttggtacatgggtgcgcaagtgcggttatgtgcatgtacatgcaggtatagatgtatacatgtgttcctgttcatttgttaatgtgtgtacatgtaggtgtaggtgcatgtatgtgctcatatgcacatgtgtttgtacacacacacacacgcacacacacacacacatacacacacacacacacacggtgtgcacatgtgcagtcaaatgcaagtgaggtctatgtgtttgcatgtcttcatgtacaatatgtacgtgcacgtgtgtgtgtgtgtgtgtgtgtgtgtgtgtgtgtgtgtgagagagagagagagagagagagagagagagagagagagagagagagagggaggaatgtctccacttacctctgaggacctgtttgaggtcagctgctgtggcacttaaagaggggatccagagtcagaaatgcagagagtcagaaagaagtgaggtgtaggaacagcacccgaatgcacaaccctgctgtggctcagtggagttcagctgtgggctcgggtgggtgtccacccctgatgctctcacgcccgaggcagagtggagtcgggagaacaagatgagccttggtccgacctggctctgcccctttatagatgggcgactcttcactttcatgttccagcctcagtttccttttctgcttcaagaagatggccatgttaccatcagcctacatacagtgctcagggtagggctgacatatgacaggttccagcaaggcaggttatgactgactttgttgtttggcaaatgtatgcggggtgaaggtgtctcctgaaggtgtctcatccatgacaacctgacaggcctgcagcaaccctgaagccgaggcaggatgggatagccgggaccctgggcttggctatgtctggaaacctttttgttaatggcgttcttgtgccccagtggtaaggccgaccctccctctctccatctggccagagcgaggccctcgctaagctgcttcttagtattgtcgggttctctccaaaccagagcagggagggtccccgtcatggttgacttggggaggtaggcttctccatcctcagctcaagctgctcggcctcatttggaagcctcttagacccggacaaagctgggcgacgtgcaggaaggtggatggatggactacgagacctggaaatggtttctccctggagaagacgtggacagtaagcatgcctgccgacaagaagtctagaaaagctgcatgcttgccccagcagttgggtgtctagtcaacccgccctccgctgttggtggtttcaggcattcttttggaacagcgcaacagccttcctgtttttacagtcctggctttgtctctttctttctcttgaaaggagcagggtgctgttatcatggggtgtatttgggcatggtaagcatagaacatttgtgtctgagtggctccttgtaccaagacaggcattactaggtgatcacacggtccctgacctggataactcaagatgagaagcaagcagtcagtagtaattgatcatcctggccaggagttgaagcctgtcttctgtactggcagggctttcctgaatggagggagaggctcattagataatggcttccctggtgagagcctgtgtgtgctggagtcagactgccccccctccccccagccttgcgtagatcatagaaaggaaggttttgacctgaggtcccaccttggatcaggcagcatggtggatcagccagtaccaccttagggatctcatatttcacagtgctagggatgtcagggtcccctccaggtggctcttggctgcttcggaagtaggcgttgtctcatcgaggctgtcttgccccagcctgggaacaggcggccaggcatcttgctgagatggtggtctggcatagtgcctgttcttcccttgggggtcccacgtgttcccgggtgctctgttggaatgacatccagggtagggcctatcctcatactggcctaaccctggctgtgccttgttctgtcacatggcctctgtggtctctgtgggtttccaccccagggccatggcctgttctccagtcacccaagaattctctgctgatgtcagcagaggctgtgtgtcaacaaggagtcttagggtccactaggaatgtgagttgagagagggagagagagggagggagggagggagagagatgggggagagaactgggaacctccttcttcctctggtacgtccatcatttcggttcaccccttctcttcaggtcctgctgaggtgaaggctacttctgtcttagagatggataaaaatagaggcttagaaggccacggccctcccgagtgggccagcgctgtaatgcctggcctattctctctggccagctttgccatacagtgtctcctctgacagggcatatcagagtgtcttcactctgccctgtgtcccagcagtacctacaatacccttgtcctttgggggtttcagtccctgtgtctgtcctggctgcagtctatcttctgtgtatgtatgtatgtggctgtctgtgagttcatcttctgagggccagggaccttgatctctgtgtctctgacatcaacattgttcctgggtcaccaaaggactgagttcttcctgctggttggtggataacaaagaagctatttgattggtgctttggggctgggctttcagcctctttggacaaagatggaggattggtggggctcctcactgaggtatataggttccaggggccagctcagtaccccacaagtctaggcaggatgctggtgatggcttgtgtggataagtacctgttctttgctgggtgtagcgtcccattacccctacctgctcttaaagctgtggagtcgctgtggaggccaggactctggccctccattctccaagccactcttctggtagactttacagctggccctttggaatcccatcagctgttattggatggctgagctctgctctttggcgctccttgttaagccacatgctgtccagcaggcccaggtccttgctcctgcttcaccttgggaaagcaccgctgagcagccccagcacaccccaggacctctctgatcaccttatatggaagagtgctgggtgctctcatgcttgcacatgcttctgcatcatctcctgtccctgtctctcgggataagccttggtggtaaaggccagtgaggagccgagtgatggagagccatctttagaaccttcttgcccagaagtaagaaagactctgggagcaatgagaatgaagagttcaaagctcccctaattctgtgtaggattctaagtctagaagaatcggccaggcaaagattgtgtggaaggaaagaatgaagggcccttgtctgggtgaactcacatagtgagtgtgctgagatttagcctggtatggggaggcctaagagccggggcagccattctgttctgttctgtgaattacttctgtagccgagctgtggtggcgctcacctttaatcccagcacttgggaggcagaggcaggcggatttctgagtttgaggccagcctggtctacagagtgagttccaggacagccagggctacacagagaaaccctgtcttgaaaaacaaacaaacaaacaaacaaacaaacaaacaaacacaaaagatttacttctgtaataagtggaatagaagtttcatgctttatgaagcatcaaatgataggaaagaatgggttagaagacatgacagggggagggggatttgttgtcaggcttcataacgagagtgagaggggaaggggctaggagtaggaccagaatgtattatatgtgtgtatgaaattattgaaatatagattagttattttaagaaggggaaagaggtaggagatggctcggtgtttaagagcactagttgctctttcagaggacccgggttagattcctagcactcacatggcaactcacaatcgtctataacccctgttccaggggatccagtgccctcttctggcctccactggcccagagcacatgccgtgctcagacatacacccaggcaaaacacccgtacctataaaatcataatagatcttaacatggaaatcagaggttgatagggtatggcttagtcaataaagtgtttgtagcactggagcacagacttgagttctatccccaggacctgtgtaagtatcaggcccagcgagcagatcgctcttcccaatgctgcagagctggagacctgatcattgggatgggttgaccagatagcctcctgaacccgtgctccagctccatcgagaggcatcacacacacaccacacacacacacacacacctcttccttgacagcagttgaaatacaccctgaagtagaggctgtggctctcttgacccacaccttgagcctcctgcttctttgagggggtgtgggaatgtctgggggctgggggttagtgagacaaccgatcctgggtgtcactagctgaaccccattggctcaggtgtcccttccctaggtctcaccctttctggtgaatgccagcaggccctcactgtcttccctcaggatcctctgtatagggctgccctggcatttgtcactggtgtctgggatctgagctgctctgggagtagaggggaaagccggagggcctgaggaccagtgtttcctttgcttcaggggagtccgactgtagggcaggaagctgctggccgtcttccttcctaattcccatatttccaccttcctgccctcactcgatggctggaagaagtgcagccatgtccagcatccctgagagttggcgccattcctcctagggatggggagccttgagcttggggagcctacccaggaaagccaggcaggcaggcaggaaggccttcaccccgctgtttcttctccctaggtgctgctatggccagcccggctgtcagctgcacttgactgaagtacagccattgggtggaacgcagactttaaatgtacagaccagtccaatcttttaccattgcaaaatgacattctgtcacgcaaagctttcccaggagttgcaaactgagttatatgaaaaaccacactcacaaaaatctcatgagtttgtttgtttgtttgttttgtcttgttcgttgttggtttttgtgtgtgtgtgttttggagacagggtttctctatgtagccctggctacactatgtagctagggactcactatgtagatcaggctggccttgaactcagagatccatctgtctctgcctcccaagtgctgggattaaaggcatgcatcgccatgccctgcagaagtcttagaatactttaagttcagaatgctttgggttgggtggcattcataactaactacccttggtcctgtgctgtccaagggccttgggttgcatatacctgctagaagtgggatccctaaagagaaggcgactcagtcactgggggtcccaggaagttggttgttaggggctgagaacctccggacaccctgctttgaagaactagcccaggataaagcacagtcacagctagcttcgtggctccctgggccaccagcaaggtccttggaggctttctggattacctggggtctgctctgtccctgccccaagagaagaagctgggaagcaatcagaatggtacctgcctgcagcggtcatgtgaccaggcccgtgggcaggtgatctgcggcctagcacacctgtcccaacgtgctctcaacgagggcagaggctacagcacactgaccacacgcagtgggcttcatctgggcttcggacctggaaactgtgcttgtcttccgtggccgtaggtggctaggttttcggggtcctcacggctttgacattttgaatgtgagatgctggcattcttccgtagtcatcctcggggacccgttgaacctcagttctgtttaaagtgttcctttaggtctccgcctgtgtgtggcagaaaaagagaaagcttctagactcttgtcaagttctgggcctccctggcagctaagggatttattcaaccgtctgtgggctcggcagctggtggtgggtcactgtgttatgctagcagagagtcccaggagcactgtgtgggactgtgcattctatgtggatgcgccgagttccgaggtcccccttttttgagtcttccctctggttagcccacctcactcacagctattgggttttgcagacaggatgagctcagatgtggccagccagagggggaggtgatggtcacaggatttccagactcgctgccatctcccttcatttcagaaccccttaccctttccatctgtagaggtgaggaacgggaggcactaaggctttctggatgctgctgacatccaggggtttgacgtgctcaagtaggattagttacacggcaggtagagcctgcttccttccttgccccatagctctctatcttttcctatctcaatgtcttacaggtgccttgtttggggggtgttccctttcctaatgtcccccacccaattcattacccgatccaaagatgcagtcagcaggcatttgtgcagtagccaacatcaaacaagcaccggatgagtggatgaactgctgtgtcagggtcttctcctgcatcccccagtgtccagggcagagccggtgcctgggaaactcttgctcaatgaatgcgccagcaaagaacccatcttccccgccttggtcctcgggattccagggtgcacgccctcttccattaacctcattgacccaaacgttgagaaaggaaacccatggacgctgcagtctcttctcatcctagacccacattatcagctgccggaaaagcatctgtgagatgcagggaggtctcatgctgggagcttctctctctgtcgaggctgagcctgtgccctctaaggccgcagacacaagaacagagcctgtggagaccggggagtggttcgtgagataaggcatggctgggcccagcctcataccgtccctggcctagtaggggcttgaagaggctgtcatttattctgtcagagtggcgcaggcattggccagtgagggtagaggtgatcaggagtgggccctgcctgggaacagtgcctcaggagctgccctttccctagagcccttgagtgggaggtgctggcttgctggtgccttagaggctctggcctgccttcttccctaagcagagcccaggcccaacactgagacgcaggcttgtcatgcctagctctagacttatggttgtcaggctcagttgccctgtgcccataagtgttgatagacttgggttccagtagcttagaggcaacctctcccttctcctcaggccccttgagctacatgggcctggaagagactggcccttgcccttctgcctagtgaacccctagccttcccctggtgccctcttaggctctcttctaggatggagctacttattggtgtcttcctggtgcaggcctaggcttgtcctcttctctatcctgaggtatgtgttgggtagatctctaaattaccacccatagctttctctgatggaaactccggcaggtggtcagtggagacgggagactactgcccctcctttctagatgagtttaccacagagggaaaaataacaatagtagtctccccccaagttccctccttgatgaaaggggatcgatcacaaggaggtatggtttgtctctgtcagccagaccatggttgctgtcccctaggagagacacatctctgggtgtgcctgagagtgttttcagagagggttcagttaggaggtcagacctatctagaatttggcagcactgttctgtgggctaggacttgggagtgaatgaaacaggggaaaggtgctaagagccacactcatctctgcttcctgactgtgatagcatcatgtttttctaccatggcggactgaatgcctttgaccgagagccaaaataaactcctgtagctttacttcagtgagtaaaggatctcatgggaggccaagcaaggagctctggggtgtgtgtgtgtgtgtgtgtgtgtgtgtgtgtgtgtgtgtgtgtgagagagagagagagagagagagaagagagagagagaatatgtgaggccaccgcttctccctggcacccgctggggtcctttgtccatgtgtaggtcctggtgggcagggggcactgtgctgtgccgagcagcagcctggatgtcatcaggaggtctgtggagagtcagagcctcacagtgacggggacagagacctctcccactccacaaagcaccgtggaggagatgccagagcacagagttcaagggaggggagtcctgagacccatcatcaacagcgatgctcttacttctgattctcatacttccggtgccttggacagaacgcagaggggagggtccagccagccaccggcaccatctaaaggcaaacacattgatctagagcggtggttctcaacctgtgggtcgtgacctcacccccccagtcttatatcagatatttacattatgattcataattaccaaaattatagttatgaagtaacaacaaaataatattatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattacacaccaattaaaaatggcgataccacaggcatttccagggatagaggaagtgccaagagggacaaggatgaattcagagtctgcgacatgacggtgtagctggtataggtctgagaaaaaaaatggcggcttcctgttctaacagcactcacactagtatttgtttacattttctctcggatccttgtctatagcttttgcacgtcaagacacactcgtcctttgagaaacagaaaactcagtgacccccccccccccatccccaaagttccagtgacttttgctgatgggaaaagaaagtttcaggctgggcaccctgtgccagcagcctgtgccaaggctgtggtttcattagctcttgcctccctcttcccagaaaaccattccgcccttagatgtaatgggatgtgctcaagatatcagtgtcttggctgtgattgatcgattcccaacacagttccacacccctgtgtcctgggaggcaccttctgcttactggtgttatttcgtgccctgctgggggctccagatggggaggcaggaccctcagacccaacctatcccagggtgggggacgtgactgtctaggtgaggctgggtctcttcatgctgctggtaaattgatgacttcctattctcctccaccaaactgttccccagcccctggctgtggtcactgacacccagatagatgtggtaacaatcctattccgtgtgtggggctgggtgggggtgagagcggctgggcctctctgtgttaccagaagaagctcactagatatgcaggtgatcctccccccccctcccccccgcgaggtcttcatttccttctggaatgcccctcgacacctcctgacacacagaggggctagagtcttgtcacataaagaaaaaaaattactttatttccaattttccatctcacacactcactcattttctttattaggtgcactatggatattagagagagagaaaatgacatttctgccgtgaattcaaagcgcgggcccctgctttgcatagtagcttatactgattggcaggaggggcccctgggtctggagccttcagggtgctgcttggtccatgcctgggtaccctgatgctgtgtgttctctgcccaggaacccatttcttcccacgtaaccgctcctcgctcggttctgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtaggatctgttctctaaggggtggggactgaacacctccaaaacacccggcaagtgaggtaccaaagtaggtgtctcgtctcctccatccagagaagcctcgtgatcttttagagttgcaggtgtgcactctggccatcttcagggctcagtttcacttgtaagaacctcgggacctcgtcatatcgtcccatttcaccagacacccacatacactctgacaaggcggacatttccctagggtgcttcagacttccagagaccttgagggtggacactctcctgttgccttagcttccggggccgggcatggtcaggaaaggaggctagggggttagctgacaatgtcctgacactgcaagctctctgggagccagctttgggtgatgatggaggacaggttgctgccggttgcagagtgggtcagcccacctggtgcgtaccgacggggagtagggtgggtgggaggggggggtcagggtgtttaaatgctgtccccatctcctttgtgagatctggaaaagatatttgcagccagtaggcacagtgcaaagaaggcgaccatcctcctttgcctgtgtagaggaacttgggaacctttctttcccctggttgcctggttacaagatcatctgtcacgtgttcctggagaagggtgcttggctggggagatgtggcaggcggtgtgtgtgtgggggggggggtggcgggggaggcgccgggagatagtgtctgctgtgggaatcaatgggcaccttcgatcatatcacaatcccattcctattacacaggacagccccactgcccagctgccctctcaaagcctcggaccgctggggcttttttgatgcatgaatgaagactgggaagtgggccaggacttggctcctgggcttcttcatcatttattagctcctagttttaattgtttctcgacttctttccagatatttatctaggagaaattgtcagaccttgccgcgtggtgcggacacgcagggcagggcgggtactgactgcagaatctgaacagcctctctgatgagtccggctggaattgcttgggtacctactgtgtgctatgtgcagtctcctgcccatgaaagactagtcttcctgggggtgcagacaaaggaatagtatttgggttgtgttttgagtgtgcctgtggcagagctcctgggacggaggtgaactctgatccctgaaaggtcgccttatgtcctggggctttgcactctcagactggaatctaaagtggttgaaccttacacgaggttgctaaaggcgcttggaactgctcagcaaccctcaggtgggggcagagcactgagggtgttgagctcacagaagtgtcctggggtggagtaggaccaggtgaggatgctgggagtgccttcttcctctgagctctagcagcagtgggagagagaagtataatggagaataccacagaggaagccagggggactttgggggaggagccattgaagggggaggagccattgaagaccttttcccttctttctatgaactaagctgtgtgtgggtcagagtggacgctgttggtgcttacggttgttttgctgagcaggactcaggtgtaagtcggggagcccaggctggctcactcagcacacgtcggaggacatctgcccttgctttggcagacagagaactcttttcaatggaggagcagggttctagggcctgagacttagatcggccaccttggaagtcattttgcattaggtagtgtcaatttctccttctgcgctctccagggagagattctgagccacggccagctagagtgggaagggcgggctccgttccactagaaaccctgtcaatggtgttcgttaagtaagcctcactcttgtgctttggctccactgcaccccttgggagccatggtagatggaattgccatgtgagcatggtgaggtgcctcatcttcatgactggctgttagcttcctccatgggctattgccatggaaggtagcatgccccttggttaaaaggctggctcgtgagtacatcctccatgcctggacctggctgcctccatcccttcctctaggactagctcccagaaaccctttgagtctctctatctccccctccccaacctccaaggctcctttatagataaggaatttcacaaccaggggcagactaagatgttaggtgggttgcccaggtcactgagctgtggtatcaaattctttacaggtcacatgggctggggttctaagaggctcagagagcagaaatagtgtgatgatgtactgaccacaccccaggccccttcctggtgccactgtctcgggtctgtcctaccataccagcacagggaaactagagagtcaagcttacaactagccttaggctgagcctatgtggaggggagacagatctatgctagcagtgggctctagagacctgtgtgcgccccactgtctcctccacaacaagttggacgcttgtttcgactgtcctgggcttgaccgcagtcattcactttacatcagtggaagggaagtctttttacagtgtgtaagtgcactggggggaggtcgcccctttgcttcttttccaccgtgtttgagaggaccacagagctccagatgcattatgggtcaggcctatgctcagctcccccaaaaacccccgtcttttgagtacggtcagattcccaggttgctttggggccttgtggatgggcagagaccatcctgcactctggggcctgaagttgtatcgacccacatcaggaccaacgaactggatgcatctgggggggcatgaaaaaagatttgtttttgtttttgtttttgttttcgagacagggtttctctgtgtagccctggctgtcctggaactcactttgtagaccaggctggcctcaaactcagaaatctgcccgcctctgcctccagagtgctgggattaaaggcgtgtgccaccatgctcggcatgaagaaaaatttggagtgatgggggagagggggagaatggaagggagatgacttgcccactggcttctcggatagtcagctcaaatccagtctggcttgggagacagagctcttctggaatttgcactcaaattatttaaaagaatatcatcaccaggagtgaacttgggatgctagcaattaagcacttctcctgtggcctggcacttctgctagcagtgggctctaagacctgtgtgcgccccattgtcctctccacactggacgcttgttctgattgtcctgggcttggccacagtcttccactttacatctgtggacgggaagtatttttacagcgtgtaagtgcattgggggaggtcgcccctctgctgccggaacctgagttccaggcgcattgtgccaagcggtggttattatttcccccagaataatgtccttttttttccctctcttgcttttaacgtcctgcccttggcatctgttccaggcattgtggacgaacggagactgtgttctgacaatgggttaaagcaagctcttattgaaaagcattctctacttaattacgtttccttcttctggaagctattttaattttttttttataatcacatgttaattgtgtattagcggggcctttctgattagttgaaaacataatgaaacctttgtaaacaacacagagagagaaagaaaagggaatgtgtgaaacagagcgggtagtgacgagccagctccaagaggcccaaagagcgacatttcttgatgcggcagagggatggaaattgtacctgcaagtcttgctttgaatttgcaagtctcccagttgcagggccaagtgggacaaacaggccagtggtggagagagaggttcacagagtttgcccaccaggagttgtgagatgggacccggtagtcctgccccactggtctgcatctactcacacattcgttaattcaccgctgaaccattctcgcggccaatcacaattttactctggttccctccctccttccctcattcattcattcattcattcattcattcactccatgatagtcttagagcaggagctgtgtctacagaacattgaccggatgcaacccctcacatgccttttctgccgtcttccttacatcttcagtacaggtattagttgcgttgtggctgaggagactagagctcactcattcagattcagctaaggaaaggaagcaagtgagccaggtctgttccccgccccccacaagtgattggggatcctggcatctgttgggatggcatgatgctctaaggagtcagtgagtgagtgtgtgtgtgtgtgtgagtgtgtgagtgtgtgtgtgtgtgtgtgtgtgtgtgtgtgtgtcaggacggagatgagagttagcctgtggctgtcatcagaaagtttgctggtattgttttgttttccacttttaatgggagccttgtttctggacagaaggcctgaatctaagtccctgttgtggcaagccggccccagagccctgctctgttccctatttaaagggctgggctcaccaggttttttttttttgcagttcccaggctgttattagggaagcgtggctggggcgcttcaaatgaaagtgctactgtgtgtgcgagccaggttcaccgtgcgcactccaaggaaatgctgccaagacagtcttatgaacaggcgccaagcaaaacacgcgtgctccgtccagaggagccagctcacttctgcaaatagaggaaaaattgactttctgatttggagtgtttttacaactaagaagaatcacttcagtgattgttctaaaaatagcccggcagcagcacactctggaaggccccgggatggtgagcgtcctttaattgtgccttttatgtaatctctctagatcattttttttttctttttaaatcacttatgcttgcgtggtcatcccccccacctccccgtatgtaactcggagatgcgagagtggtctacacagcagaaaccgtatttttatcttttcggcttcaggaagtgtatttgggttttcgtctcctgcggcagccgctgcatggctcgcagctgagctgccaaatctagggcagctccaccgccctgccctggtggtggcccagctctgaagggaggcgtccctcacacatgggtgtgcttggtggcagtgtcactgacgccgggtcaggatatcggcctgcttttgctgttcaagctgcaggcacctttccaaagcacggaggcttcaaggttgccatcagccctgagcttggccacccaaggggagatgatgcagcctcctgtgcatgcgctgtcttcccctgctgcccctcggaacctctccttcccttctctctcctcacctctgccttcatttttctacgtcactctgttccgttacatgtgggagccagtatggaagctgaagagtccagtgcaggactcctcgtccaccgggctgcatacctggggctgggtcactctacgtgtgtgggaggaatgacctgtccaccatggcctccctggcctttgcctaagagatgcctgaagcccccttcacttccttgtgggcatgacaatcaaaatgtctccagattaatgctggggggggggtctgtgaaattgaacactggtggtctagcctgtcttccaagagtagacaagactgatttctactgccaaattttacatccagagcatattttaacatataatatgattgaccctggcttaagggtgaccttgatgtgtcccacacaggcatcagggttctcaggtggcaagctggctgtcacaggcatcacctatgaacttgtgtggtcaggaggccaggagtttataatcaagttgggtttctctgccatcttcccattctaagcccctaagacaatgctgggagaattggttctctttcttttttagccagggcaagacaaagtctctctaaaacaggccaccctagaacttactatgtagcccaagctaccctttaattcacaatagccctcctgcctcccaggtgttgggatgacagttagaagccagttttcttgatgagtagactttgtaggactgtagattgtcctctggaacttgcttggttccctctttccccacttccttttcctcctctccctccttccttggatacaccccttctccccccacccccctttgcctgggagcagacttggcctgctcccaggcaaagcctgttctaatgacccatacagtaaccacctctaagaatcatgttctgtctttaaattgattcatcactgtgaggttggatagggccaggtgtcaggtgtcaccgcctccctctgggggctcatcttcaagaaatctagaattgggtggtcaatgggttttgtgcccagcttctttggaataccatgtgactactcaagagtgatttcctagtcctagccaaaactctggcttccactggctgctctcagccagctggtcagccagccagcctgagggtatgtagacatgtggaatccaccggaccccacatgccccagggtctgggctttatggtttccggttctctgatacagcatccaggtccagggaccttctggcctcagacctatggttccaggctgtgattccacagccccgccccttccaacctcctttgtcaccgggccagccctcctggctgcccgtgtacatttactcctattctagggtgatggacagggtgctgggtggaccagtgggcacagctggtgtgggttacaggccatgactggacatagatgctaagctacccagcaaccgtactggggctgttagtggttggaggaggatatgttgtaagaatggctgtgatcactgtgtgagattaatttctttccttgttagtgcccgagtttgtgtgtgtgtgttcttgtgtccgtgtccgtgtgtgtgtgtctgnnnnnnnnnnnnnnnnnnnnttttttttttttgtttttttttttttgtttttttgtttttgttttttttttttttttatgtgagcgtgcacttaacttctgtcttcccatggtggcgatgttggcccgcatccgagccctctgattttctaacggctcatctgggccatcggaaactccagtgctgtcgggctgtgcctggtgaggatgaccacagcccggctgccggcagagggctggaggaagcttggcacggaggcagagggaaagctgtgcagaagagccgcaggtttttcatatggaaatgtgaaataatggggtgattaaatagagctgtatattaaagtacatctgacatcagaattaccataatgtgctgtagccttaggctgactactttatttgccatctgcgtcggcccaaaatcccccggggaagcgctaaaatattctgaataaactcagctccagttcttattgagagtaaaataccatttgtggcacgtcgtattgattcgtcttaattgtggtgcaaaaaaagagcagtcaccggcttgatgacttttgtgcttggtgacaagctggctagagttactccttacactgtagttggttaacctgggtcgactggcagccaggaccaggtgggcacctggactgctgcagagagtcacaacgccacccctgtccccgccccaggctgtgggcacagctggggctctctgccaacccctcctgggggaagggaatatggcggaagtgggggggagaggaaattcatccagtcctctgaacctccttctcacacccagcctgtcatctcctgagccacacagcagcaccggcaccagctctgagaggagccgtgcgcctcagcttccatctgggggttagacacactgcataccgaaggaagcagaactggagaggaggggggcgggcacctacccaggcaaagccaagtctagctggtccctgctcagtggctgtggaatgtggcgtttacctcagcccttgggagaggggggagagcgggtggcagtgcttacaaaatgcattgaagataaaaagagtcattgcagggggcttgtgggggagcactctgtgatccacaccgtgcccccccattcacaaggtccagtttttaccctataattgcctatcattatacacaatttaaatattcaaacattctccacaaaccctgggctagcatgtttttattacaaattcagaacaagggaataacctttaacttcagagacaaatgagacaaatttacaagtgcgtatctgctgttttctcgcgctttatcaatccccgtggaccggagcactttcgctataacaccactcagaacaatatacatatattacgacttgtttgtagtgtgtcggtaatgagtcccctctgcattagctaacctatataactcggcgttgaggctctccataacgccaattatctcctcacagctaaacgtacactccattaaaacgagatttactgccctggccatacttcttggggtagaaagtggagatttttgtgggtttaaggaaaggaaggaaggatggagagtttcctgggaaggaagccatgacacataagaacatcctgtgtctcctagaaggatagaaagccgcatggggtgaggttcacttgccgtgtgagagaacggggtgcagacgtggaggctcccacacacctacagggctgtccctgccttttccattcgcttcctgagttcactacattttggccactaaatgatgagtatgatttatctgtttctggcacattctcgaaacccacgccgggtcggggtggcacggaacgacacagccactctggtgagtttgtccatcagcacctcagatctcccaggaggggcctggggagacggcacagttggtagagctcttgctcacaagcctgaggacctgccgttgatttctagaacctatgttaaaaaacaaaaaacaaacaaacaaacaaaaaacaaaaccaaaaaatgccaggcacggtggcatgaacctgtgatctcagggctgaggagatcgagacaggtggtccctggagtgctctggtgagccacttgggcctgttcggtaaaatctaggccagtgagaggccctgtctccaaaggaaacaacctgaatccaagatggctggctcccgaggaaccatcatggctcgtcctctggcctctgcactgacagactttgagtacctcactacacacttgcacctgcttatacaagaacgtgtgtgcatacccccacacgcatgaagaaaagcccactggagacatgtggttcagagaggcctgcgacacgcaggttgcccggggtctgactatgtagaaaccttaggtgatcttccatgaatgtgaaggtttcgtgggaggccagggttctgagggtgaccaactgtagttgtagacactccgggggaaccgtcgtcatttgtaagatcacctgtgccctttgccctgtcctcccccactctctgtgacaaacccctctgttctcaccctcctcggatcagcccctcggtcagcaatttctctttgtttcggggctgggtggctgtttctcccagcctgaccttgcacacctggtctgaccacaaaattgaacggttgaaagaaggctgtgttgggacccatggggcgcatggcgtctgcacccgaacttctctttcactttgcttagaccaccctggccctgaagctgtgggttcacagttctcagctgtcaaatgagaggcttgttgccataaccaacctgcttgagaggcggatagagggctacctcctacgttacaggccttcacggattggtgtttgtttttattgtgcttttgacatttgtgaaattgttgttgttggtggtggtggtggcagatcatccagttggaaactccatggattttctttacctgcatcctttgctgtagtgagatttttgctagacaaatcagttcttgtcttgaatgggcttgaaattctttttctttttctttttctttctttatttttgtagaaattggaatttgttttatattcagctaagttattttctttaacacacattttctgtccttccccagacaggctccaaacctgttttcaagttccgcctccagggtttcccctctgcattgagggtcccatctccatgcgttggactcctttcttctaccagcctgtccttgctttccttcctaaagtcagcattagggtgttctcagagggccttccctagggctcccaagttgctaggactcacctttcttatggactcgatacttgaaccctcgctggaaatcacgtaatcaccgatgtcttgctgactgtggttccgtgaaagcagcccttctcctgctccatggccctggctcacagtgcttcatcagtctctgcagtgtagagagcgaggcaggtggccacacaaggataaagggtactgggaagttgctgcgagcatttgcgtgaaggaacagttttccttcccagacatggtgtgaccttggagacagaactcctgggaacagaccgattcttaatgttcagcatttagtttagttcgggaggcagagtgggtgggcagggccagccctccacccaaggctctggaatgcaaagctggattctgtggggtggctgtggcatcttctgcatgcctctcccacagcaggcagagctgtgtcttccatcatggctacctgccctgcatctaggtgcgttcagaaagtctcccttgcaggcggcctgcctctgccttgctggactctgtctctctcctcacctcagcacctctggttctttcatgtttggcttgactacagcctctagacccacccctaatctttctgcttcttcccttggtatttctgaagtccacttagtcaatttgggtcagcctgacagtattctgggtctaatgcttaactggacaccatgtgcataccccagactgtgagctcctggaggtgagggaagcaagagtcactgacatttccagtaagatgtgtctgtttaggggactatggcaattggtttgccactgtggtgaaggcggtaagcacagagctttttctcccagggcgagttaacacttggtggatgaaaccacgtggtcacctatgtggcacaggtcccacacaaggaaagagaataatattttctcaaaattatatctgcttcaccatttcctacacttgaacctgactacttggcttctctgattgtccggctctctggtgttgacaggggcaggtgggaagattatgcattgcctggtccgagccccttttagggccagtgagagtcaacacttcttttgtgacaggggtcgccagctgtgagtaacgacgcgaagtgagccagatcgggcccggtctgaatgtgaatcccaggttttccagtcagcaggctgtggggattgtgggccctactcacctgtgatgagatttgatttcctttttcctaagaagtctgaaaagactcctcctcgcgtgtggttcagatataaaaagaccaaggtcagagaatggtgatccagcctggtgtccatcattaaaagggcctgacagcatgtggaagctcaggcagggaggaaacagggattccatgaaacctggtggtggcactttctgtgacacataccatggggaaacacacagaacatgttggcagggtgtatgttttctgtgtctcccgagtcacctgctgtgcactcaggaagtagaagataggggaccccatcttgggcaatttaccacaacaaacaacccaggaaggcctcccccttcctaatgagaagtccatgctttcttgctgtccagcaacttgactgcagtgtcaagtctgaagggaacagaagtgtctgcttgcaaaagctaaggaaacgccccagactagattgaactgcaggaccacaggacagagacgttaaagcatacccatgattctcactgccatggggcctgcagtcctagtacttgacaagataagcttggaatccagccacaagatggagtctgaacagtcagtctggcctgcaatacctctaatctcttctgtagatggtcagggtgagcagttatgggtgtgtaggacagaagtcggtgtaatgcagactctaatccttaatgcggctaagcccttggatctttagtcaggactctaaattttccctcagcaccgttcatacaactgtctctctctctctctctctctctctctctctctctctctctctctctctctctctctgtgtgtgtgtgagagagagagagagagagagagagagagagagagagagagagagagagtatgcatgtgtgtgtgttcgtgtgcatgtgcgtgcgctaaatcattaagaggtgacctgtagcccctggactgtgagctgccggaggagcatgaagcatgtagggtacccaggcagtgagataaaggcccacggtgacaggaagaacacatttgttcagtcctttctgtcctggttcccactgtttgagctcccgtgtgtgggtcccacggatggcagaggggcccaggctccctgtatttgctcagggttctctgaagcacagagcagagaggattccgcagtttgcagggagagtcaatggatagatctgtctgtaagactgaggccagctgagcctgtcactaagtgtcaatagccctacatagcctccccacagccaccgtcagagccaccactctatcactcccttctgcgggtcggcacggagtcagttaccacagttctagcctaaagcaactcatcttgactttttgttcccgctgagatggaaggtcaaatacaaagacacacgtgcctcacccctatcctaggcccttgaacttcaggcacttctctcctgagcaacttttctccttacagtgcaccacatagacaccgccacttgccagccggggaacgtcaggcagatctcctcatctcttccagtcctcagtttcttcatctgtaaaatggaactgatggcagttgcagtttctgagctgtgggcgcgatgcacgaagcctgtagtgtccttagctcattgctgcccatggtagagatttcttaccgtctgtcgctacctctgctctactttctgcctcccagagctgaggtccgagtgatgacttgggtaccagcaggatgcttatggatttgtagatggctataagcgctcaaggagccccggttgacattttctctgtgacattgtgaaagatgtttttagtttttgtttttgtttttattttattttattttattttttgagtgctggaagatatggggattggcaagtactctatcactgggacgctgaaatacacctccagccggagggggggcagtttaatttaatttaatttttagattcatttgtattttattctgtgtgtatgggtgttttgcctgcttgtgtgtttgtgtggcatgtgcataccacgcctacagaacccagaagaaagcatcagatctgctagatctgaacttacagacagatagctgtgacctgctgcgcggatgctgggaacggaaccagcgtcctatgaaagagcaatcaatgctcttcaccgctgagccacctctccagccccatggggagggggacagtttttaagtgaacatgagatgtacttgtcacctgaataatggttgtactggttgtcatcatgaaactgtggagagagcactcttagcagttatagggggtgtgcgtctcaggggttggggtggggtttaagtgatgaagcaagacaagaccagccttctgtttgggttcggggtgaggaggatcactgtgagacacccaggggtaccaattactgtcccaggttcagccacctcactgccatgtggtcccttcactaggtctcccaagcagcatatgtcaccaatatgctttttggctctgtaaaatgactcccgtattccaccctagagtgaatgcctgccacagggtagacataatgggagactgtccagggacaatcagtggccttccatgagagggcactgtcaacatggaaccattgacaatgtgacacacgcagggaggcctgggaaggtggtgatggcacggtgattctctaaactgctgtccccgtggtctagcatgatcatgtgatcatgatcctcacttggcttccctcagaggtgttagtgaacaagggtgacatgagctgaggtagcgataatgctgagtgagccgtgcagtgctttgtggtttactgaggagcccgggcggcccagaccagttcccctgcttgatcagaggtgtcctttaacatttgctgcttttgagtcaagctacattactcttcttccaggccttaaaccaaaaggcatccctgaaacactcagagccacatacaaggatgggtaacaaacccgcagtatataacacctactgccacatttatacagcagtgagcggtggatagagggaggacctcacagtccccaggccaagtaggaagcaaggctcagagaggtgacatctcatgtttggctacaccctttagagatcaagttccaagtgttcagtgatgctcctatggggggtggggagtcttgtcagaagagatctggggtaggagtctgcgtttgaaactcctcagacaacatactgaaagaacaaagaaggctcagtgtgtgttctaaagatctatgaaagtaaggagggaggaagcaagaaaagacaccgcagggccctctctgggttctgagctgccccgtgtgatttagtgagacaaacgcaactgacatttctaggtctgtaggccaggattggtgcttctgaagtcatttggacccagcagttagcatcattagctgcagccgctacagcagtgtaaggctagtggaccctgtcccagccattagcaaagcagccaccgcccactgcagggcacgcactgggccacctgcgtgcaggtatctctctgagttcgatgcagcaaggacgggtttgggatgagctaagcaagccctgagtctgacgcaacctgctgtctaaggctcttcttgtctaaaagcaagccatctgtgcctgtgctgtgtctataaaatacttattcagttcctgaatagaaagacgttccaagtggctcgccagagactctctgacgttgttcagttcttaaaagtgagcagccccatactcagggctatttgtaggcgagagagagccatgaggtcgtcacatgtaaacgaacattttattttaaaaaagaagggggtggctggaaagagagttgtcaagggagggccttcaagggctgggggatttattttttctttctgtcaggtactgggggaggctgctgcctatagtgagtgaagcctagagttctgtagagggacacttaggggctctgatgaagatagctctcaccccagggtgacaagtggccctgaaatctgaccggacaagtagtcagccccctttctcctcacagtttaactatggaggtgacatctgggttctagagcatgcaggtcagaatatgtgtgcccttctctctgcttttctaaaacatggaatcggttatggctacctagttacatagtctgctttggacttcggtatttgttggatagaacagtctagaaaaacatgtggccaccagataaagagacaggaagtacttcagagcaactcaaggaaatggagatgctgagaagagatgggccccaacttaagaacaccccagatctcagcaaccatcctctgtaaatccattacttagaatgactggggcccagagaagggtacagaaacacctttaatttgatatgtgacctcctaggacatggtacttcatttgtgttgatagctccaatgtgtctgaaagggacttgtatttaccttcttaagaaacacatacacacacacacacacacacacacacacgatgtgaggaagagtctgaacctgtcttctggccagcattagctaataagctgagtatggagcagtcagggctttggagaggcacggctcctgttagcctaacagtctagtcacaagcatcgtggctacccagaccttgtgaaaccaggctagaacagaagattctcgctagaggtcatgttgcccaacacagacccacccagacaggctgggacagctggcgagagcagtagcctctgttctcccagactgtttctgtttgttgtcgttttgtttagttctgctggagggtctggtgtggaggactgtaccaagggcctcatatgctaggcaagccctgtatcctgagctctctggtggcagtttaaaggatggagtaaggcctggagagacggctttctgtaaaggaatgctgtgcaggttcgagaacccgagttccaaccctaggatgcacataagaaacaaggagtggtgtcatttactcctattctcaggatgggggatgtgggagaggacctccaggacacactggccagccggtccagcctagtctgtgggctccaggtcccagtgagagaccctgtctcaaaaaagggaagatggcgcctgatggagaacaacactggaagttgtcctcaagcttcctcatgcatgtatatatacacacattcatgcacacatgaacactcatgtacagcagaatgaggctggacttccaggattctcttatttccgtccgtccttctctgctttgctcccctccacaccaaacccacagatgcagtatcaggggatgtcgggaaaatccctggcttgcaaaagcatgtcttggattccagggctatttgccctgggcctgctggtgcaatggtccaagtgaatcccaatgctgccccaggttgacacggtacttctctgtgagtcctggccggctggcaaacctaacttagagaggtgcatgctgggaacagaggcttcagaacatacacacactgtgggggtagggggtgcagcgtcctatgaagtgtcgttagctgacaggaagtgaagatgttgtctacccaggattgtagaagccccaggttaggctggtggtacagcaaaggtggtggcttcttaggtccatttccacagccctgtctactgtagggtatggtaacagcgtttgtattggctttgccggggagtttgaagctactgacttagtgtcagtgttgatatctgtttgatagaggcaagtttaaacggaggagacgggcttttcaagactcaggctgccatactatgtgccaggtctgaaataagaggcctgttcctaccgctttggagatgttacatcccatgatggtacacaggcctgtccatgcctgtcttgctcctttaaactattaggaaggttctggcaagtggaatgtggcctcatgtcaaggtcaacagctccagacaagagattcggcttccatattgtggccggcccgattgaccgacaaatctgtagtattttggctcagggccaccagtgtccactgcgatttcttactgatgtcacccgagccagttgtaacaaatcaacacgtgtggctgctcatcctgactgctgtcacatttggtggctgcctttctgtccctgtgttttctggcagaagacaccaaaccgctcttttagactagagtcccatcccccaccccctgccctgcttggggggctggggcgctgatttccacacagtgggtgtgtgaggccattggtaagggtgggtagcgggctcttgccctgtgctaatcttgcttcacctacctgggtttctatcggacagtattttctgcacaacactggcccatgaaacgggaatctcctgtggctaaaaatctcaaacgtaggcaaggtatcatggtgctgtgtgaatgtctgtctctagcattcctggggactgggcttgagtcctcagacacgctaagcaagcattccacgacggagcatcatagccatttttgttaatttttttttctttttttttttaagtttgcaaagcaacagagtcagtagttgccaaggggaggatgcagtggagtgattttcatcccagaggaggcctttcatgacgagcatacttttctgtctgcaccactggagggtggggtattagcattgactatgtggaggctctccaccccccttttgccccagcagtgaattatgagggtggggtctccatgtcaccagtgactgagtcaataaacctgggcgacatggtgaggaggtgacgcttataccctgtctcttacacaatgtagccattgtcactgtctcccatccagcccccaaaatgatgaaaataagaacacctacaggggacgccggacctagtaaatgcaagctagtcccaggtgatccagaacctgctcatagatcccgtgtttccttgccgtcgggggaggctcgtctactgcacaagtgactccaaggattccccaggcctgctcctcatagatcttgttttctctgggtggatgcggtgaagccggtccacccctgtggccatcccagctccccccgcaactgctcacgctcagcctttcttctttatgtttccccaggtaaagatgagccttccagctacatttgcacaacatgcaagcagcccttcaacagcgcctggttcctgctgcagcacgcacagaacacgcatggcttccgaatctacctggagcctgggccggccagcacctcgctcacgcccaggctcaccatcccgccaccgctcgggccggagaccgtggcgcagtccccactcatgaatttcctgggggacagcaatcctttcaacctgctgcgcatgacgggccccatcctgcgggaccaccctggcttcggtgagggccgcttgccaggtacgccaccgctcttcagcccaccgccacgccatcacttggacccacaccgcctcagtgcagaggagatggggctcgtggcccagcaccccagtgccttcgaccgagtcatgcgcctgaaccccatggccatagactctcctgccatggacttctcccggcggctgcgagaactggccggcaacagctccacgccgccgcccgtgtccccaggccgtggcaaccctatgcaccggctgctgaaccctttccagcccagtcccaagtccccgttcctcagcacgccaccgctgccacccatgcctgcgggcacaccgccaccgcagccgcctgccaagagcaagtcctgtgagttctgcggcaagaccttcaagttccagagcaatctcatcgtgcaccggcgcagccacacgggcgagaagccctacaagtgccagctgtgcgaccatgcgtgctcgcaggcgagcaagctcaagcgccacatgaagacgcacatgcacaaggcgggctctctggctggccgctcagacgacgggctctcagctgccagctcccctgagccgggcaccagcgagctgccaggtgacctgaaagcggccgatggcgacttccgccaccatgagagcgacccatctctgggccccgagcctgaggacgacgaggacgaggaggaggaagaagaggagctgctgctggagaacgagagccggcctgagtcgagcttcagcatggactcggagctgggccgtggccgcgagaacggaggtggcgtgccaccgggggtggcgggcgcaggggctgcagctgcggctctggcggatgagaaggctctggccctgggcaaggtgatggaggacgcagggctgggcgcactgccgcagtatggggagaagcggggcgccttcctgaagcgtgcaggcgacacgggtgatgccggagctgttggctgtggggacgcgggtgcaccgggtgcagtgaacgggcgcggcggggccttcgcgccaggcgcagagccctttccagctctcttcccacgcaagccagcaccgctgcccagccctgggctcggtggtcccgcgctgcacgcggccaagcgcatcaaggtggagaaagacctggagctgccacctgccgccctcatcccatctgagaacgtgtactcgcagtggctcgtgggctacgcagcatcgcgccacttcatgaaggacccattcctgggcttcacggatgcgcgccagtcgcctttcgccacatcgtcggaacattcctctgagaacggcagcctgcgcttctcaacgccacccggggacctgctggacggcgggctgtccgggcgcagtggcacggcgagcgggggcagcacacctcacctgggtggtccgggtcctgggaggccgagctccaaggagggccgccgcagcgacacatgtgagtactgcggcaaggtcttcaagaactgtagcaacctgacggtgcaccggaggagccacaccggcgagcggccttacaagtgcgagctgtgcaactacgcgtgtgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggtgaacacttgctgactaatgatgtcaaaatcgagcaggctgagaggagctaagcgcatacgtgggggacactgcgtgcgtgcgtctgtacagcgtgaccatcgccaaccttcgccaacgggaccggtgaccggactggcctctgcatccccggggcccagggaggcggcagtccaacctaacctgtgtctgcgaagtcctatggaaacctgagggttgattaaggcagtaaaaaattaaaaaaaaaaaaaacaaaaaaacaaaaaaatttgtggagccttttaactgtgcaataatttctgtatttattgggttttgtaatttttttggcatgtacgtgcaggtacctattattattattatttctgtttaaattcctttaaaagattttgttgagtatccatcccttcatttttttttttaataacccagtagtagtctgagcaatgactcgcaagtgacgtagagggaagctatcttttaaattataattttgtgtgtgtgtgtggggggggtgctgcttttttgaaatttaagctaagcatgtgtaatttcttgtcaagaagccaacacttaaatgacttttaaagttgtttgcgttttcatcatttactttgtcctgaaatgaaaagtggcatgtgggatttttttccgggggggaggggtggctttcaaaaccattttttttttttccgggaggtggatgtacagcggattacaatctttaaaattgtagcactttgtcttagcatcgcattggagagttagcactgatgtcctcctgagccacagaggcgtctctgtgtggaattcaactttcatgctatggaaggaaaatgttgaggggggcgtggcaaacgagcctctcccccacttgggaccccgagaatcttttccagggtgactctaggaacagcccccacatcnnnnnnnnnnnnnnnnnnnnaacagccccccacatcctgcaattgtgtgttaccaggagatatgataatgtccttttctgggggagcttggcgtattgggaagccgcctctgccctttgctgtagatttggctgcataaaatgggccgaggatacccactgggtagacagctgtggcctgtagtggcgggaaagaagagactaacaatgttctctcaggcttctcctggcaagatggcttctcttttcagcccccagcctacagataaatcccaggtgtccattgctacagtggtaacttgactgtgtcccaagcagacaactggccctgatggtgaactggagaagttagctgcggggtcgctcatctcacgctgataggcactgtagggcaaaggaatctcacccgttctctcttcccggaggagctggtaagagttctgtccaaggtgccccacgctgcttccgtttctgtgttttgtcttttccttcctccaattaagttgggacatactatacattggacttgttgggatttgatgtttgaattctgttgacccgcactttaaagcttttgtttgcatttaaattaaatggcttctaaacaagaaattgcagcatattcttgtctttggcccagaggtgggttaaactgtaagggacagctgagattgagtgtcagtgttgctaagcgtggcattcacaatactggcactataaagaacaaaattaaataatttattggacagtttctctactgccattcaatttgatgtgcgtgccttgaaaaccgatcttcctatttgagtctcttgagacaaatgcaaaactctcttttttttttgagatgaaaaaaaaaagactttttaaaaagcaaacaagagaagtacattctttagaaacaaagccacatttactttaaattaaaaaaaaaaatcctggttgaagagagaggacgggaaaatgccataagaccagtcaaatgaagaaataaacccagcacagccctggacatctattagcagaatcgttttcagacccccctcccccttttttggggcaacgctgcttagatatggagtggaggtgacttactgctgaattaaaactcacgtgacacaagccgatattgttgaatgaaaaaacaaacaacaacaacaacaacaaaaaacaattcaggaacaatggctgattttttttttcctcctaaatttaaatttagtgcactctgtcttaaaaatacgtttacagtattggatacatacaagggtaaaataaatcgtgtgtatgtgtgttggagcgatctttttattttattttattttcaaagtctgcttaataggttatacagaatgccacaatggctaggtgtatattgttttcttttggtgatggggttttagtatacattatatatattgaaatttcttgattactgtcaaagtggaccagtatttgtaataattgagactgcctgggcattttacaaaatgagaagaaaaaaaagtcctttttcttttccttgaaaccgttacagtaagttttaaatggtgggtctataaaatctgctctgtcacagcaacctgtaaagtcggagttttagtaaatttttttctgccttgggtgttgaatttttattttgaaaacaaaatgtatagaaacttgtatttggggtttaaagggggattgctgcaatgtgtagaaaaagtatgtagagaaagtgcttaatattgttactgctttgcagaagaagaaaaaaaaaatcacacttctgacctgtgcgtatttttctctcccacctccctctggaatggatctattggtcggttcatatgatgtaggctctcgctgtatttttaactggagcttgtaattttttaactgtaagcttgtccttttaaagggatttaaatgtacctttttgttagtgaatttggaaataaaaagagaaaaaaaaaacaaaaacaaacaggctgccataatatatttttttaatttggcaggataaaatattacaaaaaaaaaatcccccacaaaacaacaaacaaacaaaaatcccacccacatttgtatgttaagtcctcttgtatggggtggggggagggttgtttgacaaccttcaagagaaaaagacacagaaagagacatgctttgattcacaagtcattttagttgtatatagtctgtcagaattggcctactcaaaaagaactgttggctttgggctttcattcgaatgccccaactttgcatctggcctccttggtgaggccacagccgacttgatggcaagtccttacttgtgttgagtggagaaaagaaagcccttcctccaagaggcagtctataagatggtagcgcggtgagagagcaagggaggttaccttctccgctgtggctactgcggccaccccctccaccccctggccacgctcaggagcagagagaatcgacagctgcttttgtccttgagcaaacctggatggagcagcgaagcttctgagaggagcagctgggcccaggggagcctctgccactgagactggtgcaggcgggacagaggagagccttgcacgcaggtcctgttcccttggaatgtctgctccattttccccctctgtctctctgcttttctctgcaattccatccgtttcagaccagtgaggcctggaatgaaggaattctgtgccttcccatctatgttccctccgtcctccccaggctctgcctactctttgtggactcctctttaattttcttcctcctttgccccctctccccaaaccctcttttctcttcctttcttctctccttcttttcttcctcctcctcctcttcttcttcttcctcctcctcctcctcctgctcctcctcctcctcttcttcttcttcttcttcttcttcttcttcttcttctttttcttcttctcctcctccttcttttttttttttttttttgtaaagccaagtagctttaagataataaaatggttgtttattggatgagggaataatgatacactccacaaatacctatatcaggaagccattttttttttaatttcaggaaatgtaagaaaccatcatttcaggttatgaaagcgtgattgtgcatctttccaggcagatctttactaaatgcagagtctgtctcactgtttcccatttgacacagttaaaagatgggggcctagtgggaggccaggcctaagtctcagtgtcctgcatgcctgccctacggcccagggttaccctgcccttttgacaccctgcctctctgctacctgggagcctctgtgtggttctcctgtgctcataaaagctagccagtgctcaccagctcacctatcaccagaatgccaggactaagccatcctaaagcacaaggacttgtgtgtctctgtcaactgcagagagaagaggatttttgcttctcttatcaaagagaaaaatcaaccaaccaacctacccgaagcaggtgacccagcctaagggctctaccgcgggtgacccagccgacctcaggtcgggttccacactgccacaactttacccaaagttgctccctattggaacctgccacttgccattggagggtcatgggggggtggggggagaggagactggattactcgaagcaaaatgtgaaccctgaagcgaacacagccttccacctggccctccccgtccgaggtttgattccgtgattttggtgctttctgtgtctgccctgcatagccaaggcacattgatctctgcggtttgcttttgtactggcaaggcggaatatttttattaccttttctattacgtatcgtatgagcttttgttgtttgcctagagggtttgtctcttacagcaagtttggagctatttattattgcttggtatttgtgctctgcttttaagaatgggcacttggttttatttttgtttgtttgtttttttgttgttttttaattatggataaaatgttgagatgacaaaaggtcatttcaatatggcttagtaaaaatatttattgtttcttctctgtacaagattttgggcctcttttttcccccttaatgtcacaatgttgagttcagcatgtgtctgccatttcatttgttcaaaaccaagtttgttctggtttcaagttatgaaaataaattgggacatttaacttgatctccaaaccttgtccttttctgtgtcttttaaaggtgggggatggacagcttatttctaagaggggattgaaggtctctgttttcccttctgatttacgctttaagtccatggccaggaagagagagagagaaaaaaaaaccacttccaggaagcagagaggtttggaaaggctcttagccccggctatacaccatgtgcatacacagtgaggccttgcctcaagaacaaacagcaaaattaaaatgaagaggggaaacggctatgaaaagcagttcacggcagcccagggtaactctggtaatcacggatcttccatgctatgctcccttctcagtcatggtcaagcacctctgccgtgggtttagcagatgctgtgaccatatcctgagttcagttaaatcccgggttgggccacgtgaaaccacttatttatgttttgcctgggaggcggggaatatggtctctaagctctgcattctggaagcagtagccaggtctcaagtctgaggttaacctgggttctaatattggggtccaggccagcttggggtgtatagcaagatcatgtatgagaaagagagataaagagaaagatgggggaagaaggaaagagagaagatggggggaggggagaaaggaaaggagaggaaggaaagaggaagacaggaaggaggaacaaaggaagaaaagtggcaggcagagactcagaactggaaaccagtgtattgggtcccagacagcttctctgtgcacttgagcagctgctcttggctttccaggtcctgaatgagggttcaaggtcagacagcggctctgatggccacaaggggaggattccctcccctcccctcccgccccctcctcttcccttctcttcccttctttatgcaaggcgttaacaagtggaagaaacaatctctggggttcaccagtgtcaagccttgcacagtgaaagagtctggaacttttggttcacatgcagagcagcctgatggaagatgtcggggttctgtaggcttctgggtgtgtctgcacgggtgaagttacgctttcctaactccacgtgagctacatggaaagaaggaaaggtcctcctgggttcctgatctcaaagcgacaagggaattccacctgaaatcacccaccagtctcatcatgagctgagtgctgtgctagtgagtgttcactgggagcgcggaaggaagggagggaaatgtaggagcctcatggccaaggcgctctgtgggttccgcccacggaggctgaggcgaccagacaaccaggacgatgtgctaccctccatcacgtctttagcccaaaccagacaatgtcctcccaagaagcagtcacatgacagaacaggaagaacaatttgaaccgctgcaccggaagtggagcagagcactgcttggtgatggggagcaggagagaagggcaggcccgagtgctttctagagcccaaggaacaagaattcccagggaagacgttttgtttgtttgttttgcttatttttcccacagcctttccctcagttggcttagaaacacaggctttaagccttagtacttcttacccagagggatagtggagctgaaatggtccaatctcttaccttaagaactcagagagtgagctcttttggggaggtggggaggggagaagagacactctcctctttaagccaggggaacaaatgcttagggttgagtcatggaaattgttcagatgaacaagttagcgaatgctcaggcttacaacaaaccgagggccatggggcaaataggggacaatgtagggcaaagaaagggcttgatggagtctcaatcggtttccttggtaactttttatgatctcaggtcagtctcttcccttttctgggcctatagcaaagggttaaggcaacagggctgaaccattttgccctcagacactaaaggtgataccagatgcctgggttccaccaacagagcaagcttgacagcagaatatcccggttgctggctgcgactgaaggtttcccccgagatataaatcctgggatctctgcagtttccaatcgtcccgttgtggtttggggcatctctgaagtttctggacagctttagtcaccccattctgagctgcaaggtccagcaattaaaatgagaaaaattcccttgtctgctttggagataaaaccagaggaacgggactttttatgttaatgtgatggagatacataacgaatctcatgtaactttcaagccgggaggatgaaaacgctgacgctccgtgcaggtgatgccttagccactaattgcctgccctgaatagtcttcaaaacggctccatcggattctgattgcagaccatctaggatgcttaaaagacgtctaaacaggctcaacctggaaaccaatttagctccaaggcagggactgagctgaatgtcatgtgtgtgaacgcagggagggctcggcttgtctcctcgctcccaaggagagaagcaggagaggcagaatttttcccgggctaggtggtgtgggtagcaaaggagtgaagaagagggaggagtggaccagccatgaggcaggagggccaggaaactgtgctgttccttcagagaggaatcaccagcaagatgagaaccgagggagagatggtgcctcttacagagggcaggagggagaaacttcacagcgcttggaagagcagagtcaagttcatagagaagcagaatcccagagatggctggcatccttacaattcatttagcatattcctagctaatccatccatccatccatctacccacccacccacccacccaaccatccatccatccatccacccatccatccatccatccatccatccatccatccatccatccatccacccatccatccacccatccacccacccatccatccacccatccatccatccatccatccatccatccatccatccatccatccatccatctatctacccatccatccacccatccaccatccatccatcttctatattgtttgtaccattgaatctttcaaacacctccattgtcctccacagccagcgtgtcctatcttcctgtttgattcccacagtactgaaaaaacaggaacttctgtggataagcacttcattctccagtaactccatcactgtcttaatctgagagtctgtgactacttagacaccctcagcaaggtgtgaggtggtgagcgacattagtcccttgcctgaggttccagccattttctccctcacctgtgacctagctgtacggtattctgccccagctgtacaaggtcttgggaagtgcgagagtaccttgagtgttgagggttaatagaaatagggaacccatctacgcagctatggggggagtcatcacttatgccagggtcacctacactcctacaagcaacccggcacccatacttctggaagccagttcaggacactcattagctgtccaggatggacttggtgtgtggctttggcgactttaggtgcgttgcaaagtgttacattgctctgtcattgatgccctgcccaagggagtagacagtgcttgtgtctcctaggaagagttccagcaacaaccccaagaacccagtgtcgaaagacagcaggactctgtacctcactcctactatgtggccatcctgcctgctgctctgttctcatcttggcctttaattccagcactcaggaggcagagacaggcagatctctgtgagtttgaggctagcctgatctacagagctagttccaggacagccaagacgacacagagaaatcctgtctctgaaaacctaaataacctgatatagctgtctcccgagaggctctgccagtgcctgacaaatacagaagtgggtgttcacagcctaccatcggactgagcacagggtccccaatgaaggagctagagtaaggacccaaggagctgaaggggtttgcagcctcataggaggaacatcaatatgaactaaccagtaccccccactgagctccctgggactaaaccaccaatcaaagaaaacacatggtgggactcatggctctagctgcatatgtagcagaggatggccttgttggacatcaatgggaggagaggccttggtcctgtgaaggttctatgccccagtataggggaatgccaggacagggaagtgggagtnnnnnnnnnnnnnnnnnnnnatccattcatccccccacccactcactcattcaaacagctactcacccacccacccacccacgtgcttcttcacttcacaaacattgaagacacatgctgtgtcgcagacacggatggaagttaggggcaagtcaaattctcattgcctttcaggaagttctctttcagtgggcagaacaacttatgtatacattcactcatccaactacctgcccacccacctactcatcattcctttccaactctggagttaccacctctggcctacatgtacaggccttgtcatggagtcactccattttggatgggaatgccacgggacaacaggtaaatagggcttggaatgttgaccaataggcttcagtgggaggttggagcaagggttctccatacccaggtctctctttttactatggtttatttttcagatcacattgaaaaggaaattgtatttttgtactctcttataattaaaaacaataataaaaaaaaggaactgtctggcttaggacacagtgtagtttgtgatcctcgggaccttgtctagaacaaggagaaggacttttatctgttcaaatcccaaatggtgctgctgtgtagctcttggtccagactatggaagagtttttggctccaagtgcactgaagactgcaatttccaaaggcttggctagcatctcagtcaatgaaggagacctgggttagggacagtgccacccaccctctttccctattatcatggagacgctgccaagtgctgtgcaagtcctgtgcagtgtggtggggaatgcagaactgctgggttcaaagtgaacctaggaagcccaagcagtagtcagcaggtatcatgcacccaaacatcttccacactgggtgcggccccgccctttgcctgtgttgggactatgactgagaattggctttatcatctgt

SEQ ID NO: 1284 - DNA, 2697 bp, Mus musculus
ggcggcggcggctcagaccccctccccggcccgcatctgtgcagctttccgggcgatgccagaatagatgccggggcaatgtcccgccgcaaacagggcaacccgcagcacttgtcccagagggaactcatcacgccagaggctgaccatgtggaggctaccatcctcgaggaagacgagggtctggagatagaggagcctagcagcctggggctgatggtgggaggccccgaccctgatctactcacctgtggccagtgtcagatgaacttcccgctgggggacatcctggtttttatagagcacaagaagaaacagtgtggaggcctgggcccctgctacgacaaggtcctggacaagagcagtccacctccctcctctcgctctgagctcaggagagtatctgagccagtggagatcgggatccaggtcacccctgatgaagatgaccacctactgtcacccacgaaaggcatctgtccaagcaggagaacattgcaggtaaagatgagccttccagctcatttgcacaacatgcaaagcagccttcaacaagcgcctggttcctgctgcagcacgcacagaacacacatggcttccgaatctacctggagctgggccgggcagcacctcgttacgcccaggctaacatccggggcacgagcaccgctcgggccggagaccgtggcgcagtccccactcatgaatttcctgggggacagcaatcctttcaacctgctgcgcatgacgggccccatcctgcgggaccaccctggcttcggtgagggccgcttgccaggtacgccaccgctcttcagcccaccgccacgccatcacttggacccacaccgcctcagtgcagaggagatggggctcgtggcccagcaccccagtgccttcgaccgagtcatgcgcctgaaccccatggccatagactctcctgccatggacttctcccggcggctgcgagaactggccggcaacagctccacgccgccgtccgtgtccccaggccgtggcaaccctatgcaccggctgctgaaccctttccagcccagtcccaagtccccgttcctcagcacgccaccgctgccacccatgcctgcgggcacaccgccaccgcagccgcctgccaagagcaagtcctgtgagttctgcggcaagaccttcaagttccagagcaatctcatcgtgcaccggcgcagccacacgggcgagaagccctacaagtgccagctgtgcgaccatgcgtgctcgcaggcgagcaagctcaagcgccacatgaagacgcacatgcacaaggcgggctctctggctggccgctcagacgacgggctctcagctgccagctcccctgagccgggcaccagcgagctgccaggtgacctgaaagcggccgatggcgacttccgccaccatgagagcgacccatctctgggccccgagcctgaggacgacgaggacgaggaggaggaagaagaggagctgctgctggagaacgagagccggcctgagtcgagcttcagcatggactcggagctgggccgtggccgcgagaacggaggtggtgtgccaccgggggtggcgggcgcaggggctgcagctgcggctctggcggatgagaaggctctggccctgggcaaggtgatggaggacgcagggctgggcgcactgccgcagtatggggagaagcggggcgccttcctgaagcgtgcaggcgacacgggtgatgccggagctgttggctgtggggacgcgggtgcaccgggtgcagtgaacgggcgcggcggggccttcgcgccaggcgcagagccctttccagctctcttcccacgcaagccagcaccgctgcccagccctgggctcggtggtcccgcgctgcacgcggccaagcgcatcaaggtggagaaagacctggagctgccacctgccgccctcatcccatctgagaacgtgtactcgcagtggctcgtgggctacgcagcatcgcgccacttcatgaaggacccattcctgggcttcacggatgcgcgccagtcgcctttcgccacatcgtcggaacattcctctgagaacggcagcctgcgcttctcaacgccacccggggacctgctggacggcgggctgtccgggcgcagtggcacggcgagcgggggcagcacacctcacctgggtggtccgggtcctgggaggccgagctccaaggagggccgccgcagcgacacatgtgagtactgcggcaaggtcttcaagaactgtagcaacctgacggtgcaccggaagaaccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggtgaacacttgctgactaatgatgtcaaaatcgagcaggctgagaggagctaagcgcatacgtgggggacactgcgtgcgtgcgtctgtacagcgtgaccatcgccaaccttcgccaacgggaccggtgaccggactggcctctgcatccccggggcccagggaggcggcagtccagcctaacctgtgtctgcgaagtcctatggaaacctgagggttgattaaggcagt

SEQ ID NO: 1285 - DNA, 2442 bp, Mus musculus
atgtcccgccgcaaacagggcaacccgcagcacttgtcccagagggaactcatcacgccagaggctgaccatgtggaggctaccatcctcgaggaagacgagggtctggagatagaggagcctagcagcctggggctgatggtgggaggccccgaccctgatctactcacctgtggccagtgtcagatgaacttcccgctgggggacatcctggtttttatagagcacaagaagaaacagtgtggaggcctgggcccctgctacgacaaggtcctggacaagagcagtccacctccctcctctcgctctgagctcaggagagtatctgagccagtggagatcgggatccaggtcacccctgatgaagatgaccacctactgtcacccacgaaaggcatctgtccaagcaggagaacattgcaggtaaagatgagccttccagctcatttgcacaacatgcaaagcagccttcaacaagcgcctggttcctgctgcagcacgcacagaacacacatggcttccgaatctacctggagctgggccgggcagcacctcgttacgcccaggctaacatccggggcacgagcaccgctcgggccggagaccgtggcgcagtccccactcatgaatttcctgggggacagcaatcctttcaacctgctgcgcatgacgggccccatcctgcgggaccaccctggcttcggtgagggccgcttgccaggtacgccaccgctcttcagcccaccgccacgccatcacttggacccacaccgcctcagtgcagaggagatggggctcgtggcccagcaccccagtgccttcgaccgagtcatgcgcctgaaccccatggccatagactctcctgccatggacttctcccggcggctgcgagaactggccggcaacagctccacgccgccgtccgtgtccccaggccgtggcaaccctatgcaccggctgctgaaccctttccagcccagtcccaagtccccgttcctcagcacgccaccgctgccacccatgcctgcgggcacaccgccaccgcagccgcctgccaagagcaagtcctgtgagttctgcggcaagaccttcaagttccagagcaatctcatcgtgcaccggcgcagccacacgggcgagaagccctacaagtgccagctgtgcgaccatgcgtgctcgcaggcgagcaagctcaagcgccacatgaagacgcacatgcacaaggcgggctctctggctggccgctcagacgacgggctctcagctgccagctcccctgagccgggcaccagcgagctgccaggtgacctgaaagcggccgatggcgacttccgccaccatgagagcgacccatctctgggccccgagcctgaggacgacgaggacgaggaggaggaagaagaggagctgctgctggagaacgagagccggcctgagtcgagcttcagcatggactcggagctgggccgtggccgcgagaacggaggtggtgtgccaccgggggtggcgggcgcaggggctgcagctgcggctctggcggatgagaaggctctggccctgggcaaggtgatggaggacgcagggctgggcgcactgccgcagtatggggagaagcggggcgccttcctgaagcgtgcaggcgacacgggtgatgccggagctgttggctgtggggacgcgggtgcaccgggtgcagtgaacgggcgcggcggggccttcgcgccaggcgcagagccctttccagctctcttcccacgcaagccagcaccgctgcccagccctgggctcggtggtcccgcgctgcacgcggccaagcgcatcaaggtggagaaagacctggagctgccacctgccgccctcatcccatctgagaacgtgtactcgcagtggctcgtgggctacgcagcatcgcgccacttcatgaaggacccattcctgggcttcacggatgcgcgccagtcgcctttcgccacatcgtcggaacattcctctgagaacggcagcctgcgcttctcaacgccacccggggacctgctggacggcgggctgtccgggcgcagtggcacggcgagcgggggcagcacacctcacctgggtggtccgggtcctgggaggccgagctccaaggagggccgccgcagcgacacatgtgagtactgcggcaaggtcttcaagaactgtagcaacctgacggtgcaccggaagaaccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggtgaacacttgctgactaatgatgtcaaaatcgagcaggctgagaggagctaa

SEQ ID NO: 1286 - DNA, 44323 bp, Homo sapiens
aaaacaacacagtggcaatcgtgccgaggggaggttaagggggatcggctgaccacgcagaggaaagggccagagcccgctgtgccagacagggccagggtgaagggaagagtacttaaatccaagaaggagcttgatgctttctgaagagaccaaggaaaataagatgtccacggtaaactgcgtaaccccagtcaaggtgattttctcaacaacccaccaacaggtttcctaggaagattagtaattttccgtatgaattcacgattttgtaaaacaactagagacccaagcaagattcaatgcaaaagttaggctaactgtgttaattccatggttaccttttgaattaggttttgctgtagctgtgtgttttgaaggcagcggtgctcacaattatcttaactccccagggtagagtatatctccagtggtccacatgtctttcagaattgggcctccgataaatttcataagacatagccctctttttttttttttggttagttggtggggggggggtgaagttcctctcccttctgcacagaagggaaccccatatcattagaagtgtgatataagtcagctgctctgattcaatgggagaataaaaacgtgttcaccaaaggtgttatgccaggctgattttattcatttgtaattcacacctgagagaaaacagccgtgagcatattttaacagcccctaatatttttaaagggtcttttttccctacctgaatgatatgatgtacatatgcatatttcttttcttttcttttcttttctttttttttgatggggaggttgctatctgcctgtgcttggccttggcgattttttgtctggcctttgaaatatttcataacagaaaactaggcatttctgaagtgctggggtgaatgcagttgcttttgtgaagccggccttagagacatcgaggctgggttagctggttgggtgtgttgtgtcagtgaccagtgtggagggctaagtgggtcctactcaacccaagggaaggccaactttgggtgcatttgagaataattagaattgtgtctcaggtgagacggaagcacagaaaacagtcgtttacagataccagtttctagcgccttctcagaatggagttcttggcactgtcttatagcttagaacacggcttgcaccagccttcacttatccccttttcatctcctatctcgattgctttgcattctctgttgcttgttgtgataaaatactttccaaaataaactttcagttgaattggcttttggttgatggcaagctgaaacgccgagccgcgcctagcgccacttggcagctagggggagctcggtgcccgtgtcatggcttggcgcctccgctacaatgggctaggaacgggcttccatcagcagcggcggcagtttacgttgctgcaaaataccttaagtgtgaagttgtaatattgattttccagcagagattcgtgcaggacaaaatgagaatataagtttgagaaatctattttcaagctatcgccattgatttacaagccctcacttggcagatgggggcattttctttttctttgattttctttctttcttttttaacaattaaaattgtgagttttgaatgggtgtgttttccctgattcgtccgtggtcttgacgttctgaaaattctgctgcgttattaaggcgctggtgatcgggctggggaggtctggggaaggcgtactgctcatttctgtcttgcatgtcacagacccagggaacagtcgagagttgctgcttttgggagtcgtgtacctaaaacagcttgatgaatggaaatccttttagctcaaattttatgacacttggattctcaattccatttattaggtaatgttcccactgaactaagggaaatagcaccgttccccaaagatttaaaatgccgactcaaataacatgtaaaactttgtttggaaagagtatgtgattgctagagccagtcttgatcacatctttcaccccaaacagttgtcctttatggatggcttttaatgagaggatttctcccctaaacatgtaatctagtgatggggaatatatgtgcttttgatcataggatttctagatttataatgtcttctttcccaagttgaagaaatctgcagactgcaccctgagtcttatgctagagttcaatatatgagcagaagaggttaccctgcgacaggaaagagtgctttattctaacctgaaagagaaataaattaggtcagacaaaagcctagcgctgtcgtcagctggagaaagagccttcactctccagtacacagggccagcaatttatctgatgatttctctacttcatttaatgtttgaatcgagccagttgtaagcatgtagtggcagcgagctcactggaccactcagagatgaagaggcacggtgacctcgaagtcttgggccggacggtggtctctgagctgcagaaaaccgttaaaaatcagtttagcaatctccaatcctttgccttagaactcaggggagtttcacaagctgtaactaaacacagatcatagataagacaatgcaggaaaaaatatatgggggagggaatgggagggggtcaggttcttgtccgttggagactctccttcatctcccatggcttaaggatggaccttctggctgcctggttaggcctcacctttagctgaaactctccaaagactttggcctcgaggttaatgttggcttcacatctggggaggacaaggagaaagtaaatggtctttggggactgtaccctgcaccacatggttgagttattgataccggctgagcatctttctctgaagacggtgttagctgtagatacacttttgtatttattaatggggaagggtacagaagacactaggaatgaatgtctgtgtcatccagctgccgtgagtatgctttgtcactttgcggcactcttttgactcaggccatttggcctgaggtcctgtgcggcactcttttgactcaggccatttggcctgaggtcctgtgtgctctgtcctgtccctactccctgatcccactcagcttccttccggtcccagggagccaaatgtcagggagatgtgctcaggctcggtccccctcttgctccatccctccccaagaaacgccgtgtgctgactgcctcccttgagcaagtatgtttcccagggcgtgggtaaaaagtgccgagagcaggctatttggagacgcgtggaaagagaaggacacatttcttgcgtcttctgcacaagccagtgaggagggtgagcagagcagccttgttttttgctggcaaaagtgacactagatggaggcttgatgaatggtgccacattcacgggatgttggtccagcattttgacatatgctagtcttttgtgcagttgctgaaaatcaagaaattcattcttttttctttttcttgtggcagctgataatttgcttgggtgttgaatagccagcctgagctattttactgtaatgaaatcccagaccacacaaaattaagtcacttcaaagtaaaaaaagaaaaaaaaaatcctctcttttacataacttcttttttatggcccccttccacttattttattgaaatacaaataaatacatttgtgaaatgttctaatgagttttctactaaaacaacacgcagaaatgactcaagaaaagttgagtgccaatattattgtgattaacatgtgcctcagaaatggatgcactgctaagaattaaaaaaaagggggggggcggtgtcatgtttaaattcctaccttggaaaagagatgtcgaaagcactcctgcccttgctatttgctgttggcctcagataatccaaactcctccagctaaagccttgaggtccagtgtcctgtgtggaagcccttcttttcttccgcacctttgaaaaaagcataatgttaaataaaaacaaatctcttcatttgcccacaaagagtgcttttttatcacatcgttaggagcccgttgtggctctgaagattgaaggcatttgcagttttatagaacctgctaaatgtgttgagaaggattgctattgtggtaaatcttttccttttctttttctttaaagcgcctattttatttgtcaagacttttatttgtaaccttttagtaatggctgagacctgtgaatatacctgagtatgttttccttattcacttgttcttttttctgctcttgtgctggggagacccaggctcctgggctcagtttttggggttctggagaggtgtgtgcattattcttttttctgctcttgtgctggggagacccagactcctgggctcagtttttggggttctggagaggtgtgtgcagtgggggagagaaggcggttggactccatagagcaactgaggatatttttcagggagctgcttaagcatcctaaaattaggctggagtcctgcaaacaatctgtacacagggagaccctccccaaacattcgactttcccgcctggagtctgtagaccagaaggtatgggagtgagcctcttcctgcatctaaaacctcttcacggatctggagtttccacctcctggcctgcaggccaggcccaaagtttccgctgctggcggagtcagcgggaccctggtcattttcctgggaagcccacactgggaagcatgttttgcaccggccgccttcccttgctctccctctcacatgtcagaaacggcgatcgaggtgtgtgcctcagctgaggaggggcagacaggacctcatggggtggtggctgtggtatgtatctgtccctccagggaggcagcctttggagggtgtcaggagggtgcagagctgacctggagcaggctggactcctctgactgtctgctgagagggtcgagggtcaggacagagaggtgtgatctgggtcttgcttcctgcttcagactccgcctggctgtgccttcccagggtccccacccccaacttgtgtcctaataacccttcgagaccccctgtggacatcctcctgacaccagcctccctcttatctccatttccttctctgccaggcacttcattattccctccgttaggggaacttcataaaatctcttgtcgtgcctttaagcgtcatctagtcatagattattttctccaccaagaattgattcctgctctctccccctccacccttctcctcccccctccctacggttgttattttctcttggatccaataaattaaaaatggatggcagctcagaaagtgttgtgctccgtcgagtgtgcgtgtggtggcgtttccgtgtcgcctggagtcccagcccctccccaagtgttcacggagaggagatgaaaagatctcttcgtagattatgggtaagcatgggctcgctggcaagagctccctcttcgtaggaagcaggtgtaaagtctccagtcggatgcagagctcgggcggatggatgctgaacatttcttgtaaacatgcgtacacatcatgatggcggttgtgacgttggtggcacacgattttaagagcctgggacccatccccccacatccttccctttcccacccccgtcatcactgaaacaataattctgtgtatgtttctcctggactgtagcttagccattaaagataagagagttggatttgaattaatgcagggtaaggaggagcagcagcccacgtactgtgtatgtagcaatgcacatgtgtgtgtgcaggcagccacgcacatgcctgtgctctggggacagcaggcagcagacctctcggctggagttcccctaagggcaggtgcatgggcagttgttagagatgggccagggagggcggggtccttggcaccctgtgtgtgggggagtcactggccaggtaaggccctgctgaaagcttgcagctgctgggggcttgttggctgcttggctgggcctgtgttaacgatgtctttccatttctttcttctgactcaaattccttcccagcaaagccgaggcatggggaagtttgtcttgggatcaagtgcttcccctttcacttaacaacgatgtccattattatttgtgattgcttctaaatgcatttaccagctgggaggaggcctggccttgtaaataaaatgtggttttgttgtaaaagaaaatctaactcgtgtgtttgtgtgtgtgtgtgtgtaaatacagatttgtccctgcactttaggatttagcatttcagaatccgcctcagccctctgatatctgcctttcgaacaagttgtctgctgcatccattcatttttcctcttaatgagtcaaacatttcagcaattgctctactttattcggctcataatatattgagagcagcaatattctgcagggctgcccgacacttggggagcttttcatgaaagcagagatcatctcagaggaaaacctcatcttggctttatttttttaaggcccgagtttgctggacaaggctgcatgaggggctggcctgtagggtctgggaatttgaaagactgttttcattggtctttttcctggtgctttttcgtctctgggtggcaggttggaccactctgcctgttagaacagaggcctggctctctgaggctgtgcagagccgggagactcaggtgtccatagggcagagaaagaggggtgtcactttgcccttcccagggcttggctttctccttttatttcttccattatcgatacagttctaaggagggacacatgcacacatatgcaggcaccctacacgcctagcttggtatctgcctgccagcggaagtgaaaccacagtctttgggggtgtctacaaaggccttgaacgtgagctttcaggcccacttggtccacttactctgacccagaaatttggggctgggggtgactctgctgcctgatgttgagggtgaccttgctaccttcctgggaagtgtcgcacacagcaggccaaggcacagcgccacagcctgggtggtggggagaggaaaccccgttctttggaatcgggtgaacaccctgtcatctcaggggtttaactttcaacgctgaaagtgggaggggaaggagatattttttgtttgtttcttttcctcccagactcccttagaggcagtgagttggatctctggtctgggacgtggagatcccagctcagaactgagccctggaggcctggataatcccggggctgtctcggggacgccaacagggcctggctcccaggttggttggctgttaggacttgacgcagaaatcagagctgcagcacagcaaacggctttggacaccttcaaactcaattacgggggctcgcagggctgctgcatgaggaaagtgaaaaggcagagactgccaaaaaaaggaaagaataccagatgttaccaaaaataaaaaaataaaaaaaagaggagagaaaggaaaaagtgctggtacatagtcttggcaaaagacgaagctgaggaggaggggtgcttgcgaacaggcacgtgtgacctctgctaatttttaaattcatctgtgtttcttttgaattagaaaatgagtttgaaattatgtagttgaaaacctcctagcagagaggagatatttaggcttgctagaactcctactcaggagggcggacgaggctgaaaaagttaataaaaaagcaaacaaaaaagtaaaccgaagattaaattaaaaaaaccaagaagacctcttcgccctcagaaaggacggtccagctggccatgtggatttgtcgttgtacgtttttatcaaatcttccactgatgcaggagtttgccaggcctggacagggtggtatttaaaatagtaccaggtaccgcacctcgcccctgtttcctttgaattctcaatttcattatgtccttttttgcttttcagctcatttcttttgtgcctctctctctattttttaacaaaacaatattttgacatcctcctcccatttattagagcaccttctgtaaaaatggcgcacaatacatccttatatttctaaagaactgtttttacagtgctctcctttggctctgaaattatgtatatgtaattggtaattaaaggtgcgagcttttcaatataaacagtattgctcaatgttagatcattaaagggaaaaagaggcaccaaataattaccttttacattctgacaaaccgttcacaggaatccagtcttccctagaacctctgttcggtgggaaggttgtgattacattttaaccatagcaaagcatcttttcataaaataaattggtaaattaattacgtggcattgtcttcaaacccatttttaagtaaactcctatttctttctaaagtgtaattaatggtttctgggaccggctttgtgaggactgtttctttaccttgtaggttctttttcttagagagatgcagacaacagatttaggatttcctcgtctgcggggcgtttctgtactgccacatttctgatgcattctgcatttaattcatcgagggctctgtctgcttttctgtaaccacaggtgggatctcaaattgtagtttctcttctcagcgatacctacgtcgctacctattcacacatagttcatacgtgcgcgttgtacgtcttacatcgtcgtatattctgtattcagtttcacacatggactctcctaggccctgcataggctcgtgttcagaaaatagagaacagtgatttatgtgtaggatgggagatgccacagaattttttccttaaattatctgttctttggctctggcacttcaataacttcactgccacggaatgtattttcctccctcccattccttctcgccgttcctctgtggttttcattatccttccctaaataccatacaacttaaaatttacctgcctcctcgggtttcagacctttggctgccctctggcttccctgaagaccccgccactcgtgtcttctctacgactactgacatttgctctcgaaaaattccagcccgaatttgctcagaccccgaggggaatatgaaacctccacactgtccacttctctttatttatgacacttttggctgccgagtcttccaattttcccttgaggaggttgctgctttttgaggcatttattagcttccaaatatttgggtcctaggctccctactccctcccccacaaaaaaaacccaagagaaatctatcggctgctaaagaaatataaaaacatacagtccattgaaagtgtggtttgatatcttccaagaaatgcttttggagtctggagaattttctttctttcatttttctgggagtgaaaataaaatcaacaaacagaaaaggacagtggggagttgatgagtgtgggggaaatctacagagaaatggaagtctgaccgggcctcgggtgcttggcaggagagcctgcttcccgactctgcaagccggttccagcctcccttctgctgcagtgctttctcctaagatatttttttggaacctgacactcacttgttgctttctgagcatgtgggcttccttctctcctaaggacgggcccttagacgcccatctgggtttctgttttctagtttggtgtgtggccaggtcccaggtagaggaatgtgagtgggattcgcatgaatggggagggcatgaatgaaggtgtaagggatgggaggggtggggctccagcccagcagggggaaagggctccagctcactggttctcggccctggctgcccattggaatcacctggggagtctgaaagactattccgatgtttgttcccagtgtaactggtcaggggtgctgcctgcgccttgggatttttcaaaccctccaggtgattctcagatactggaaactttgagagacacatcacgacctcatgctgtcagcagccagggtgtgtgtgtatgcacgtgtgtccgtgtgtgttcttatactacgttggggagaaactggcagaaaataaactagaatgcagtaagatcggcactacttacgtggcaatgcccagggggcacgacgttgctcctagagcctcagtgtgcccatctgtcctgtgggggatgctcaccagcccccaaccccggggaggacctggtgagctctggcagccagcagcagagggggctgcttcttggcggggaaggggtggaccggaagttgggtgctgtgaccgcctaagcccatctctatcttctctgccccttccctttcttctttctgtctccagcagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtatgggatgctgcgcttgcctggttgctgtggaagccacctcctgggtcccatgccctctgcctgagtgtgctggtgcaggggaaggcccaggggcttccaggatggcctctgggccaccagccggggctccccctttctgagggtccaccatccaggtgaccttcaggaggagacaggcctggggctcggggaggcccaaatggctgatggctgcttgcttttggtgaggggactctgtctcgggggctaatccagaggtggtcagaagcacagaatgaaaatttggaagtctggttggccctctctttgctactgatcttggcttagtccctgattttgaagctagacagttttgggttagagtttgtcttcacaacttggacatgttagtttgcccatctgtgaaatggagctaaggaaacccacctcattagggttgctgtgaggacgaatgagctgttgcatgcggcatgacctggtaggcacttaggaatgggagtgctcattctctcccctctcctttctctctggactcagtttcccatgtgtgaaatgaggagttaggccccctgatctcagaggttgcttctgacattgcccgaccccaggggccggtcccaggcaggggtgtgggaacttgttggagcactgtgcccgttgggggaggttggatatgccctttgacatgctcactcatttgaccactgggacagctggttttaccaccttgagaacaggtctagggcccctctgtccccaggcgtgggtctgctcaccacagtgagttagcatgaagtccctccctcttggccagcaccatggcatgctggagcctcttccagggagccgctgctctctgtgcaaaccagagtgtttgtttctggtttatacttctgagcccaggaggcctgggggagaaaggagggcctggccagcctgggttccctaaaaagcagcagcctgtgctggagcaagatgggcatcagagtttatgcagacgagtgttcaaatcctgatggttgactttggattagccacttcatgggtccgagcctcagtttccccatctgtcaacagaaagtgataatagcagcaggcctggtgtgaggattagatgagcaggggctcttaatcagtcttttgcccgtggcacttctctctcagaggtctcgtctggctctgcggtgtgcaagtaggtggctggctggggaaacgagtgcattgatcgttaccatgcttccatcatggaaggtagcatgggctctggagggactcaggctttcgatgcttctaggagggtgagatggatgggcatgggcactgatcaagacccatcacccaggacgcagtcagggtaatgctgcaagcctgtctcccccacgtctccaaagctttgtgacgctgagcctcactttgctcacctgcacaaggggcttagtgagccctctcttttgtggggagactgtggtggtatgcagagtcctgcagcctcatgccaggcactggggagacatcagtgaaccagattggcctctgggccttgccttctgatgggtgccctagcatgaagtgtctcatacactttccaagatgcaaggggctttgagacatgtccaggccaccggcatgtaaacactggcttctcagagtgctatgtgcacctgagcagcgtctcttcaccgggctgagccatcaggcgagagaggtgctgggtcccttttgtctttgttggtccacattccagggacagttttacctgtagtatcgacgcctggcctcagtgcacatcgatctttcaggggtggccttgctagggagactcgggccgcctatttatgtttccatggaaagatttgctgcttttgccaaaaacatccaaatcctcatttcacattgaaggcatttcccaatgagaggctgcagatcactgtggcaggtttgtttaagaaagtgactaaatgtgatttcataaaaggcaaagctaatctccaaggcagctttgtcctcatccttccaccccctggcccccctgttttgttttttttttttttttttttttttccaggttgtgatactgcagcagcctacagtatctttattttatgtgtgacgaaagatattcttggcctttctgttcagcaacaggacgaatggatttcttcattctagaagaaatatgtaaaataatcccttagaagtctaaagagatatgtttgttcaaagcatttaaaatgttattttaatcaaaggcacaaaacagtctacatgctgtgtcagctgaagacgaccatcccattttaacagcacacatgcgcctgccttctagttcccattcctcctatttccctgcctacttgggcagcaacttttctttttttatttaataaaaaggaaagattaaagaagaaaacttcagtggctcaaatgtataaagtaatttaatatggtgggagcattaattattttagcttaattgaattccgaggactgcagtagttgcatttttgtagacaagccctgtttattatttctctgtgtagattaacagtaaaggaaacacagataactttcagttatttattgtaaaataaatgtgtcaattcatgtgtaaagcaagctgctcagagataattgagtctttatattttaagagggggactaggaatcacgggcacttctccgcccaggcttccggaaacccgtccagctgctgcccacgctcctggcccccgggccggctgtccctccaggcttctgcctcctggccggggctccaaggagtcctccaatccctccatgacctgctattgtccccagggcctcgctggccccggccagtagctggtgagcgggtggctgttaattcttggactctgcctctggctttggctgtccaggctcagaggagtccagggtgaggtgacctcgagggtcctggtggctgtgagggtcctgccttttccagggccagcaaccttcctgatacccaggcaggtccccgctcttccttgctaccaggtgcttctagaagtggggactccagaggcagacccgaagggggttcctcccacccttaagggagatcccagggtgagaactgcagggggattctgtcagtcatcacactaggtcggggaccccatatcagctgtttcctcgggatagtcattctggagagtaattactgttattttttatttttggtaaatgatagagaagtaggaaggtagagggaggaagtttctgaagctttgttttctggagggcattcattcattcattcagcaactgagcacctggggcccatcctccgccctgggtgtccccacctggatccccaggtaaacagcccccagaggagggagcgggcgtccaacatggggataatgggcagagtgtgagctggcagcagccctgctcttgacgtgtgcattctggatccagggctccactccctgctgagcattcgctgtggacggaggaggtccttggaaatttgtttcaggcctctctggggatggggcgaagctggtcagaggcagggtctttagctggtggtctgactcagggcagctatggtgcctctgatacatcgctgcctataggtttacattctttatgtttcttaaggttcctgcctgtggcattctccctgcctctgtgggagttcaggggagcacaggacccatcctttgggggagctgagaggtgttccaggttttgcaaagagcacgtggcgctgccaagccgttatctgggaggggtgttttgaggaggggtgaggagaaaggggctttcagggtgtttggggtttgaaggctgtctgttgctgtgtgggaaagaacacagcccgagtcagagccccaccctgctccctgccagcctccggcagccacttgaccttctgagccgcggtttcctcatctgtcattgtgacatttatgatgagtgcctggcacacggtgggggtaggtgtgctgcaaataggagcttttcctggcgctcggctttccctcctccgccgcattttcaggcgttagagcagcttgcaccggtcttcttggcaatgggctcctgtcagggttgggacaaaccgccactgggttgtgggactaaatccaccatcacaggcagtgtcagcatggagtagactctctcccgtccattctgccttttgttaggtgactgtcccttgaggatctctttgctggcggtgcactctgaggagccggcggggggtttcaggtgagggagcacaggctttggcatctcccgggtggaatcccagccccatcactcactgctggccacctgtgtgagtcacttcacttttcttggcctccgtttcctcgtctgcacctcctttttgggttatgctgaggatgaaatgaggaagcacccacctggcaccggttgggcctgaggcagatgatcaagaagtggatgcttctagaaagccaaacacaggaaagtgtggaccctgcttggcagcatgccgagtacgtgtttttcttggtcaaaaccatgatcacttacctgggatctctctcacggtgatttcctacaggttcctccatataattctcacttgatagtcactgaaggggaggcgcttgatcaccaggaatttggttttgcctgttttcagcccttccataaccaaatgaagctacagagggaggaattaactatcagctgtcactcataggcctgcctccgtaaccctccaagtcctgaatgtcagttttctggagaagtgcggagacaggcagcaggtgacaggaggtggcagatccctctgggcttggaggtggcaggcagccctggctgcgatgtccctgcccacttgatatgtcttcatccacaacctagggaggacgtgggatctacctgggagattctcttagcaggtggggcacagataagggtttggtttggggccccagtgacccattgctaagcaaaatgtgtgagagaaaaggacttctgacgagcccagggatttacgtgctgctttgggaatgttctctccagacttttaaaaataaataaaataaacgtgaaaaaaaatattagcttggctagtgagagaaactaaataacttgcttgtgctggaaactggagataaaccccactcgcaggttgccttaaaaaacttgcacttgatctatttagagttgttattttcccttcaaattaagatgcgttaaatccatgtgtgttgtggcatggattatctttttttattattaaatcatgacagctaattattagttctgtctgcaccgaggaatagtgcagtgttctgtctgagggacatggccctgggctcaggctggggtttgggtgttgggatggctgaacagggcagagtttgggctgggctggtgggtggtggggaagaggggcgctacctggtattcctcattgtgctagatgcttttcttgggttatctcacttaattcttcaaccttgaaatatatatttctaaccctactttgaactggggctcagagaggttaagggagttgctgaaggtcacacagcaaagcagagtcagactcagtcaggcctagtttccttggatagcaaggggtgtggaggattttggggatgggtattctaactctgtctgtctggctggtggggccttgatggcgggcaccacctctgaccccatccaaaatggtctttgaagcccatcccagatatgaccctgtggatacagccagaagtcctcagacccccagggaccatggccttcagtctgtggcttttgtatatactgtcctgtacttcctaatgagggcattggagagatgggtggtgacaaagaatgaagtacagtgtaaattcaggtgcacctgggccagaattttagattttttcccatatatatgattatttcttttattttatattcactgttgcatagacttttcccccataaatacaaattatttgttttattttgtggaattgtggttttgccagggtcttgctatgtgactgtcagccaactgtttgcctccccaggtctcggtacctataactggagataatgttccttgtgttttgggcttgttataaggtttgattcagacaaggtatacatagaacaggttcctgtgggttttagctgttgttgataatggagatcctgccggtgggatccagaggaagggtctggcttcctagcctcctggaaggaccttgctgccaactcttcccttctcacctgctcagtgacttgtctgaacttacataactagttactggcagagctgagtccagaccccaattatctcgagtcaggacaggtgactttttgccatcccagggtgcccacccctgtagcttgaggccatctcccctggtggagtcccagtttcctcagctgagaaagggggtgagcccttcctgtcccactggccttccagggaggcggtggacccacctgccatgtgaactgtgcaaaccagagtcaagagtgtgtgccgctaacatggtgacatcagcaccgattgtagttgaaagttttattggattaaaaaaaagagagacaatactggtcacataaatgggtgtttttttttttctcttaaggtttgaggccttatttattgttttatgtacgtagttccatacttccagcagtaattcaggaaacaggagagagagataaggtaagaaaaagagagaaaggcagctgggctcccaaggggtgaacttaaccaacattcagcctgagttaatattattattcttagtttgtctatttgacagtaaatagttagtattgactaaagtttttttaatcaggcatttgacagcttttttgagtggttgttgctcatttgcatgcttggctaatgaattaaccaccaggtctagaatctgttaggagtgggctctgctgataatctatagaaataaggctgactggctgtcaccctgtgcctttggggtcatcttttcactgaggaaacaaagagatggagtttttcctaatttcatgtaaaatttatttatttatttttgagacagagtctcgctgtcgcccaggctggagtgcaagggcgcgatctcagctcaccaaaacctctgcctcctaggttcaagagattctcctgctgggcacgggggctcacgcctgtaatctcaggactttgggaggccgaggcggggggatcatgaggtcaggtgatcgagaccatcctggctaacacggtgaaactccgtctcgactaaaaatacaaaaaattagctgggcatggtggcgggtgcctgtagtcccagctactcaggaggctgaggcaggagaatggtgtgaacccaggaggtggagcttgcagtgagccgagatcatgccactgtactccagcctgggcgacagaaggagattccatctcaaaaaaaaaaaaaaaaaaaagattctcctgtctcagcctcctgagtagttgggattacaggcgcctgcctggctaatttttgtagttttagtgagatggggttttgccatgttggccaggctggtctcaaactcctgtattcaggtgatccacccgcctcggcctcccaaactgttgggattacaggcacgagccaccgcacccagcctgatgttaaatttaactcatacttactagatcttactgtgtgccagacactattctaaagactctgcagatactaactggtgtaatcctccctatgaccttatgatatgctaatatcagccccactttatagaagaggaaactgaagcccagagatgttaagttatttacccaaggtcacacagcggtgagtagggtcccagggtgtcaactccggcagttatgttcttcactgtggtcataactgtgcctacattccctccacctctctgccccacgagggtggtaaatcaggtattcctttcattttgcagatgaggcaactgagtcatagagaggtaccttgcacagttgtccggtgagtcaccagctcagttgcgcctagagaccaggctcctgggagggagagcattaggaaaaatagctaatgcatgctgggcttaatacctaggcgatgggttggtaggtgcagcaaaccaccatggcacacgtttacccatgtaacaaacctgcacaccctgcacatgtaccccagaacttaaaattaaaattaaaataaaaaaagaggacaggctcctgacttcccagggaggccctgggtcttcactgtgtcatgtcccaggagcccaggcctcgtgggatcctgtgttcttgaactgtggctggtgcaggccctttctgctcctggctgggcaatgagtgatttccactctgaggtcgaatcttggtgatgggacttgggttccagagtggggtgaaagaaccaagacagtaggcacccacctgtcctgcacacatctgtggtttcatgttgactgcattttgggaggagctggcccccacctcgtcatgagttacaggcaagtggccctgttgagtccagagtggggagaggcaggcacagtggactctggctcgagacctaggatggcatcctactgtggctggcatgctgtgtgaccttgagcagacagatcttccccgtctctggggctgagcctgctgggctgaaatgtgagatggagccaccagtggtttctaacagctgcaagagccaggcagaaggtcgtgcatttcccacctcaattcctttcccacccagtagttcccccaactttcctcatttttcacattaatgaggcttaggagtcagttttctctgaagaaactggtggtgaaaatgaaaactgttagattgaaagcttaggtctttctgccccaggctgtgaagatccttatgggagaatttggtccactcaccgtgaggtaaacagttgaagctcagagccccttgtgtgaccaggccctgtccctaatgtccctgtgtggtttggcattcttttctttgtgatgagtgtaccctgaattgtataaacctcgggccctgcaagatctggacccaccctggcccagagcctgctgggggcggccagtgacctctgggcacacagggagtgggagcctcctcaggggagggtgtgatcaggacttgcaagcctcgagttggacccagggaagaagaggccttgctggagaaggcaaggcacccgaggcttcattttattttgtttttgagttttcttgacgccttcttgctggtccgctggttttggtctggagggccctggggtgtctcagaaaggaggagtctgtgctgagggttgggagaggagagcagggagggagggaggagggagcccttgatcagccacaggtctgggaaagcatctgcccctcgctgctcagacagctgggaaactgggaccacagcctcctctgggcggaaaaatagtaacaaaatagcctttttgttggaggtgaaaagtcagactcccccactcctggtgtggagaaaaggcagcagccaagggcagggtgagccccccagcccaggaccgcctgctctgtctctaagccaaggcaatgtttgatcagggctgttttccccccatcccctgccctgggggctgagtgcctgggcagcttccatggccttcaggttgcgggtgtggacacaacctcaaaggtgcaggcaaacaggtgcgtgggtcagcgtctgctgaagatgaatccagaggcacagagccctaggagctggtagccccagtgcctaggctgtgcctctagtgatatggcacagatgaagccatccgtccaatccacaagagtgtccagaaaacacgcgtctacctcctgatgactgcaggtgccaaaggcatcctggaaaggagtggagaaggtggctttatttcaaagcctttttcagggtagagcacacctcctggagagtgtagccagccaaccagggattccaggctcctcccttggggtttgagggcagagactggctgtcctgggctcagagagacaacaactgtctgaattcttctctgttcgggagaaaatgggacaaaccttcagtgactccctgccaccttcagcagctggctaaaaactgttggagttggtaaacccagcaaaactaagttttcctggggctggagcgggttcttttctcctcccacctcaagttcaaagccagccaattaagaaagctaaacagtgtggtcttctctctgcatcattggcttgtaaaactttccctgcaaactaggcgactttatttgttgggaaaacgaagtatataattttcctgacctggcctttgctttggggagaaggggaaagagagaaagaagtcatttccagaaacagacgggccccgaggagcaaaacaaggtccacactccagcgtcagggcagcgtagactgcagcgctgtggtctggaacgctgaaaacagcgtgttgcggggaggcgggacgcgaggctccaggctgcggagccctctggggcctgggtcactgtctgcgaggtggacatcgaagtcctcccaattctgctttcgaacctctgggcgccacctgcctccccgctactgcaattttccggtttccccgacgtttgcaacttgcaagtctcctctcacttccttccatctccagcagcccctcctcaagcttggcctcctcccctccccgcgacggtgcctatcccgagcaaatcatacccatcctctccgccgcccgcaagacagcctcccccgccctgcccgagggggacttcaggcccctccctccaagggctcaatggttggggtccatagcccccttcattgccacacaggagaacacaatggccttccccgaggccaggggcgcagagctccgcgggggcggctgcatctcccggaccccgcacccggcacggcgcggacactttggcaacttcaaaactgcgcgggggcctcccctgcgagcggtgcccctttcccggctggccctggccgggtcgggaggctcctcggcactgttcccaggcctgcgggcgcgcctggcccccgcctggccgccggcctctgattcgcccacggccttgcgcccatcgtccacctccttccctctctctttgacccgcgcccgctgcgcacgttgattgtgccttggtggggcgggagggccgagagggctcaaggtccatgcataattcgggggcttaatggagcagctgcctgagccgggcggcgaggggcgggcggaggcgcagctgacccagcccgcgtctggcctcgctgggaaggcgcgctcctttcttcctcccctgacactcccctcccccactcggcctgggtccgaggaaggcggggggtgggcgagtcgaagggctagctttgggaaggggtttccctcgtgcatccgtgcaacttttgctttggggggcggggggcatgcagtgaatcggagccgcctcgggaccggctcctgaaggtggtggaatgcaggcttcctcggagcactctgcagccctggagtcttttttcccggctcctttcccccccgcccccgtcggtccccagcccagcagcagcccagcgagcacgcctctggccccgggccagcccccttccctggcagccggcggagatggatggaggcggagacccaaggtcaagggcggggagcctgccggccccgggcccctttgtgcgcacggggccgcccctcctccaccagtcgcctcctctctggcccttgggcgctctcccgggtgggtgaccttctcgggcatggggaatgtggaagtggtcccctccccgaaaccgctgcgcgccggtcgggtcgcttcgccggggtggcattcgtcccgggtgctgggggcgcacggggatccctcttccgcccgccgccattgccctgatgagtggcgccgtcttcctcagcccaccttggcgggacagagcgggcggttcccgggatccaggtgaggccgggacggaaggagcctccgggagttcccttgtacaaaaatgtgatcatccaggggcaacagccccatctcaaagtggggatttcgtggggaccttagtttctttccgagtgggagaagagtaagcccgcttttctcaaggacaaaagtgttttcccaattgtgtgggaatggaaccctccactggagtgggacaccgaagctcctggaattacagggatttaatgtcagtcctcctttcagcctgacttctcttaggataacctcttccaacaagaatttgtatgcaaatcgtcaccttgctaggagtctctagttttgtgtgttaaaaattggcctccaattgtttaaagcacttcaacaggcccttaaaggcccagaaaagcagtggttggacgcccagcctgtccaccacaaagctcttaagaaaatgttcaaacattttcccaaagctgttactctggaaataaaactgtatactgttcgcctgtagccgattaaaagtttaccttcactgtgacagcttttccaggctaggattggacccacatctctattttccatttttcagaaataaatctaaaccaggcagaattgatttgctataacaagagtcaaggtagtattaaaaatatgcgtatacctatatacttataatatgaaacagtatgttacacttgctgggctctcaaggcgagtattgtgtaaacggcaccgtcatggcgttttgagtaagagttgattttaaaatctcagatttagctaacccgaactttgagcagccagcttttctggtagaggaatctgaaggcatttgtcaatttattttttgcaagccctccggaaaaggtaacaaattcaacacttgggagctcaaagctactgccagtcctggacaggaaggttttcatatctgtctgaacttgctcgctgatttctcagacgtccatttataacagtgggtctaacaagatagaatccgcctttgaatatctgtaaatacgggtaaagatcacagtccagcactcataatggtccaaaacgaactggcagattctcgtgtttgattaatatttatgttaccggattcctttacagaaagaaagatgaaacgctaattatgtgtgtgtgtgtttgacgggccccatcctaggtctctgcagttcatttaaagggatgtacattttaggatttttggagactaggggtgtgtgtgtgtgtgaggggggggtaattgttcatgttttgcttgaaagacaggtaacctgtggttggctgaagtattggctggtacactgagggagaggctgacttttcattttccttttctttattttgacggctcaacagtgatcagaattacgcgtgatttctccctgtatgtttgggctaaggcttggacagtgtggtggaaggctcttgttcaggatcttcctcgaggagaactggtagcccccagggtgctctggcgtctttgcagggcacactttctgcgcctgagtggcagggtaggctgccctgcagtgtgtgcttccgagccctgccatgtgtctgtagggcactttccttgctttttttttttaggagcaatgtgtgggagatttgcctggaaatggggggttctgtcagctggatcatgttgaaataccagtgcaattggtagccaaagggatcctggagaagcctccttcggaggtgctgtgttaagcatcttcaattttattgctttgagaagcctagatttttgtataggatttcctacaagggtgcttccagagtggcacctgagtcctgcttagaggttcaataatatttgttgttgctggagcgtcaggggccgtgtcgttgttaaagccgcagaatctagaggttggcatgtggtgtcggatagtctcgaatgcattgacttcctaaacagcccagggcaaaccagttcatctgttagttgcttcatctataaaatggggctagccaattgtttacttccctgtccctgtccagatatgaaaacaaacccataggtaggagtgaagcaattgctgatttcaaagacatcataaaaatggagaactgttattgttcagtccgtgggggcagggtgactaatttgcaaaagggaaaggaatcaaatagccgcttctagagggtgtaattttttactgcaaggaagaagaattaggggctttgggaggaggtttatgtggggaggggggcacttggtttttcaatttagtaacctgataccaataggaaactcccccacttccccattcattttagaggagtgttcccccaccccagctccttgttattgttgggactgtcacatgattcagaatcttgatactgaatagtgtcactgctgctcttgacctgaataccctagaaaaggtattttttcctgatatttggtctcaggccccagaaggagaggagctggacaggggacatgtagacttggattagggaggaatgcatacagcaagcagtctttaaatgcacaggcttgctaggtgccggtgaggaaggaactcaaagcggaccagtgaggaaattctcaccgcctctcagagctaacaaaaattggcacttatccccatggagcacacagctgtctgctatgaaatggtaccttcactagggaagccagagggcctaagtgtcctattggggctccattttactttttggttgttgcttttctttggaagtgtcttgatttcttttttccagcaaaagctggattacttgaattagatttttcataaaataacctctggcagggtccaaaacctctggattagtcttgttagttaggaaatacagaagctttctttatgtatttggtttgttcaccctggctgggccaagactttgggctggagttgtggggtaggggtgggagagtgtggtcctctcctttccccatgggggccttgacccagcccctgttcactggcattggggctggagtggggaacggcagatacctggagtctgcgatggtgcaggcttggagccaggagctgtctggtgcttcttaattgaatacagatctaagtaaattccacgtgggcatgcaaggctgggcaaggaaggccgtgatattcccctctccacggctggactcgtaaccctcccaacctgacgggcctctccgcctgtcgctgtacccagcccacatggtttgcgagaaaaggtagggaagcagggggacaagatcatgcaacgcccatgtaaatattgtctgtatgaactgggtcttccatcttttgttagtggcagctcgttaattaaccagcagattagtgctgccttcttttgacacatgcatgtattttggggtagaggattcttgttctcctaaaactctgaaccgaaccgctcagaaagtcttccttcagcgccgcctgcccctgctccctctccctgatgtcctccccactccccttttcctgtccccttctacccaccctttccttaaacccaagtgggcttgtagtcgagtggaggacagacacgttaaacacagctaaataaatcatgtttacgcttggcgtcttcggtagtgaaaaatctgttggctgtttttacttccttatttctcagcatttgcttcctacctgcttttgaccacatgcccagaaatagtagttttgtcaaatgaggggataatgccagccagcctttctcgctgccaaggaagctgctggattttgcaaaacagagtgacgttttttttagtgacactgatgtttttttcaaagaaattaggatgtagaataagggtattaaaatgcacttagggaagggggaaaaaagcgacatcgtcccccctacagcacagggacacgtagcaagcaggtttagagaagaaaggtctcatttttgtttgcacttggccgctccaagggcaggaggcagctgtcagaggcggaggagctgagtcaggttcccttcgtctcagccccaagacttaatttttctgccattttggtgatgtggtgcgaagatttttttttttctttttcttttgggttttgtgtctgtttagtctctgaggcctcctgagcgatgcttgctgctttcttcctctgagattacagctagattctcgccccgatctggaattggagctcgttgggatcctggctacactatgattgtttatgtgtaagagtggccccggaggcctccccgcctctgggctcttatctacaatgttgttttggggtatatttcatgatggggtgctgggcagagaacttcctgggtaattacagccaaacagaggctgtagatttaaaaaaaataataaaaaaacagtttcaaaaccaagtaagtggcatataaatactgggcactcctgtagggagaagaggcttgtcttatcgcgggatctttgcagggtttctgcagtcaattctgtctgaggtccagcacatcagctctgtttcaaagacagctgaggaaaaaaaaaaattacaacaaaatcaaagtcagcgtgctatgatttcccccaatttctaatgggaatagtctgcaatagaaatgatatttccattgaggactgcgctgccggtttctttaattacattaaatagcggtataaacctcagctgaatgtaaacctctgttacagcggcgtctcgcgcgtggctagatgaatcgtaaggagcaatattcctagcgttaatgtgctaacaatctttattaaattagtcccgcgaagtgttaatttttacacattttgttgtgcacgcactgcacgtcaccgctagtgtgttaggagatgaaaacggatttcacgtcaaaaaataagtaagaaggtggctgtcagacagctcccttagaagaaaatttgtgatttttgccatcaaatgttacctgtgctgaaaagaaggcttacgatatgtatattaaatgccatctacatacagaaaactcagttaaaggaactactttgttgaaagtaattacaggcctgttcaattttttagtcagtgacatttcagacttggcttaggaacataaagaggccatagaaaagattttgttcttatgtaatgcaaagcactgaacctcggtcttctataagtccattaggaaaaggaaaaaaaatgaaagggagaaaagagatttagtcataaacaaaatccaggggagagctgtattttttttattacaatagtagaaatcaattgcctataattctatcaaatgcaacccaaaacaaaatgtgcatttaaactatagcagggtcctcctttttacaatttgatttcttttctctctcttcctttctttctttccttttttctttctttttaaccttctactaaccaaatttatttctgttccatctgaaacaagaaaccctgctggccctgtggttgtctgttcccttatggctcaggtagagttttatggtctgatcttaaaaaggttgatgatgcttacattcctcatatccatgactccatctgcacctgaaatttctgttcccttttctggctgcttcgggcttgagtcatcccaataacctccttgctgggcactccgttttctttatgttctttttattggctgtgctgtttattttcattcttaattctccgggattctcgcagctcagccttcctccttctgtttattccattgcactgtctgtacatggccgttgagcaaaagccagcattggagttcatgggaccttggaaccacaacttcctgaactccccagtttgtaaacatgttttagggagggccagattcttaacacgtgtcaggattcagtgttttccgggtcattcctcaaaggtcaggcacagtggatgctgaggggatagaaaaaggtgtccttagtttaaaactcactgtaggcacccaatctgaagatgagtttcctggtttttgccttgtgtgacatgtgagttctatcttaactgtgtatttccactcccacccccagctctaaattaatgaagaaataggaacatatctgagggatgcctggccaagcttgtcattggagtctggcccctaagttccatctgggaaagggctacagggtcccaacccgaagtcccacattctttatgcttggtatccagatgatttatctaacactttacttcggtttgcagcctgccttcactcttcgttgagttattcttcatgcagatgacatgtagtatactgtttgtggctctggacgcaactggagagaaaattactgaaggatcttgaattaaattgtcttagaaaacagagactgctgaaggttgaagcagctaccacacctctgatcagaaaacctaaattgagaggaaaaggggcaattcctccattaggtattgactggctgattttgctggtgagatttggagaatctctcagttgcaatttgtccttgccctctgtggactctggttggatgcgcgcaagacatcttaacatgtccacgttgctgatagatgagtgtttgtgtgtgtatgtgcatatgcatatgtatatgtatatagaacctctcttatagataatagaagtgcatgcacacatttttctaaccagtgcgacacatggcttcaccttctgttgtcctcaggcctgcccattccaggatggtgggccccaatttggtggaccctgcctgcctgaggtcacccagaggagttatattcatttttgtatctgtgtcctgaagccgtgatgcctaggagcaaaggaatgatcagcgtcccggctggaggacaagtgtttgtggtttatttgcatttcagtagttcggaacactgcaggattttccccgagagacaagcaaaagaagagtccaagctgcgtgtccctcactgcgcccccctaccccctgcaaatgcccacttaggggctggaacggccagccccctccacctccgtggttcacagaagatggctgagggatgcccttcctccccatcaacattgaagtgtcctctgctccctcacaggggccttggtgttggaatttgtgatgtaacttcaccagtccttgggtcagggtgcagaaaggggatcagcagccctggagtatttcagctgcctgcatcttgaggaaattggagttggcagtcaatgaaacaggtgcttttggacctggggaaggggtgtgcccaagcgtgcctgcctctaaattgcaagaggcagctgctggggaggatgttccctttccaatctctggtggaaggaggagaaaggttttggtagtgtcggtgggggacgcgatcattccttggctctgcctctccattttctgggatgagatttcggaagtgctccaagaggaggagcttagagtagggcagcctggctcagggtgctccctgaggtgtgcttctagtctccctcacggccaagccttctcacggtgggtgcaggtggataccctggtggccacacagggtcgtgggtggcctgtggggaatctctggatggccgtttgtggaagtgatggtagaagtggtctcaacccaaagatgagcagttgcccatgttcctggaggcccctggtgaacccacctcacttcctgcagcctggcactcctcagtgaccctctctggatccattagggcctagatggttgatgaaggatgctggacaggctctttcacctgcatttgaattcttaccctcctcagccacctgcaaggactgctgtctttcagctagccgcccacatagaggccaaacgtagattcgaactgtttttatgtctcccgtgtaatgaccccgaaggaactctttaaacacagctgtgcaaacccttgtgagacctgactttcccttttcgttgctcttctttccaaggacacctacatgttcacccccaagccaaaacccgtggcaacaagggactagagacccgtaatggccatcgggtgcccagacaaaacagtggtgtctgatggagaatgagaatccaggagtgggaggtggggcctggggagctccatcgccctgcctggcatttctaggtcccccagatgctctggggcagtgagctgagccacgtggcacacccactccctctctggtcctgccttggggacccaccctagacttgcagcttttcatggtaacctgcgtgttcacttaaatgctttgctttccctttctgctttatgatgatgattgttggtatatattttacaatgaaatggaaaacaagttccagtcattgctggttcctagaccttggtaattaaaagctaaaaaaaaaaaaaaagaaaaaaaaagaaatgaaataatacctgtggagtgaaggaatttattttttgagtcaccctcaaccccaaagacctgtgtagctctgaaattgagcaaacgaagaagtctccctagaattgttcttctctattcctgctgtctcagccactccccctctacaccccccacagccccccaaaaaaagggattgagagaaagacaaatgatgagagaaggccagtcttgtcaggtgaacacccagttcctgtctcatttaaggttgcactccacttctttcaaataggaaattgccaaaatggatgtcatgggctgctaattagatgtattttaactgcaggatcattttaccagctaatactgttattatgtgcttcaatgtgaacccatggtggagctgttaaaatatgagcgtgcagtcttagcagacagctcttggagccgttgggatgggtggagggcgcttttcctcacggccctgaagatccccgggccaggccctgtgctgaagatcagagccctttcagcttctcaagaggtgccccctgctctcctaaagaccatcttctccttgtgtttagaccagggcctgagcctccaggaggcctgagctctccagcgtcacatcccctgccctctagacatcagggttccctctggaccagcctagaagtgccagatgaccacagttcatgcctgtgcctacccagaacaggcaggcctgaatctcacacactggagtttcaagtctgtgctggcttctcctccatcttccctctgtagcaaaccggaaaaagaatcctaatttcccgttggggtgggaggagatgagctaggatcaggataatgatttttaaatgtgagccaggcatttgacttcacgttatttcttttccccctcacgctcttaatacttagcattttttttctatcatccttaagacaaagtagctggcaaaatatttaagtgatcagaaaaaaatatttttatttgcccgcgtgcgaattgggttatctgcctatcttgtttatgaaatttggcgctgcctttcctgcacagtacgttcgcctctcaaatctttcccggctcccatttccatatttctgcgtgcttgttctttgttaatcacttggcaagcgcttatttgaatattaaaaatttctttaatcatcaaaggcaggagcacagtctcatgaatattcatatttttccccctcctcagactggattctagttcattaccctgcagtaaaagccaaacagccatcaatcgccctcattacaggctctggcgttttgattggctgcctgctgcccagagctttttttaatttttttaattttttcccccttctcctatgagctgtcttgtacctgccaacaaccaaaaaaaagaaaaaaaaatcaacaatgcaagaataaatttctctggttggaaaacaactttgcaaacttgtcaaacagtccttgtggcttgctgctgccaccgctgtagcgtccaccagcgccacctccttccccccgctgtccttcccccaccaaaaaaagaaaaaagaaaaaaaaaagaagcccaagataaaagagaggggggagagaaaaataaataaataaataaataaaaagggagaaacttgagcctcagagatgaatatttgtcaagagagttgacgtaagtttcatttgcataatgactttgtacttctgcattaataaaatttgcatatgaagccatgttaattactcctgatcatgctttttgcattcatgcatagtaattttctccgacttgtgagaattaatgtcttggcatggggggagggggcgcggggactgtcaggttcccttgccagtgtccctcactcacacgcgctgcctccctggctgtctccttccttgatctatgactcatttctgcactatcagtaggagttctcagcttaaaaaaatgtatcaattgaaaggcaccagtagggagaaaaatactcgtctcctgcacagtgtattccagaccacctctctccagctctgaacatggaatctgtaatcctcccatttgggaggggacgccccagaggcttcaggggtggggaaggctcgaattccccctgaaaccgggatggggcttttccaggcgtttttgtgtctccacgctcctcggcggtgggcgtgttcgctgggtgagtgcgcatgtgtgaggaacggagcaggagcctctgcaaagtccctctagaagagagacgggtgacagacccctgtggaatgcttaaacccatgaaggcatcaagaatgagcttatctagcattgccctgttttggagcctaagaagaggcattttaggggccttatttttagactttttttttttttttttttttttttgtgcatagacctccaaagccagcgtttttttgggagtgtcttgcaggtctttgcagggcgctttgctatgctcagagaacatcctcttgctttcttcgctgggcagcgatgatgccttggaaaggaccatagggagtggggaaagtttcagaatggaaagcaagagaatgatagtgaccgtttggtgagtttcctggatctccggctctggctcagggctgacctgacccttcctttaaagttgagggagctgaggctctgagaaagtgactcaccttcagtcacgaggccaggagacagccgaggaggaatttgaatccagtcctctcggtcctcaaggctgtgcggcctgggagctctggtggcttcctctgtgcgtgtgtgggtgcataccctgtcccacatctcaagcgctccttaagtgctttctggatttcccagcttcacttttaaaggcaaatacccctcctctgaggaaggatgggggctgggaggtagcctgggacaggtactgaggctgttttttcaagttgaggtaagagtcacatgatgtacaattgaccattttaaagtgtacaatcagtggttttggatctattcacaatgtcgtgcagccgtcactcctgtctaagtcccgagcattttcatcaccccccgaagaaactctgtgcccattagccacccctcacacccctactggctccccccagcccctggcaactgctactttctgtgtccgtggatttgcctcttatgaacatttcgtatccatggagtcatgccgtaggtggctcctttcatcactttgggcttttgcagtagcttcagatttcttgagttccacccttgggaagggctctgggtttgagctgccccgtgtggaaacctctcccagtgtagaaggtgctctgggagccccagagaggccctgtagagcttgggatttgaagcccctctcccggctgcccccctcccctgcctcagttgagccggtccctggagcaggtggacttcagcaaggtcacaattgctaatgagactctggggaaacctgtccagggcggcctaccccctgacccctatgcagggaacaacgtgtggtgtgtgacatcgcctttacagaccctggtctgagccccaccttggacgtttccaggagaagggtgtggccagatgcctgttttctacctgctctgcaacggttcctcccaccacggagacagagtcagcttcttagcacctgggacaacccttaccaggcctcgagctgcttctgctggtttctcagtagtgataaatggtgctggctgtgtcgtggcctcacccagaacccaggaaccagagcctgggtttggcctttgcagcttccaatggctggattgagcccagggatctcagacttccgcccactatgtggccgttgctctagagatcccaggacccctggtcacttacccagctgcagccctagagggaagcagagcattgcgggcttcggggacacaactgggttccagtctcagatctccctaagcctcagttttcccccagtggaatgtggatcttttctgagcgaggtggctgtcatgatgatggatgacccagagccctcggtggtctgcagggaaggcctacatagggatttgagaccaccagtggacaggatcaaatgcagtgtccagtgctggaaggttcaggctagggcaggcttccaggaggaggcaggtcctgaccttccttgagggatggcactaaatctagcatggccttcccctcagcatctgaggctgaaactgtttactggttcctcagccacatccttccagggctatccccagctcagaaataccctgggcccgaggcctcacctagtatgaggtctttgttggttcagggggttccgagcagtgttggtgttagctttgacctcttgacaggacactgacagcttgcaatccctaagcagggggtcttcttaaatgccctgatgccttgatcctggataacccatgttttagagaaaccagggctacagagaaagagccctggttctggggccagacagctggggtttggatggggctgctgatgtctgcagttttctgcagtcacgccatcagtttcctggtctgtgcaatgggtattctaagccccagttcccgtcagtgtgttaggaagttcagtccaatgaagactgacaggctcctggctcctggtggcttgcagggtcctgtggctctccttgcgatgggggaatccacttgggggccctggagtgggcagactcccacccgtgcagacctgtgctgggcctccctggcaaagccggctgggcccagctgcccatcctcttgttgacgtttcctttttgtctctctgatgcttccctgctcaattatttacccagggaatttgggcttcttcacttgtggttttggcaagggcttcacacaaatgttttgccctggtggtctcttagccatttaagataaacggctaaatcaaatgcaggccttgctgtggagctgagcgagctgtggggctgggcagaggcggggccggccctggccctgtgtccttgctgtcacatggcgggaggcctcccaagccaggccgagacgttaggagggggtgagcagcgccagggttttcttggggtgtggtaggggggtgtgaaagccttctgaagggcattgcgttttgggtgcagcacgctcagtgcttggggctggagagagcccccagctggtggtctgccagacaggaggctaacagagcccagacacctggaggcggacccaaggctggaggcggacccaaggtgtcccgggcctgtaggaacagcccatcctgatacagcaaacaggggaggctgtgagcttcccagctcttccagggaggggtagcccgaagttttggaaacaaatccccaaatggaacctatttgattgctccagaggcccccacgtggggggtccttcctgagagtgggtcctcacagcccccgttcacccagccccctgcaccaggcccccagaggcggggtcctgcctccccgacagcccagcctggcagctgtggaaaccgggccctccccagtgccccctgcccacctccccgagcccattccctcgcctgtgtcccgattgccttccctgcagggcctggcaccccgggggcctcccacccccgaagggtggcctgagcagagccccacgccccgagccccgtcccaccccgtgcccctcacacagtccagggcccgactgaccagtcttttctattgttttttctccagggccgtgcaggcctgcccagctgccagcggtggcccccatagctgcctcctcccaccctcactcatccgtgatcacttcacctctgcgtgccctgggcgctctcccgccctgcctccccctgccgtgctgcagcgcgcgcccggtctcgggtgacgggactcagggtgagggtcagacggaggctccctttggatgccagtgtcagttgtcaggtaacagacgacgccgcggtggggggcgggcccccgggatggcggggtgtgccatgggcagcgctggagcaaggtggggacccagggaggaagggcagctcccacccagaaggctttttggggtgccaggggaagtggtaaagaatgttcgctgaactatgagccagggcccggtgcccctcggtcaggagtcccccacggtgcccccacccgttctgagagtcttgctcccagaatgcattccccagcctcccaatcccgcttctttgggttgtttagcgacagcttaattggataacacttaacatctgaggttttcttcggcccttgccactgccaccccctcccccaccccagacaatcccctgccccgccaagaccaggctaggggaagattccttggttgactgtgtacattgctggagccgtccaaaatgctgagtttctctttgggagaatgtgttgcccattagctttgaaaaagaaaaaaagtggctcaaaaggagcctcttaaaaagctgtggccacgagagggagtgaaacactgtgaggtgtgtgaggggtgggggcgggggctgagtacctgctgtgcgtccggctctgggccagacccagacacagctgtttgtgccgactcatcctgctctcccgggcgggcggtgtggctgcccattctacagatgggcagatgggccggtgtggtgacacaaactggcctctacctgccctgcttctccccaagtggaacccaagatcttattctgcctagggtctctgggaatccttggggtccttgggaattcaagggcaaagggccctctcacaagtctgtccccccggcatctcggcagggcctggcgtgaaagcactgtggccacgcaaaccaggatgctgacacagacacatgtggtgagcagccgtggcctggtttctgtggcaggggcaggaaaggagaaggggggtgcagagctggggcagatttgattggtccctgctttgtcaccaggcatgttgcaggctttctctcgacttgaattgtgaaaggaaaactatttttattgggcaggttgtgtttttaattgaagctgtccccacaggcggtccctgatggagccacagctctgcaaaagccatggccacagctctgtaaaaggccacaggcagcccctgctccagggtccagagcttcctgggctccagagctccctagtagggtggcctggagctttagtgtaccctccctgctgtgacaggtggtgacatcataggatctggcttccaaaagggagttctggtttcttactggacttgtgccttaaaggcacaaagcaaaacccaaaatctcctgggaaggagtcggaaccacttgcaaagacgccggctcccttttctgggctgtgctggtccccaggtgctcaggcctcctgtcctggttcagtagatctgttctgtgagtctgtggaaggccctgcttgctgagcagggggtgcctgctctgtctgggtggttgccttgctctcgtggcttcctgtcattagcgctgcagcctcggcaaccactgggggggccatgctatcaaagatcagcctgagtgtttattactggacgcggtcaagttccgtggcacagaaatctgatctcaccagaggctcacccagggctttgcttaaccctctgttggccctacttagaagttgctgaagtagatgagactcagctagaggactgagccgctccctcatgtggccaggcctgcttagcatctttgtatggtgctgaccaggagctgttaccatccccattttgcagatggagaagcaagggcttggggagggagagtggctagccagggtggcagaactgggatttgtccttggttgcctcctgaaaggccacccctcttcctgtggagccacgctgcctctgccgacatccacgggaggtcgaatgagctttccactgccttggctctggggggctctgccatcagcaagtcctcatacatgccactaggatccttatgaggactgtgtatggagggcctgctatgtgctgcattgtgctgggcatgtgtgccttcttgaatttaaccctcacagcaaccctaatactttattctcctcactttgcagatgagaaaatgatgttcagagatgttgagttctcacagctcacgtctatccgtccgtccatccatccatccatccatccatccatccatccatgtatccatccatccatccatctatccatccatccatccatccatccatccatccatccatccatccatccattcatccatgtagccatccatccatccatgcatccatccatgcatccatccatccacccatccgttcatccatccatccatccatccatttattcattctttagcttgaagccatttggaaggcacctagcttgtagcactgtgcacacacaggaagagtcggcaggcaggtccctgccctcgtgcagcttgcagtctggtggtggggaggacagggagtggggacctgcagaaggggaaggaggagcagggagggagggagtggtggaggtgggatttgatcccaggctctccatccagcacctgccacatctttggctttggctcttcttctggcattaaaggcctttttagattttaggccttgagagctgccaggactcagagcctgtgagcaaccagtgcttgattgcagtgctctgggagggacgtgaggaagggcagtgtcctgttcctggggctgggactgcaggaggctgagcccctaggactgctccaggagacccttctaaggggcctgctcttacctcctgccctctgccaccatgtctggtacagttctcttttttcattcggtcccagttcattggccctcaccagcttgcaccaccatgtttcccgatcaatttgaatacctgaaactatcctattctggtgttttttgtccctttgtgatttgtgtccctggcactgggctgtttgcttaagtgtttttagtgcctgtttaattagtagttggaatggagtcattaagttcccagtaacccgttaggaagaagcaggcctttgtaaagatggaatgggcctgctgtccttacctggttttgtcccttttcggatcaggatgcattgaacccatctcttcaagttaacatggagaaccccagtgtaaacgtgtttcacacaggttaattgcgtgcctgttaccgcatctgcagttatttatagaaggatgtgattttacggggggagaaaaccacacaggtatgtgtgtttgtgcacaccctgggctggcagcatcccagggggccctgcctcccgggaccccaaccctagacctctttccaatggtcgcagtggggagaagggactcgggggtcctgactctttttgactctgctgaaggaaggtggggctttgagtctaggcgttcctgggaactgaaatttcttccctgagaaatttcacatagaggatttggcacagtggctgtggggtcaagagcctcagactgtgttcctggtctgtgcttcagctggccaggggccctaaagaagtcattgcctcagtttccccttctgtaaaaatacacgtatgtatgtatatgtgtatgtatgcaacatttgaaaacgaggctcgtgttattttctgagacaggtcagtgtggagctgctgtgggtggagtgagcatggggctagctaggtttccagggcagggcgtgggacattcagagaatggtttggacactcctgggctttgtgccccgcatgccagaatccttccctgttctgaggcttccatgattggaaagcggtggtcaagtgtatgagactgcttgggggtgaaggctgttctgccccatgtagtcatttcccctctccatccctcagtttccccatctataaaatggagctaaggataggacaggctctgaagggtcgttctggggatcgtgtgagatcatacgggccaggtgctgagaacaacaccatgtgctgagtgagccctgtcgaagttagagtccatgcacgagcggaatgggattcacgacattgagactctgtcaggtctcacttcaagctggatcttcgctttccattcttaaaagtatttagccttttggctggctcagatcatgtaccagctttgggaggtggaataggaactgagacacttcattgcatatttaaaagctgcaaatggtcatcagccacagtgattaatatgtgtacttggtgaagttcaaggtctcacacaagaacacacaggatcccagctcagggaagtggaagtgtttggctttaatagagggagtcagttgcagtcattagtatatgctgaaatcacagggcaatcttgtaaagttaaattcaatttacttttctactgaaattgtgcttgctgtgttatttaactagtctggggtttcttggcatgggttaaagggacaataaagataaaagaatacctgtaagtaaatagtagggtttaaccatagaatctatccttttctcctccttcaattatatcccagtgttcattttgtgttggttttataaccagagccgtccaatggggcgccgtggattagaccacgctagctgtggaagcctgatgcaattaatgcagtctgcctggaaagtggccttatttctggaagttttgtgttaatgatatggtctgtgctttgcacatttcataccaaacaagaagcaagctgtagtttcattctggactgggttcgattaacaccggaggatccatgggaagccaaacggtgatacggacagagatggtagcctcaccaggcccctgctgatgcgtcgccttgattctggtgcagggggtgccagagacactccaggagggtgttagatcggccactgagactggagggaggggtgagtatgggggtgaagacaaaaaaagaaccgtgtgagtgagcgtgtgtggacagcagagctccgtcgtgggaaggttggaaaacatgctcatgggattccctttgcaaagtaacgtttgttgttaggatccttctgggctaaccagacaggtcctagtgttgatgggggctggctccatgtaggaaaagggctttcaggggagttattaaaaatttagagagtcatctgtatgccttgcaatgtctacatcgcccaagggccggtggtcccagcatctgcaacccagtcttcacagtgctgttgctcttcctggcgtgcaagcgctgttgattccaccctagcacctgcctgcttcttgaggtcacgctgctgcagaggctgtccatgcccgactgccttgagaacccagacgcctctttctgtgaccggaggaagtgccaggagaggccatggagagctgcaggccccccagttgggggaagccccccagttggggcacctaccagcatgactgtccttagataaaagaggccccagcaaatccctgagtggagatcgctgcagcctcgccagattccatttcactctctgagttggcccttcagacgttctgaaggcagagctaaatcaaagaattctgttcaaatccatacaagatgttgctgtttttctgctctgacaggagaggcatttggaagtgcagtttctttctttctttctttttttccctttttttttaatagctgtcttaaaaaggagtttggctgtttagcacagctggtgctcattacattatgcactggcaataagatagcatgtgtaattaatttttaatgcagtgctggatgcagcgctttcaagcagttagtggatgtgaagaagcagcactggccaaggacatcagagacctcagagcaaggcagccccgttctcctttaaagggactcggaaagtggcagaggaggcttgcattgccctctgtgtggagcggactggcccagaaatgggttcttctcgggtgacctgaggtcaagtcagtctataacaatctaagaccagggatcccaagagatcatctcctccaacctcttcattatataaatggggaaaccaaggcagagagtggggatgaagccatgacacatgggtggcagagctgactcatacctgggtctgcccactaggccatactacctctcttgagtttttattgaaaaccagaaaaggaagttcgtcgcccagtggaagccacttaaagattgatttctgcctgaccatgaggcttggtgtgaaccctgcaatgagattggtagcaggtagagctctgatgttgaggagccccacgttgggtgccttggacttcagctctgctatctgcagtgggagcccaccagacacatcctgggtttgagactctggggttgtgctttgacagctggctgccctgtccctgtggggctctgtggcatggatgtgtgtttgaagttaaatgtcattgtggacccgtgttagactgcaggcattgtgggaagctctagagatggggccatcctcggtccttcccttgcagtgaatgggagtgagtatgtgatcccaggctagccacttacttcctctctccaatcttcagtgtccccacctgtaaaatggggacactgaagtacttgcttaccatccctctactggcaggtcccatgaacagctaccatctgggcgtggccacagcccatgaccagcacctgggggaatcagagggaaaaggccggtgggaagggaaggagggagaaagctgagatgccggaaagccttttgagactctggccttgggtaatcggcaccccagtgacgacttagctcttggaaagccacttgcctgggagagtttcttagtgtgaatgaaggcagaggaagggccaacatcatcagtgttcctggggcttgccactgtttgctaaagggccggctcagtcctaggcatgacatctcatcgttgtaacgctcccaagaagaggcactcccccacccttttgcttatgaggatattggggctcagagaggccacacaacccaccaggggtcacacagcacacaaatagcagaacttggacagagagtctcaaaacagagattcagactcaggtctggccagcctcccagctgtacttggagctctcccgtctggcttcccactgggctgtagtggacaacagagaaggagctgctggtagaaaaccaaatcaaactctgatatggtacctgggagggtcctgaaggtcttccttcatgcactggtcatccttgtgccagaccctgggctggactgagggatccggaaatgggcatgacggggtccttgccctagaggaactcaccgtggtgggggtgcccatggagggccttctcactcagtggatgtgaaatgcatgtccccatggcgcctttctctgtttgaaaaaaatgaatcaattggctgctgctcgggtgctccctcacttattgccatggtgcagctcaagagcagatctcaggatggagaggtgtcccacctgaggacagcttgtccttgtggtcgcattgctgagaggtggggggtaccttctgtgaggatttttacctgaatgaagcacaagtggtgcctgactgcattggaatccacgtgattattggcgtgtttttgactctcattttatccagtggtgcat

SEQ ID NO: 1287 - DNA, 7603 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 1288 - DNA, 2472 bp, Homo sapiens
atgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaa

SEQ ID NO: 1289 - DNA, 43793 bp, Mus musculus
  misc_feature (2690)..(2776): "n" at positions 2690 thru 2776  can be any base
  misc_feature (7970)..(8296): "n" at positions 7970 thru 8296  can be any base
  misc_feature (9906)..(9932): "n" at positions 9906 thru 9932  can be any base
  misc_feature (12180)..(12199): "n" at positions 12180 thru 12199  can be any base
  misc_feature (13667)..(13793): "n" at positions 13667 thru 13793  can be any base
  misc_feature (21988)..(23113): "n" at positions 21988 thru 23113  can be any base
  misc_feature (25771)..(25790): "n" at positions 25771 thru 25790  can be any base
  misc_feature (38708)..(38727): "n" at positions 38708 thru 38727  can be any base
  misc_feature (40651)..(40861): "n" at positions 40651 thru 40861  can be any base
ttaacatgctcttaacatctctctagcccctatttggggggttgttctgtctgtctgtttgtttgtctaactgtctgtgtcagggtcttgttgtatagctctggctatcctggaattcatgacagttctcctgcctctacctcccttttgctgttttgatttgatttggtttgggggtatttgtattgttttgttttgttttgttttgttttttgtttttgtctgaggccaagtctgcagaacaggctgacttggaacttgcctttatcctgtctcaaactctggaattataggtatatgccaatacacctaatttaataaatgtatttttgtcctgtctttacatatgtgaaaatcacctaactacttacagtatctcaaaagctcatttcccattcagacctcatttcagactcttgttagttaacatttttaatttatttatgttctgtgtatggttgctttgtctacatatgtctgtgcaccatgcataggcccggtgcccacagaggcaagaaaaggacctggaattagctggaagctgccctatgggtgctggtggtcaaacacaggtcgtctggagattacaggagcaggccaccacacccacctgatgttttctttttactcactcttgtgtgcacacacatctgtgtgcttgcccttgccagtatagagaacatgtggaggctgaaggctgactgcaaatgtcttccccactctcctcacccatcccctttcttgtttttgttttgtttttccagacaggatttttctgtgttgccttggctgttcgggaactcattctgaggaccaccaggctggtcttaaactcacagagattcacctgcctctccctcctgaatgctgatgctgggataaaaggtgtgcactactatctggctttaaagaaatgtttacgaatgcttttagtttgttttgttttgttttttagatttatttagtatttatatgtatgtttgtgaaccaccatgtgaatgataaagacttaaacctagttcctcatcaagaaaaacaatacagagacaaagtttggagctgagatacagagacaaagtttggagctgagacaaaaggatggaccatctagagactgccatacctggggatccatcccataatcagcctccaaacgttgacaccattgcatacaccttttcagcaagattttgctgaaaggaccctgatatagctgtctcttgtgagactattcttgggcctagcaaacacagaagtggatgcccatagtcatttataggatggatcacagggcccctaacggaggagctagagaaagtacccaaggagctaaagggatctgcaaccctataggtggaacaacaatatgaactaaccagtaccccccagagctcatgactctagctgcatatgtatcagaagatggcctagtcagccatcagtggaaagagaggcccattggtcttgcaaattttatatgcctaagtacaggggaatgccagggccaagaagtgagagtggggggaagggcatgggggacttttgggatagcattggaaatgtaaatgaagaaaatacctaatttaaaaaaaaaaaaaaaaaaacaagtggcagggcggtggtggcacatgcctttaatcccagcccttggggaggcaaaggcaggcagatttctgagtttgaggccagcctggtctacagagtaagttccaggacagccaggagtatacagagaaaccctgtcttgaaaaactaaaagaaagaaagaaagaaagaaagaaagaaagaaagaaagaaagacaagtggtcttaaccactgagccatccaacccctcatctttttgtttgtttggttggttggttgtttttttggcttcttgtgaagtcataacttccagttctttggaaacatcaaatgatgttttgctggtgcacacaggtgaaaggatatttggatatagtaaacacatggaaggacctgtgatgatgttatataaatatgacccccagactgtggaagatgagcactgagccttggtttggtttgctccacctggttattcttccctaatgacatgcatgcatggattgattcgctttacatagtgctgttgagctccacttatggaaaacaccgatattgagaaaaacttgcccaagaactactcgtgaggttcctgcctctggagtgctaggactaaaatcacgtatcaccactgcccagctaattcctcacctttgaaagaaaacaaaaaaacaggctctcctcactggacccagagctcaatatactggccagactggctggcctgtgagccaacttgctgtttccactgccttgccgtaggccagtgggtgaacccggtggtttctacaggattaaactatggctgcctggtgtctgcttgctgagaaggactggactgcagctgctggttcgtgtctggtgtctgcagctgctgagctgtatttggtgtttgctaagggactgaactgctgacaaagaaaatggacctcacctccaaagaacaattgctgagcaggtccacttcccccacatcctaataacttttctcttccactaccactattggtggtgggctagaagagagattgacccgtattaaaagtaggttgcattaggaggcagaggcaggtgaatttctgagttccaggctagcctggtctannnnnnnnnnnnnnnnnnnnnnnnnnnnnnnnnnnnnnnnnnnnnnnnnnnnnnnnnnnnnnnnnnnnnnnnnnnnnnnnnnnnnnncctcaaactcagagatttgcctgtttctgcctctggagttctaggactaaaatcatgtatcaccactgcccagctaattcctcacctttgaaagaaaacaaaaaacaggctctcctcactggacccagagctcaatatactggccagactggctggcctgtgagctcactgttgtcctctccccttgctccatagtctgacagtttcttatgtagccccggctagcctcttgattcattactctgagcctcccaaaatctggaatcagagtcatgagccatcaccgcacatcagccacatacactgtacagcactgggcaagtgacctctcccccctcactgagcctcagtttcctgtcaagtggagggtggtctctgccctattgagaggaggacataaaagaacttcaagacgagggtgtcattcagcagcagagcagtcacctagaacgcgtgaggccccagatgtcgtctcttacactgcaagacaaaatttgctaggcatggcggagcgcatctgtaaccacggcactcagaagaaggcagagccaagagcatcaggacatcaagagcatcctcagaggggggggggggggggttgggggggggaatgattgactcagtagtcaggagcacaggctgctcttgcagagaaccagggtttaattcccagcaccgacatggcgacttataactccatctcctaggggtctgtagccctcttccgtcctccacaagtaccaggcacacatacatgcggtacatgtgcatactatgtaagcaaacactcatatacattaaataaagcttcatcaggccgggcggtggtgacgcacgcctttaatcccagcacttgggagtcagaggcaggcagatttctgtgttcgaggccagcctggtctacagaatgagttccaggacagccagggctacacagagaaaccctgtctcgaaaaacaaaaacaaaacaaacaaacaaaagctccatcagttaaaaataatcaaacaaaggtggcaataaacaaaggactgttgtcacctgcatagtggatacaaggccaacccgtgctatatgaaaccctgtttcaaaaaaataaaagaaagagagagaaaaggtggtgggttagaaagaaagaggcagataggagtgataagttttgcccgatgttagtgagcgcagaagccaaagttgagagtagccgctgtggacctgcctgcagcaggtacccagaaccatggctcgccaggatcctttctcagggatcagtggtgatgaaccaggccttgaaccaccctctccccgaccccacgcactagagagagactcaagggaattgtggccagcccaggtgcagggcagttcctctccactcagagcccacacatatggcaaataaagggccaggagtaagggccactggagcccatctccggcacggctgaacaggaagtgaggcggagtttggagtggaatctggtacctcaaggctacggccacccaaactaaccgactcactgggagacgatgccagggggtctagaagccctcagagccctgcctctcctcctcttcttgtcatacgcctgtttgggtaatgtggccaaagggaaggtgcgggtggggcgggggtgttgcggctgacaggagaggtgcagagtggagtcagaaatggccaggcagggtgatgcataacgtggcatctcttaaagtaacgccagaactctaggaaactgaggaaggaggaacactgcatttgaggccagcctgggctacataatgagttctatctaggccaacctgggcaagttactgattaaaactgtctcaaaaagaaaaggagtgtggggagggaatcagggaaagccgtctgtagctagccacaggcttgagtaagtccactgttaggaccaacactaccttgccccacgacacacgaccttagctccacaggtcagaatgagaactgaggtaagtgttgactgaacaccacaccagtggaggtgtagcaatgggtgtcggtgagggaacgggttttatttgtttgtttgtttgtttgtttgtttgtttgttttttcctctgccttacatctggagggcaggcttgccatgtgaccacatagacccaggtttgcagtggaggtcttaggagcagggactggggccctgctctctgtgtcttaagcctgtgtgaccaggaactggctggggctctttcccctccctttctttcttcctcacttccgaccttcttcttttctgtcatgtccacaaaagggagctacaagccagtgtggagctggggaggctgagaacagggtggggggtggggggcgcggttcaagataaatacaagagcagacaccatagccaccagtccaccctcggctcttagcctcctccgatgccccagacagaactcagtcccagtgcctaggttaatactggtttctctgttttgttttgtttttcgagacagggcttctgtgtgcaactggaactcactctgttagaccaggcaggcctcaaactcccagagatctgcctgactctctctcctgagtgctgggattaaaggcatgtaccactactgcctggcaggtcgccacatttaaattacagagatgagaaacagcctaggcacaaaaaaacaaaaaaacaaacaaacaaacaaaaaaaacaaaaacaaaaaaaaaaacaagccaagcgcagtaaaggagagattcaggaaggtgggaattgggctctactatcttttccaatagcctggttactgctgagctgagccccaccgctgcatctaaggttctgccccaccttcaccccctccccgtgggggttcctaagagttgtaaggaatggggaccaatgggatggttttcatgaaagagtccctgggctgtttggggaacatcaaaatacaaaggggaaagggaagaaagaggccatagggtgtgcccccccccaagtctcccatcatctttttctaggtaccattaccattggtacggctccactcctgatgtgaaggggtctgggctagagcaatcatctccatctccaggctctgacccatctgtctcctctcctctctccacaggtcccggatgccaggccctgcgggtagaagggggtccaccatccctgacggtgaacttgggcgaggaggcccgcctcacctgtgaaaacaatggcaggaaccctaatatcacatggtggttcagccttcagtctaacatcacatggcccccagtgccactgggtcctggccagggtaccacaggccagctgttcttccccgaagtaaacaagaaccacaggggcttgtactggtgccaagtgatagaaaacaacatattaaaacgctcctgtggtacttacctccgcgtgcgcagtgagtagggagggcgctggcctccttgcgttccctgctccctctttcttccaaaacattaggagcagagctagctcctccctcctggacctgccaccagccacagagatggtggcttcagggctccctgacctcgcaagggtcagggctgggagaagaagggacaccagaatgctgagcagcaccctgtcttcacagatccagtccctaggcccttcctggacatgggggaaggtaccaagaaccgcatcatcacagcagaagggatcatcttgctgttctgtgcagtggtgccagggacgctgctgctattcagggtgagtctcccccaagtgacacccctcaagtcatcttggcttacctgggcctggactgtgactcccagtgtccagctggtcctctgaattccaaggtttgtccttccaagtttgggaggctgggaataaccaccaaaaggattcccaggggggtcagcgtgtccccacggccctcatagaaaccctctcacttctggcccgccaacgggagtcccctgcaaatgcagccaagacaagggaagaaggtgtgtcctcccagagcccctgcgtctccttaggccagaagacaacatttttcacccacattggggcttcattatgtagccctggctggccttgaactcacagagatctgcctatttctgcctcccaagtgctgctgggattaaagggccaccatgcctgcccttcttcctttctttaactttttcttttccccaccacctaaccccccaagactgggtctctctgtgtagccctggctgtcctagatataaggctggcctcagactcacagagatccacctgcctctgcctcctgagtgctgggattacagttgtgcacccctatcgccctgcactttatttatgtcttagtgtgtacgtgggcatgttgagtgtggaggtcgaagaacaactttcaggagttgattctttcctcccactgtgggattccgcacaccaaattcatatcctcaggtttgcatggcaatacacttaccagcttgagctatcatctggactttctttgctttcagtttttattttactttattttattttatttttttaaagctagatattagtctaggctagcctcaaacttgctatatcaccatggctggcctgattcctctttaccttccaagcactgaaattacaggcaggtggcaccaccagttttatttttgtttgttttaatttttgttttgtgttttgttttgtttttgtggggagggttagacagcattttgctatgtaattcaggctgggctagaactcactctatagatcatattggtctggaattcccaatcctcctgcctcagtttgccaagcactggaattacagatgtccagcaccactcactccctgctcgccgttctgcttgtcattgaggagcagtagagagctagcatggtggtgcacagctttgaccctagcagcactcaggaggcagaggcaggcggatctctcgggagccaaggccagcctggtccacgtactgagttcccaggtagttcttgctagatagagatcctcagagcatcagtggagtggcagggaggtgcagcagtccacttgagacagggagattgcttaaagtttgaggcccataaaaagaaagagaggagaggggcagagactagaatctgccaagatcctgatggtgggatctgccttgatggtggggagcacagtatccctcactctttctgataaagcacttgctagtaggagacagtctaaaaacccttcacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggggtgtggtgtctgccttgatctcaccctggattgactggacgctggggctccagctgtcagggtactgatgtctcctctctgacccctgcagggcctgaaccttgatgactgttctatgtatgaggacatctccaggggactccagggcacctaccaggatgtgggcaacctccacattggagatgcccagctggaaaagccatgactgacatgtcccacccttccctgcctgccatatgtctgactccagcatccctgcctccccactcttcccctggagtccccccttcccagtgcttgctccagccactcgagtggcctacccttgcctccaggctgccccaccctattctcccacctaatcttgtccttccccaagtccagctccctctctagtgggtaatgagcccttaatcgctgcctctaggggagctgattacagcagcctcgttagtgtcaccccccctcctcccagatctgtcatggccacttaagtgataataaatccttcccaaagcagcccttggcaggagtcatggatctcatgtagactgctcctcaacactgccagggaaccaggagcagaaaacccaagtcccctcccccctcagacccaggattctaggttcaagttctcacctgaccacttctgagatctgggaccagacagttcttgctgtctgtcttccccaaccccctccccccaaaataacaggaagtctcttggggaagtccccaccccaattgaaatgctggtttatctcccttatagggcctcaccctcctcatgtcccaaagcaagggggaaccagcccgggtgttaccaaatttttacctatatttaaactctgagaacacaagatattattttctggagtggggcctaattccctcatgggttcacttgcataaggcagatttggagagtttctgtcaagaaccggggggagggggatgacagagagagctagagtggtgtgacagtcattgggatgggaagagcagactcaggttgttaaaagacaggaggccaagaggagactcagtgggatccccagagacaaggatgcagagataaatagccaaaggaagaagcagacacaaactggctggcctgataataacagttgaggaaaggacaaagcctgaaatctcagagcatgagagagacagccaacagcaagaaatgggcccagcgtgatcaaggcacagaggagctgcagcagggagaagcaacagaggccagaaagcaaggagtgcctggatgggcccctgaccttgtgggcaggaaggccttcgagcttcgaaaaagagatcagggtggtggcgcgcacctttagctttaatctctctactccagaagcagagacacctgagttcgaatccagcccgccttacacaacaagttcgaggccagccagggctacatagggagcccttgtcgcaaactaagagaaagagagagtaagggccagggcaggagctgggcaacagcagggagggcggcggaggcggacaaaggcgaaggggagccgggcggggccgggtggggacgcgcccgcggggaaaggaggagccgcgcgggcggcgagaaggggaaggannnnnnnnnnnnnnnnnnnnnnnnnnngggcggcgggcgggggctccggaaaaacgccccgacttcctgcccgccaggagccaggaagccggagtcgggacaccgggcccgggatccccgagcccgacctcgggcgcctcgccggtcacctccccgcgcggacaccaggtacactgtccctggccccgcccggcctcctcctccagccgccgcagggaggagcagggaggggaccgggcgcggagggcctcccagggtgcgcccagtgaacctgcagccgcctttctctggcctcggttttctcatctgtcaaagagagcaaagagaaaacccggcgcgttggcgcccgcctgtcatcccaggagttgggaagcagagacaggaggattgccatgagttcgaggttagcttgggcgacctagcatgaacctgcctcaaaagaaaaaaaaaaaaaaaaacaaaacaaaacagagagagagagagagagagagagagagcacttgtcgagagcacaagtaggtagagatccaggctcccagcgaagaacgataacactcatttatcagcagggaaactgaggcccagggagtcggactgccttgtcgtagggacagagcatctgggacttgaactcaaagctgtttcctgtaaagagctgtccctgcgatcatggatgcttgattagagctccctaaaataaacaaatatctctgcagtacattttaaagccgagacttacagagcgttaaacacgtctcagaaagcttttttccttaccctctctgtggtattaattatactctgggagatggctgtaggggagagaaccggaaacatatcctcattgaacagatgggaagactgaggcctaaagggaagtcattgcattttgcaggttagtctatcagaagaaaatatatgctcgagcgcatgagtgttttatgcttttgtttgtgtgtgtgtgtgtgtgtgtgtgtgtgtgtgtgtgtctatctatgtgagggggttctgtttttgttttgttttttctttccaattacagcgggaggagttgacagtggtgacagagggtatacaagcatttggaatttaataggtccgagttggggaggtagagctcatgtgaggtcccgataggtgcttaggacctgagcgacttgaagtttctccgagattgagccctaaccaggcaatggaaccatgcaccactcctgctaagggggcggggcccaggagagtgacaggggcagtcgaaatacggaaacaagggtcctccaaggcagaccagagcggccctatcgggccagcgtggcgccgtgtattgcgatacccgccggcaggaggagtggagttgccgaggccggagagcggtaggaggcgggctagagcggccggagggaggagtggagctggacgcaaaggcggcctctggctcggctagagcgactctgcggcacgggtgggggaacctggagctcgagcgcggaggcttcggttcctgaggctgcagtggcttgcttctcttcccatccgacaggtgagataggcagcccttggttgccgtgaaacctgaccccacacgtcttccctgccacccacaccaccaccgctgcagaattagtgagcgcctgttgtagatcagccacgtcccacgtaagatttagggctcgtgaagacccgccacgttacataggtcaataagagctcacataccttccaggtttcaggaagcctttcacggagacctggcttttaacataagcataggcttctcatagatcaaggcagggccctacagaacccaccacacaccactatcgaggtcccataaaccattagttttccctttagaatcaccatctctctggattcttgaggcccactatatgtcaaatagaatgtggggttgtatacattccagggccctcgtagtttttttcaaggctcccagaagttcttggagacctaaataatccagtccaaaggcttgttgaatgtgagcccttaggacccaggcgcctttatgtgtttacttcttcaggacccccccacacacacacacacacatacacacacacacacacacacacacacacacacacacacactgcatagacctaaacctgccctgacttcccctgtccaccccacctccagagcctcaagtgcaaaatgctccctctgccggacagtagtggactttgtcagttgcttcattttgccagctttacctatgtctacttttcaaatcctcttgagcccaggtttctggagnnnnnnnnnnnnnnnnnnnntgtgtgtgtgtgtgtgtgtgtgtgtgtgtgtgtagcagtgttgtgtgctgaatgtttaaactgtggaaccagactgcctgaacctgaatcctggctctgactctcataagccatgcctcaatttccccctcctgtaaatcagcaataagaataatagtgacaccctcctctcctaaaacaaaccaaaataatgctggcctcattgggtcagtaagaggattaaattcattaacatctgtagacagaccctgaaccctgcatagaaactaagcctgtgtgtgctgtctttgctgtgtctgacacatactgagaacacgtgagtgtcagccattgttccttattactgtgatggggagtgtggaggcaatgcatgtgaactgtgaacaagagagtcagggtcttctggtgacaatttgttaaaatttcgtacctcccttggcttctcttttcttgggggggggagttaataaagatttaagcgtgagagttacgggggccactctgaatgatgtgtacaggccagtatggtggcacacgcctttgatcccagcattgggaaggaggagacaagtgactctcttgattcaaggctggcctgctctgcagagttccaggatagtcagggctacacagataaaccctgtctcctgtctaagaaagagagagagagagagagagagagagagagagagagagaatagaaggaaggaaggacaaacaagcattctgtcattgagctacatccccaagccctccttggctcctttggggtctgtcaggtgagtatatttcctgctaactgagatgagcatgggagttcctggtctgtgatcatggcttctaacctagaaggtctggctggctggaaagggtggtttttgaaggcatcttgtttctcaggggatgagtgcttgtagttggggaggtattgcagttgatgggactagacagagtgcttctctccaataatactagaactcaagagaccaagacagggggatgcccgcaagcttgaggccagtctacagagtgagatcctgtctagaaaaaagaaaagcaaaaactgagctgatatacccagaacagttcttacgcactagatgggcttgtttctcataagctgactttgttggcaagtgtatttattaaacgctcaccagtgttcacatcttgacattagctgagcttttatggtggacagatccagcttctgaggaagagtacaaatgatgcctgcttggtggaacccccggccatgacttctggacactacagaaagcatctttggcagaaatcagaatcatagcaacggttcattgagtgctagggaggaggctcctggaagagggagaagggcgggtctcgggcagccagagttataaatagctttggggtgtggggacccgccccctactggtccaccccacactctttccaccattccttccctcctgacactgatccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgcagtgtggagctggaccgaaccaacaccagctgtggaaggacagctgtcctggggtgggggaggagagatagggaggcagaggaggggccagcagaggtgataggaaggatgaggtaggtctgggaggagaggtggagtcccggattcatattgaaggggagcagcatgcccctgagggcaggctgctgagccccacctcctccatcatctttcagggaccaaagctgggaactgtagggaaccatggggcccaagagctcagtgtgtctgacagagagggactcggttttgttttctcgtgtagagggcgttggaggttgggggttcaccattgacatttcctgtcacaggaaatggggctggtgggttcagaggcaacatcctggcccaggcccgccacagatcacagtgtatcaccttcccctactcttcctaccttctcctaagggctgtgcttttaattttgcttgtgccaaagtccctcccccttgagggctagccagccttctgggtccctggtccttccttctttagtgacccaaattagtggttttacccacagccacccagcccacccatggacccatgctcctggcctccagcacacgcccaccccgcttggtctctccgcctcagctgggctgagaagagctctttgtcgccacacagaggctccattgagcttaggaggctggggggtgggggtgtttactcaccttccgcacctgggccaggaatctgtgagtaactgcccagcctcgggcacttcctccccacccctaactgctcctcctctccgcagcccggcggagtcctggagatgggagaagtcgccggaggggcggtgagtgcggggagaagatctgagccaaggtgagggaggtctggtgctctgtgaggtagggagccctgtgaattgaaaccatgtgtccccttgcaggccccagggcctccccggtctggcctggtgtccatcatcatcggggcggaggatgaggattttgagaacgagctggaggcggtaagcagggtggggtgggagagtgtccaccaaggacccagttctccgtcctgggatgtgtcctccctgctcacattatcatctctcaccccatgtgtaactgtctacagtagtcccacccatctcactctaaccccagtttatcaccacccctcccccatttgactcacatcccttctcaggaccggctcaggaacatcaagtcttatcccttcttcccaacttcttgtccttactgtctgggttgtagcataggcccatccacccccatttccctgtcgtgaaaccattgagaggtgcaagaaactgggtagggcaagccttggatgtcccttctttccccttggcactcagctcccttgtccccaccctccagaactcagaagatcaaaacagccagttccagagcctagagcaagtgaagcgccgccctgcccacctcatggccctcctgcagcatgtggccctgcagttcgagccaggaccactggtgaggatggggcggtggggcagagcaggaatgaggctgggcaactaagaggtctggaaagtccagaacacagcatgagttatcgaaatagggccccagacaagatgggaaaagcaggcatatgatctagacaggtttgcagatgcccggtgagccgcagtaagcagggatcccaggcctgagtgcttacagcagaacccagcatcctgacagatgccatgtcctgcccttttcaagcatctccagctggtaacgctgaccttggcagtggggagggttggggggtggcagcaagaccatctcagcaggtgtcaccagtcctgcatcaaggagttggttcccttagccatctagacttagagaacacctcagaccttgatccaaatacccagacaaactccatgtggttgctaacctagaaacgtcctgagcctgccgtgataatacacacctgtgatcctaagcacattagacactgaggcaggaggatagccacaccttcatagtcagctaaggctgctacatggcaagactggacctcaaacaaaagaaacttccagggccaggcaggagacactggggagacacagataaagaactgtgtggtccagaaaccccagtccctgatttagcaagaagccaccgtactggctgggagtggggggctgtgtaggtaggtgcgtgggagcatggacggttaggcctcttcctaagaagactggataccacccagcacaagctacttggcaagggatgtccgagggtcttgcactacatgaaaatgcacgcagaatcccccccaaccaaaactaggagactaacagaaatcacaggcagggacacccggggtgaagaaagacggacacaggagggctggggatgtaactcaggtggtaggaagtatgcctatcgagtacagaggcctgggttagagcctggcattgcataaagcaagcatagtgatgcaggctggtgatcccagcactcggcagaagaggaggatcctcggctacttagcaactttaaggccagcctgggctacatgagaccttgtctcaagaaaaaggcatgaaatgaaacgctaggactagttgtcctgacaccaggctttagaaactagtggaaaattgatgcagtctctccatctacgttcttggaaaaagcagccatccctcctgggtacacagaggctgtccttgcctaggcgttggagctcaggagtttcctatcctagccctacttaactcaaggactgggaagtgctctgtttgacccaatggcttctggctgggaggagttgctcttatgcagcttcctcacccatcagagtatggggcaagaatggaaagagcagacatagatgtgtcaaccagtaaatgtaaaatgttctgctgccagtcagtggtggcttgtgccgttagtcccagcactcaggaggcagaggcaggcggatctctgactttgtaaggccagcctggtctacagaggaattccagacaactatagctacacagagaagtcctgtctcaagaaaccaaagacaaaaaaaaaaaaaaaaaaaaaaaaaggtctgcctgcacaggagtatccccaagcaccaccagaaatgacatgtcacttgccaggcagcagcatttccagtgtcacccaccaaagactggcacacaggcaacttcaggagatggcctggcaagaatgagtggaccccacttgtccacccgtctactgtctgtccctcaccgccctgcaccctaggcagattgccagagacagctgcctacatttgagcctggctttaccatgtgacattgagcagggatgtttattcattgttggtattggggattgaactcagggccttagctatgtgaggcaagcactctgccactgcctcccaagcccttgttatttttatcgtgtgtgatgtggtgtatgtgtgttcatttgggtatgtgcatgtatgtgtacatatgcattgtatgtagaagccaggggccaacatcaagattccttgatctctttccaccatattttctctctccttttaaaattttattccatgtatttgtttgtttgagacagggtctctctgttatgtagcctggtctcatagtgagctgcctgcttctgactcccaagtgttagaattaaagtcacgcaccactaacccccagctctgtctaaaactattcttattaaatacgaacatgtgtgtgggtgcctgtgtgtggatacatccatggcatagcactagtatggagatggtaggacagcctctaagaggtcataggacagcctctaggagtctctcctcccaccatggaattcccagggattgaactccagttgtcaggcctggtagtaggcagagctaagccatatctctggtcccaccttacttttgagacagggtctcctgaccagggagctcatctgattgagattggcaaggctgcggagcatgagctctgggaactgcccccaaggtctaaaggcacaggctgtcaggcttggtttgtacatcagagctggagatgcaacgatgctcaggattcatagcctgtgcttcccttctgagttagccctgtaacccatactctggtctttctttctttatttctttttttttttaagatttatttatttattatatgtaagtacattgtagctgtcttcagacactccagaagagggagtcagatcttgttacggatggttgtgagccaccatgtggttgctgggatttgaactccggaccttcggaagagtagtcaggtgctcttacccactgagccatctcaccagccctactctcgtctttctagagagggtcttatacagagccatgaacttgaaatggtcctcctgcttctgcttccgagcaagcgttgggaggtgccagcagtactggctttaccttgtattttgagataaggtttctctaagttgcccagggctgcccttgaaccttcgatcctttgaccatgaagcttaagctgttttctctctttccttttggtggtattttggtttttttttttttttttgtgacacagattttgaactcctccctggtcttcctgcctgaagtccccagggatggatgtgcaggccggtgccaaggcactgagctttgaactcccaattccacaccgttgtttttagaaacaggcaggatctcgtatagcctagcctggccccacactcacaagtgttcaaggatgaccttgaactcctgatcctcctgcttctgcctggaaagtgaggggaccatagtcatgcaccactatacctgggttcaaggttcccaccggcaaaatggtgataatggtggtctcagtgatggggcaggttcctaaataacctctggtgggccccagatcctcagaatagctagtagagataggtagtagtaagaattggaaaggaataagaaagtattcatagcaatgaccctggagagtctcaggagaccacctggacagctgggctagaagtcagagtgggcttcaccgaagaaggcatgtctgcaccccacaggcatacagtggtcacaaagctgcttaggctatccaaagagggagtgtggtggttggggccgggagaaagagtcccgctctgtgtgtccccagctctgctgcctgcatgcagacatgctgagctctctgggccccaaagaagccaagaaggccttccttgacttctatcacagtttcctggagaagactgcggtgagatacctcccagctgcccctgtccctctcccagtgtctatctgtggtggtgcctgccaatgtggggcctcttcagtgtcttccctcagacccttctcaccaaggtctcctgagatacatctgccaccttactcctttctcccctgagcaggttctacgggtgccggtccctcccagtgtcgcttttgaacttggtaagaagaggaggggtctgaggataagagaggctttctgaccctggagactcatgggatggaagccatgattcagtcattcattcttggtggtggcagcacagggaaatattagaatccatgggtggggaccatgatccaagtaggttgggagccaggacccctggaatgtggcccctagcccttgcatgcatgtctgtagatcgtactcgacctgatctgatctctgaggatgtccagaggcggttcatacaagaggtggtgcagagccagcaggcagccgtgagccgtcagctagaggacttccgctccaagcggctcatgggcatgacgccctgggagcaggaactgagcctgctggagccctggattgggaaagaccgaggcaactatgaggcccgggagcggcatgttgcggagcggctgctgtcccacctggaggagacccagtaagtgggcactgagattccagttccagtgtgggtctgcctcggtgtcagtcttagtgtctgtattcttgcctcatccagagttctacttggacctacttggaccatggtcccactgtcagcctaactcttagaactctggggttccattgaagtttctgggtcttgtccatggtcatgtgtttgggtctagcgcttgtgtcctctggaatggaccttccgaggtcactttcccttctgcttaccctgcttactgaagagatggcagcccagaagtgatcctccgtggacagggaagccaggttttgtgatttcattgtaaatttctttctttgcaggcataccatctctacagatgaagagaaaaggtgacagctgtggggagtgtcgtgaaaaaaaaggcatggtctggaccagagggaggccatggcgtctctggggtggcaccctcgctcctggctttgggagccacccctctcctctaaccacaggaaatgcttgaggggttgtgggggactgtgtctttgtcattgtggacatagtgtgctcctgtgtgtctgccccggggacccttacctcactgtcttctccccttagtgctgctgtggtcactgccatcagcctgtatatgcgccaccttggagtccggaccaagagtggggacaagaagtcgggaaggaacttcttccggaaaaaggtgctgaggtcaagtctggccctgtcctttctaagaatcttcctgggtgccagccagcagtcactttctgctttgtgtcattttggaagccatagtcttccttttcatcatctccccacaggtgatggggaatcggaggtcagacgaacccccaaagacaaagaaagggctgagcagtatcctagatcctgcacgttggaaccggggagagccatccggtaagagggctactggccccacccttgcccaccccgttcatcccaggccaagctcactgtcccacttttttttttttttaattttattttatttttattaggtattttcctcgtttacattttcttttttttttttaaagatttatttatttattatatgtaagtacactgtagctgtcttcagacactccagaagagggcgtcagatcttgttacagatggttgtgagccaccatgtggttgctgggatttgaactcctgaccttcggaagagcagtcgggtgctcttacccactgagccatctcaccagccccctcgtttacattttcaatgctatcccaaaagtccgccatacccacccccccaatccactacccacccactcccccgttttggccctggggttcccctgtactggggcatatacagtttgcaagtccaatgggcctctctttgcagtgatggccgactaggccatcttttgatacgtatgcagctagagtcaagagctccggggtattggttagttcataatgttgttccacctatagggttgcagttccctttagctccttgggtaatttctctagctccgtgtttgctaggccccggcatagtctcacaagagacagctatatctgggtcctttcagcaaaatcttgctagtgtatgcaatagtgtcagcgtttgggagctgattatgggatggatccctgcatatggcaatcactagatggtccatccttttgtcacagctccaaattttgtctctgtaactccttcaatgggtgttttgttcccatttcttttttttttttttaaagatttatttatttattatatgtaagtacactgtagctgtcttcagacactccagaagagggcatcagatttcgttatggatggttgtgagccaccatgtggttgctgggatttgaactcgggaccttcagaagagcagtcagcactcttaaccactgagccatctcgccagccccttgttcccatttctaagaaggggcaaagtgtccacactttggtcttcgttcttcttgaatttcatgtgtttagcaaattgtatcttatatctttggtatcctaagtttctgggctaatatccacttatcagtgagtacatattgtgcgagttcctttgtgtttaggttacctcactcaggatgatgccctccaggtttatccatttgcctaggaatttcataaattcatttttttaatagctgagtagtattccattgtgtaaatgtaccacattttttgtatccattcctctgttcaggggcatactgggttctttccagcttctggctattataaataaggctgctatgaacatagtggagcatgtgtccttattaccggttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcaatcccaccaacaatggaggagtgttcctctttctctacatcctcgccagcatctgctgtcacctgaatttttgatcttagccattctgactggatcactgtcccacttttgtttcagctccagattgtcgacatctaaaggtcgaggctgatggtaatgaacctgtagttaaggtgtccatccagggctgagggaggagggctggggtctggagccctgggtctgagggaggagggctggggtctggacccttgggtctgagggaggaggactggggtctggagccctgagtctgagggaggagggctggggcctggatccctgggtctgagggaggagggctggggtctggagctctgagtctgagggaggaggcctggggtctggagccctgggtctgagggaggagggctggggtctggagctctgagtctgagggaggaggcctggggtctggagccctgagtctgagggaggagggctggggtctggagctctgagtctgagggaggagggctggggcctggagccctgggtctgagggaggagggctggggtctggagccctgagtctgagggaggagggctggggtctggagctctgagtctgagggaggagggctggggcctggagccctgggtctgagggaggagagctggggtctggatccctagatctgagggaggagggctggcatgtggactcctgggtctgagggaggagggctgggtctgaggaagaagtagagagtatgtagagaactgagcatgggaggagggggtctctggtgtggaagacagccaagagcacagtgtcatagttctcctggatgcagtagcagatgggactagatgcctctgtttatttccccttttcattcttccttgccgtctttccagcagagaagccaggccctgcagaccggaagggaggcctgggtatgtcttctcgggacaggactgttgggactcctggacaggacaacccaggagtctccctgcaccctctgtctacagacagcgtcgactcccgggaaccaggtaagcgattctgagtcgggacaggagaaccacgagccccacagccctacttggatgaaagcccctgtccctttgagatctctcctttgttctccgcttcttttccagcttctggtcaggggtagtaattgcccgctgccttagtttaccctttgggctctgacctctgtgttggtgtcatgtctccttatccctggtctaggtttcttgtgttgttgtcatttggggctttggttctggcactgggggttggaactctcctcttcacacatggcaggggagctctctgccaccaagctacacccctaacccccactgctggactctaggccagagccgtactgatgagctgtgtccctcctgaccagctgtttccaacagtccctggggttcatttcctggaatctcagtgaggaatgtcctcatgacactcttgtgtcatcttgaatggtgaaccccaaagccctatgagtttactctgtcttcccacagctccagggctttcatcttagcccttaggtcccagacgctcttgtaacctgggttcagatctctcctgcagcttacttgtgctgtgttatggaagccacttccctctctgggttcacttacctttcagtgggtctgtccgtttcccttaaggctttgtggacagaggactgacggcttccagtcccctcctgcctggggtgggaggacgctgtagttctgtgacgacgccccctccttctggtgctagccccgctgcagtgttctgaggtctgaccgagtttctgtcctctcacactgaatactgcatgagtaggtggttaatggccaggcactgagtgtcttctagccctccctcagtgcacaggtcagggagactgagacaactacagggcagaactccatccacatcagaggccttccaagcagctctcttcttcccacccacacccctctatccataggcgtggataccccgcaggagccaggggatacacccccacagggccctaccagcctggagcccctggcgcccccagagagcacagaggacaatggcgagactgagaggtgtctgctgcggtgctgggagggcctgggcagggcagggcagggcagcatagagggcccagggagggtgcttgggattgctgctgcagtctgcacccgcctgtcccagtcatctctgctgccggacctccctcttctgcctgtctctgggcttcttccatccttgcctttccctcctcccctcctcctccctcttctctttaccctctgtttccggccttctctggccaggttctcctgggctccacctcggtcctattcagcttccttcctctcgttcccaccatctccctcttctcagtaagctctgcctccctcatggccctgctcttggtgtcccttgccctctctgtgctccaagctgcagtgtcctgggggccttgtccccctcacagttggggggcaggttctgccccctgcccgtccttgtgctgctgcttcggggaacccttggtgggtgtggggagctgggctgggcacacctggtccacctctgaccctgttgccctctctccccataaggtggaagaggtgggtgcctgggccctgggnnnnnnnnnnnnnnnnnnnnctccccctccccatggccacctcctccccttcaccccctgtgaggggaggggtgggtaggtacgtcaccctcccgattgagctaagtatggaaatcctttctccttgtccctttccctgaccccagcctcagggaagggagggggctggtcctgtgggccacagtgggttttgatctgcccaccacagttcagtacccttggggccactcccaaccccaggtacctccccaagttcactacttctgaccttctcttctctcttctgttgcttgtttcatccctgacccggtcttccctgtccctgtcctggtctgtcctggtctgtcctggtctgtcctgtctgtcctggtctgtcctgtccctgtccctgtccggtctatcctatccctgtccctgcctgatctcccctgttggctgtccctggtctgtcctgtctctgtcctggtctgtcctgtccctgtcctgtctctgttctggtttcccctgtccctgtcctggtctggtctgtcctgtccctgtccctgcctggtctcccctgttggctgtctcggtcctggcctctgcctgactctgtccttggcctcggggtccaggctatcagggcgtctagggcgctcagagagcctgcgggtgagtgaccgccgccggccttcccggggcagcctcggggctaagggccggggtgggggccgttcccggagcgacgtggacatggacccgggctccgccacggccgtgcttggccccacccgacgagccacgtacgtcatttccccctcgcaagctaaggaagcctagagagttgggaggtggtgggttgatgctagactctcaaagaaatagacatccggtgtctgaggttgctcgggccagctgtggacagcatagaccattggggagttgggaggtgggacactgcagtctagagacctggggagaggcgtcaaatgtcaaggccacagagggcttgtaactaaggaagagcaagaggctcccctggggtgctccaggatggagcttaacagtgcctctgtccacagccctgagcccggagatgatggggagccaggacggtcaggcctggaactggaaccagaagaacctcctgggtggagggaactcgtgcccccagacaccctgctcagtctgcccaagagccaagtgaagcggcaagaggtcatcagcggtgagtgctactctggagtctgcactgcagccagggatgctggccagtgctggctgaggcagagaccgagagcatgtgagagcagctgctttccaacagaagcagctgggtgcataggctgtggaacagacccagtgtgagtaagccaagtgccactgtcagccgagcgtgcgcccggagactgtgctgtcagttactaccatcagggctgtgcctccagaggaggtgtggcagtgtagacagtgctgatgtcgggagccagatacagcaaagcctgtcatcccagccacgtgccctggggatcaggtggccagagttcaaggccagggtccatgagatggcttactgggtaaaaggagcctgctgcaaagcctgacagctaccaggacccacatgctgggagagagccacctctacaaggtgtgtgtgtgtgtgtgtgtgtgtgtgtgtgtgtatgtgtgtgtatgtgtgtgtgtgagagtgtgtgtgatttttttttttaaaaaaagttttattcattttatgagcacactgtagtgtcttcaaatacaacagaagagggcattagatcccattacagatggttgtgagccaccatgtggttgctgggaattgaactcaggacctttggaagagcagtcattgctcttaaccactgagccatctctccagctcagacttatttatctatctatctatctatttctttatttattaagaaggaaacttgcgctgggcagtggtggcacacgcctttaatattacttcttttttttttttttttttttttttttttttttttttatatggaagtacactgtagctgtcttccgacactccaaaagagagagtcagatctcattacagggggttgtgagccaccatgtggttgctgggatttgaactccaaaccttcggaagagcagtcgggtgctcttacccactgagccatctcaccagcccaggcacacgcctttaatcccatcacttaggaggcagaggcaggaggatttctgaattcgagccagcctggtctacagagtgagttccaggacgaccagggctacacagagaaaccctgtttcgaagaagaaggaaaaaaaaaaaaaagaaggaaattcgctttcttctcagccccttaggatcagaagcaggtgatgtctgtgagttctaggctgaattggactatacaccaagtcccaggactctgtcacaagagactctatctctaatcaccaaacccaaaacaaaccaaagaaggaaaaaggagctagagacagtctgaaactgctcttgtcctgcctctcttgggcttcttactgtcagctgtttggtttttttaggggttttgcttttttttgttttttttttgttttgtttgtttgtttgtttgtctgtttttgagacagggtctttaaactagccctgactctcctggaactcactcagtagactaagccttccttgaacagacggacataactgccacccacatgctgagattgaaggcatgtcccaccacacccagacatttccaacttgtttgcttatttgtttgtttttaacttattctgtttctttttatcctacaaagtctcgtgaccttggtggagtagtatcactggtttttctgcccgcctgcctgaaacagaaaacgagaaagggtgtgtgtgtgtgtgcgtgtgcacgtgcgtgcgtgcgcactgtagcactgtagcactcctaagtgcctacataaggcggtaatggctccacccagaatatgttctgacctcaccagtttctagggattcttcctcagcctctgcgctctcccagcatgcctttgaacctgtccctagagcagcagttctcaacctgtagggcttgatccttttggaggtcacttggtgatatcctgcatatcagatatttatattacacttcacaacagtggcaaaatgacagttatgctgcagcaatgaactagttctatggttggggttaccacaacatgaggaactgtattaacgggtcacagggttgggcaggttgaaaccctctgctctagagcatgtaccctcccttgtgatgcttcctatttggggcccacagagctgctcgtgactgaggcagctcacgtgcgcatgctacgggtactgcatgacctcttctaccagcccatggcggatggaggcttcttccctctggacgagctgcagaacatcttcccgagcctggatgagctcatcgaggtgcactgtgagtgccagccacagctccctcccttctccagcacatcccagtaccaactccctcctccaggcctcctggacccagagcctgccacaggcagcctggcctactcctggggaccacacattcccgtcccccacagcatacaccccagaggtacagacactaaacaagcacacaaaatgcgtgacagcccaccagccccaaggatcaaacacataactgcagcctgagccagcagcaacctaaaccaggcatttcagtctcttctgctccagtaagccacctgctttcctgtgccccccacccccagccctgttcctcgatcgcttgatgaagcggagacaagagagtggctacctcattgaggagatcggcgatgtgctactggcccgggtgaggtaccctgacatggtcctacacaccccagagacccgggccccaggcctgtgtactttaggcttcctaaagtatgagaatgtttggacaacccgacctgagaccttcccttgcctgaatcttcccgcagttcgatggtgctgagggctcatggttccagaagatctcctcccgcttctgcagccgccagtcgttcgctctagagcagctcaaagccaagcagcgcaaggagcctcggttctgtgcctttgtgcaggtacagtgggtgggacgcgagaatacactgtggtgtcctgggggtgagggttgagggctggaactgaactctgcctcataggagagaagggctgtgggtgtggccctgggctacccctgtgctgcctgcttgctcctcaggaagctgagagccgcccgagatgccggcgcctacagttaaaggacatgatccccactgagatgcagcgactgaccaagtacccactgctgctacagagcatcgggcagaacacaggtaccctcccggccttcctctgaccatggccgctgagtgaggacatgccaggctgacgattcacaccgctccctttgcccgcccgcagaggagtctacagaacgagggaaagtggagcttgcagctgagtgctgccgggagattctgcaccatgtcaatcaagccgtccgtgacatggaggacctgctggtgagctggggcctggctccacccaggacggggcatggtggggaacatccatgcacctggcttagaggtcagtgtccaggagtcagttggcctttggtgtcttcctctcaggactcctggaggtcagatctggacctcagcctgtcccctgcagttggccttatatcattgcttatccatctaccttggagtcgctgagggccagcccctgtgcctggtttagctccctgtaaccctcctgtctctgtcctagcggctcaaggattaccagcggcgcctggacttgactcacctacggcagagcagtgaccctatgctgagcgagttcaaggtgaacccctagtcttccctcagctcaccttggccctgctgccctgggggttcttatgtacactgtggctgagactgcatcccgggagtctccacccccatctccttcccagagggtgtccatggtgacctctgacctcactccctggtccttggctgttcagctgccctcccctcccttcatcaccttagctgatcatggctccttcctgcctcagaacctggacatcactaagaagaagttggtccatgaaggccccctcacgtggcgagtgaccaaagacaaagctataggtgagtgcacccaaaggtggtggggccatgggtagaggccaggcctgacattgctgcctcacccacagaagtgcacgtgctcttgctggacgacctgctgctgctgctccagcgccaggacgagaggctgctgctcaagtcccacagccggacgctgacacctacccccgatggcaagaccatgctgcggccggtgctccggctcacctctgccatgacccgagaggtggccactggtgagctggggcaggtcatctgagcgcacttgtcctatggcatggggagtggaactctctaagagccacagagctcactctggggaggaacaaagacttggaagggtcctaatgaggcagaactgggcaggactaagtaaggatggcagagatgaggcatagactgtcattgcagaactcaagaggctaagggaagagagaggagcttgagtgtgaggtcagcttgggctataaaggaccaccctgcctcaagaaactaaaaatagccatgcttggtgacatatgcctttaatcccagcactcaagaggcagaggcaggcatgatctctgtgttcgaggccagcctggtctacagagtgagttccaggacagccagggctacacagaaaaaccctgtcaggagaaacaacaacaaaataagaaactaaaaataaataaaaatagagggaactgcctgcatttgcagaagagcatggtctgccccaagggttttctgtttttttgtttgtttgtttttttcccacaatgctgtcccctgccccctgtttaggaattgtaggtacttggaacataaggcagaagccagggcagagagttttgcaagcattgctgagaggttgtgctagggccactggtgccgtatggagggctctccaggtgaaggcagcctgggctctggggcctgatgtgatcagggctgtggaggaagacctcaggacagtgagtgtgaactgtatcacatgaggagagaggagcaatggcgccccagagggggccacactgggagccctagctccaagtcacatctctcccctccctatgcagatcacaaagctttctacgtcatttttacctgggaccaggaggcccagatatatgagctggtggcacagacatcttcggaacgcaaaaagtgagagtccccaaggatggtgtgaaggtgtgtcccgcatagggtggggtttaggtgtgctgaccacctctggtcttgtcctgtctccccagctggtgtaacctcatcactgagactgctggatccctgaaggtccctgcccctgcctcccgcctcaaaccccggcccagcccaagcaggtaagggtcaaggaaagaactggagaagggggcgtgggggtgcttccgtgcacatctacagaacttaagccccagcgcatgcacagatgtgcgtgctgagtcaagtgcagcctgcctccagctacctgtaccccaatgtgcccgtctttgggccagggatacggggtcacctgtcacttccctccccagcatccgagaacccctgctcagcagctctgagaatggcactggaggcgcagagatggctccagctgatggtaagtctcaaggtcactggctaggggaggtcacctgaagccagacaggacctgagcatccctgtctgtctccctacccagccaggacagagcggctcctcaatgacctcctgcccttctgcagaccaggcccagagggccagcttgctgccacagcccttcagaaaggtatgccagccctgcaccctccaaggccagtgtctagtgaagtggtgcctctgttttgaactagtgaaaggctccgtccgtctttcagatgtctgtatgtccacgaatcaagaaacccacccaaacgcctttcttctttagctgctcccccgccatgggcgctaagttcagcttctccagccccaggcctcctgccccatcctaacccttttgactgataaccacctcatccctcagctgtcatctggcccttggcctcctgccccttgtgaccctgttcctcttgccttggccagtactgtccctgaagcagatcctgctaagcactgaggaagacagtggagcggggcctccccgcgatggggatggggtgcctggtggtagggcccccggcccagtgcacacccaggagattgaggaaaacttgcttagcttagaggtggccatcagacaactggaggtatgcctgggggctgggggctgggctcgggcaggctgtggaaggaaaggcattcttcatctgtgatccccttcaggagttggaagaggaattttgtcgcctaagacccctcctgtcccagcttggggggactctgtcccccaacctggctgcacctgaacgctctgctcagacaggtgagtggggaactggggtcagggtgctgttctgaggggcaggaggggtacccttacccaccagccctctcttctcaactcctttccctccctctctccgtgtctgttaccctcaggcctttcatgaagagaagagtgggggagaggatgcaggggggcccacccccacccccacagctgccacagcatctcacaccccagaggcctggagcagagggagattggctgaacttgatagcagacctgctcgggtccctgcctcccactctggcctctgcctttctccctcctgccttctgcttggggaactcagggcttcactcccagagcacccccttaatccccacttttcaggccgtctcagtattgcctatggggggtcaccctccttcccctaccccaagtgcctttgctatgtttttatatcctggactggaggtttatttttaatatatattatctaaggaaagatctgtgtgtgtgagggcgttgggcagtgcgccccatgtctgggcctgtccttgacttcctgggtctgacccacgtcacctccatgactcttgcttcctttcaagcttcttccacccacccacccacccatccatccattcgcttgtcttacatttttatttagtatattatgggaggggcgcactgtgtgctacgtcagaggacaacttgtgggagttggttctccttccaacacctgggtctcagagctcagactcagatgacagacacctgtcccttttccctcactgtactaaggactccacacacgtgcacgctgcatgtgaggtgtgccccgtggtcatgcagagtgaggcacccacaacgcacactcagttcttttatttttgtagtaaactctggaggtggccgtgggatctgaacgggagccggtggggagagggcccctcctgggtggggctggggcgggggcggggttattgctctgatctccctgtccccaaggggacctgtgtgggaggatttcaagagggggctggcactggattggggacactgccacacgaacacgcaggtcacagcacataggaggtcaggggaggctgggcgccgtattgcactttgagagtggggccaggcggttatccccctcaaatcagaacctgggaggagactagaggccatcctgttgctctccactctggagaaggtgtgacctccacttgggggttagaaatggccaggagggtgccaagggctggccctgggccttgcgctagtgttaagggcagaccatgtagaagcttcatggatgactgccctggtcaccagcaggatccaccctacacctgctcagctgccgttcccccctttgcctgacttggtcttgggggacactggaccctcatcgccctcactgtcagagctgcagccgctgacatccgtgacctccagctcagagtcactgtcctccttcccagccaatgtggcctctgggcctccagcccctggcagtgccaggcgaggggccactgccagcccggaggggcgctcagggcccaggccctcccctgtcgcagcaagcaggggtgcagccatgggccctccccctgctcctgcagcagacaggtggcccagggaacccaaagggttggggtagaagtgaggtgggtagagagaggggggcaacttggggaaggggccggtgaggtatgggttgaagttccaggggtactcagggaaggcgcggccgtaaggacccagcaggctgggcggcttggagtagcctgtggcacctgaagaggcataggaacaggtcaggctggcccactagccatggggccctgtttcatggcggatgtgcctcctgcatggtctcccaccctccacctcacctcccccacttccctccctattcctttaacctgcctgcccccaaaaccctcctgccaagtagccaactccctcccattaagttgttctgcagcagagcattctctgccttgattggcttttagaaatgttcccattatataaccaaaattggcttccaactcataatctacctgcctcggcctcttgagtgctgggtgccacgtagcttagcctgacactgaacttgattgatctgtagtcaggatcaagactgagcttggtcctccaacttgtgtgtccctcgtgcaggggtctctggtgtgtgcaccacacccaactgctgcagcactgactgtaaccttgcttcaagcactctgactgagctacatctttgccgcatcccctccctggcttttaaacacatgtacccacacgtactctgtagacacatctctatcttatctcctggagtacacactccacgtgtgctgatcccctcccccagcccccagccccttaccagaacccaggaatgggaaggggctgtccagacgtagtttatccgtctctggggtgaataggggtgtccgagcccctggctctcctaggcgtggggcagagaacaggttctgcagggtctggagagggaggtagggaggcggtactgcttagccccctctggagaggacacaaaacacccctcttccagcactaagattgcagtatccagactcacctcaggggtcaggggtggagcatctggcccaggtgccccagcaaagggcccaggggtcagcaagagaggggagcctgtggcagcagcagccacatccagcagtgggtaattaacaagtacaactttgctgaagttgaacttgtaggtgaacctcttccctttggtcttgtggagaatgcgcttgttgtagtagtaactgtgggagagaagatggggtactggggaggggcaagggggggtgaggcagtagccgggctcaggttcctcaggttcctcatcgccaccccctcccagtttccactcacaagtactggggtccactggaattcagtcctaggatacagagggaatgccccacctttgggggggcagaaaggacagcgaagggaggagagagcaggatgggggtccggcccacagcccctcctcaccgcagggcccggctcagcttgtcataattcatgtggggcttgcacttgcgaatgccccatagacgggccacctcatcggggtccttgatgacaaattccccgtagtccccttgccaggcgatgacgccctggtactcctccttctgcaacagctccaggataaagtgccacagctggatctgcctggagccaggagatgactcgggcttgtaggcccaatctgggaaggcaaaccctagggacaggagacagggaggccttaaggttaggaaacagttgggggctctgggcattactggattttgcaacttgagatgcccagtctcttgagagcaagggaggagagggtgaaattgagagggacccatttcctgcatccacggctcttgggacgtggctgaaaagggcccactctgagcagtgatcaccctgtagggaggcctgagatatttctagtgacttgtgatctgccccttgcctaaggcgctcctggcactcagcccgtatgcatctgtgtatctacctctggtctgccccttcccatgtgctcccatcttcaagctgtcaggtagaaggctgtgtgtctgatgcaggcacagccgtgcaggtgcccatggcagacagcacatcatgcagacatccacttgccatgttagtccatgggacacaaccacacccaagtgccacacactcctgcttagggctgctaaagcaaacagatgtaggctgcctacactatatggatgcaacaacccagcatggtacacccttggcaacatgcacaaatacagacacacaagcccaacacccagctaacacctggtgtgacaaagataatgaggccatgacactcaagtccccagataggcagacgggcacatgcacagtaacaagacaaccaaacaacctcccaggtctacactccagcctgtgtatgtctgcaattgcatggtccaattggccttacttcaccctgggaggagtctcctggttcccgccatctgtacacacttagagaccaggagcggagatcctacctacccctggtctttccaagctagaaggctctggatcccagtgtccacaccagctcctatgtcatcccttgtcttgtaccttcccagagattgccatgatccagacgtgaacacatatttaaatctggtctctagcaagctgagagcagtacaagagacagggaaggctagggaagccatcaaaggctgggacatgggagggactatgctgagctgggagacctgggtccctgtatccagttgctgtgtagccaggggatagtttctgtcctctctggattgaggttctggaagcaggaggcaggaagtagcagaatctcactggtgcaggctgccctctggtacatatgtgcaggtgatgccccaactgccaaaggacaggcagtggtcgccactccctgtggaaggggagttttaatctctgagccatttcatctcagatgccatcgacaatccgtccagatggaccctggccaattcatacccatagctcacttccctggggaagccaccgcgtcacaaacatgtttgcacaaccaagagaccagaagggatccgctggagagaggaccaatacagcaggcaggcatagacaaccccagacacagtccagaaaccaagcccagatcctgatatacaggcccagggccatctacccacaccctgcaaaatagacctcagatatccactgagagtgccacagacgaccagagacaggcaaatcctctttaccccaccaaagcaggagtatggcacacaagctgccagacgccaaaagtatacatgcatgaccccgagatgtagagtccctgaatcattcctgtggcctctgtggtccaatctgtgtatgagcaggcgtgcattcacacaaagatggccccctgcagacacttgccctctgtgaccccttcaggaacactgaagtgtcgcacatgcacgcatacactccacagtgaaactcagagcagacagacagatgctctcaaagactccctcttattagtgacccattcgtgccaagaagatcctctccccctggcttaaacaccacatgcctctcctttcttctctttaggctgtgccctctccttgtgcctagcctagagctcgggggaggtgcagccaaatggacatggtgcggaaatccttcatctccgccccttccgtcctcatcctccaaaagaccctggacctttgtgtcccagcaagcaggtggcagggatagcagaccatgaagaagtttctggtcaactttctcatgaaagggtttgtagccagggaactgatggggaccgagacagacaggttcacaggtgcatgagagagacaggaagnnnnnnnnnnnnnnnnnnnncatttccgtgttggttttgatttctcttccccaacgctttcaactcccccgccgcctcctccgggacacgttataacgaggagccgtgggatcggcgctccgggccctgctcccacgctccccccgtcgtctctcacacacatctctgccttctcgcagtctctgctgccactttttccccatctctctcgtgtctggtctctgtcctgtgtatcagcccccccagccccgaggacctggttctggcccctccagccgggtcggtctccacctagaccagcatttctcctatgtcggttgctagcatctctaggtctcatctctcggtctctgtgtccctgggcctttagtctccacatggttcctctctccatttctgggtctccacatctctgcctccctgtctgagtctctctttcttgcaaagtccccatctctgtctttaggtctctctttcagtcccagtgtccctctcttgggactcctttgatctcgccgtgcccctggcacccccctggccccattgattgctgatcgacccatggaggaagtagggccttcggcccggggctatagggccaggcagcagctttggcagagccactggacagatggacagacagccccagccccagccccagccccagtggctgaggagggggagcatcacaagcccctcccagccggccggcacgatgcggatggggactccgggcaagctttaatttttaattttattttgcttccttcagccccccctcacccccatctctagcgcccgaagccatggcaccgaatgtgtgcgtgagtgaggcagccgcttggagaggggttgggcaggcaaaggctgcctccctctgttccttaccaagcacaattacacagacccacacctcctgcaagcacacaggccaacaaagtcacttgcaccactgcattccccacacactgtcacactcaaaacacacacagagacagaaccatgcacagtcccacagcccacacatcaatgaagtcacacatcaatgttgtacattctcatgtacaacagaaccagacacaagatctgcctagactgatgcatagtaacacaggcaccaggtcacacaccagtgcaatcacacagagagacaatgtcgtacagaaacagagaccccccccccctccccatacacagcagcacagacaagtcagcagcaggcacagtcacacatacaggtactagagaccttccatcaaacacaaactggagcacaggcagacacacaaaacaccacaaacacaggctgccacagccagatggcacacatgtgaggccacacccatcaaaggcatagagccacagtcagagtccccaatatgatcagcacagtggggaaaccccacagcagcccccatgctcagagagaggcaacactctcacttagacataggggctcagttcagctgggtgggggcgcccatttagaggctacagcagcccagcaacgtcaatgtccctgccaccatgggtttgtctgtcatctgtgaatctcactctctctctctcctctctctctctctctctctctctctctctctctctctctctctctctctgtgtgtgtgtgtgtgtgtgtgtgtgtgtgtgtgtgttcaaaacgtgtgcttgctacatagtcgtctcttcagtccccttcattgtctgtgtctgtctgtctgtcaccgagggtctttttattgctcatctctgtgtgccttagtctccagatgcttttgagtatctctcattctgtctctggacgccctcccccgtcccccttggcctctgggcctctctgcctctgtctcctcaccccatcaccccagccccctgggctggggtttaaccagttgttttgatttctctaagctgcgctgagccgcctcgggagccgcctcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactgctcccgcgtacagcttgtgcatgcgtttgcgcgcgcacacacacacacatacacacacacactgctcacacatatactacacacacacacacacacacacactgctcacacatatactacacacacacacactgctcccacatacaccacacacacacacacacacacacacacacacacacactgctcccacatacaccacacacatacacacgccctagctcctgcattcacccttcctcacaccacatgccaatgtgcacacatctgtgcacacagcagagatgatgcttgaccatgggcacacagaccaatccacactctgggcccacgggcatgctgccagctagcatgagctcctatggctgtcctgacaaaaaagaggtctctcaggggctgtcataccaatacctgccaccttaccgcaaatgtcacccaattctcaccctggtcacatcaaccatactctctgccctggctcctaggaggggagactgtgccaaaacttcatacttcacatttgtgtaccacacacaccatatacatactacacacatgccacacacacacacacacacaagacatactacacacacacattaggcaaactatacacccacacacacactacacacctgtacagtagataaaccatagatattctacatatctgctgtacacataccacacactcatatcacaaacataccgtacctcacgaacaaaactgtacactcctatatgccatacaaataccatgtgacatacactccatataccacaccacacacccatacaacatataaacaccacataccacaccacatcacatatctactacataccatatgtacaggtactcatgacacacccatatatgcatcacatgcatatcacacacgcagaccacatagaaatcatacaccacacatagataccaagtcatacacataccacattccaaataccacaactaccacatgccgtccctgcttcccccagactgcatacagataccacgaagtgcaagaactgaaaccccttgtcacatagggtcactcctgatacacagatccacacggaggcagacatgccatcatagacacggcctcacacccagaatggagcacaggttcacactgtgcacacacgcagcagcaccccagcatccacccagggatgcacaatcacaaggtcacacgtgcacatgcacacgctcagcgctgttagcattcctcaggactggtcatgcacaccctctctgctgcaaaccaacattcactccagcctgctgcatctcgcctcccaaatgactgtctgtgcatgcacacacagcgagaacaccataggcatccaaagccagagtcagacacaggctcagagatgtagtaaccaccgtcaacagtctgccacacagccagggtctggcacaggtctgggggcctctgtagctactgtgcttcccgggtgagcccctcctgctcagcacccccactgacagtggcccctcagcgcccctgcctctcccaccccacttctggactcaggctccttacctcctcaccctcagggacagctgtcctgccttggtcactcagccctgcacagatgcagaaacaccaaacacagctcaacccagagttctgggcagtcacacgcacagctgatggacccacatgtgtgtcccactgtcacatccatagatgtgtgtggctttgggcagcccccacgacctctctctcgctctctctctctcgcgcacacacacacacacacacctaatcttctgtgcccagggacacacacaacaattgacacaggccatatttacatgtgctacaacacacagacacacaaggggacctttgagaaggcttcactgcaggacagggacaaggcctgggtgagatctggctggtaccagatttggggtggttaagaaaggaaagaggagtccagggcctggaagggcaggaatggagggcccaggccccaccttggaccctgccaccccaccccaccccaccccctgtctctctctgtatctctttctggtctggagccatgcttgtctctttgagtctctgactctctcctggagtcccagtctcagcacggatgtccctggggctgcagccagcctgcagaacgatgtcagtgggggtagtggtgagggagagtccccagggagttgggagctgcagtgccacgcaccccgcctacaaaacagtgctgggggaggggatggaggtggaggcgcaagcagccccagtccaggctttcctcttgagacacggagaccctgagcgatgcaagaggccaatgcaagaggctggggtgggggtgggtgtgggggacaaacagggtctcagagagagagattgggagaggggaagggccaacaggctaatgggaccagaggcagggtgagagaccaaggcagagtagacttcccacagtcagaaagaggaagctagacccaaggagacagagacaggcagataggagagaaagaagagacagagacagagagacaaggagagacagaatcagggagattctggaagagggaatgactggagaggggctgagaggaagtaaattagagagctgagagccagggcaccagagaacctgggtcagcaaggatgcaggggagggggcagagatgcggaaaattgagggattagggcagaggcaagagagtggatggaggagacaagagctgagacagccaggaggactcccccccctccacaccatggtgaacacccccacccccaccccgtgtcccccacaccccccttgccgtgtggattcatgactctctttagtgccttccttacctcagtttcagtactggggctctggtgttccctacactaaaacccaggcctcctcatttccacctgctccatcccaggcc

SEQ ID NO: 1290 - DNA, 3200 bp, Mus musculus
cgggacaccgggcccgggatccccgagcccgacctcgggcgcctcgccggtcacctccccgcgcggacaccagcccggcggagtcctggagatgggagaagtcgccggaggggcggccccagggcctccccggtctggcctggtgtccatcatcatcggggcggaggatgaggattttgagaacgagctggaggcgaactcagaagatcaaaacagccagttccagagcctagagcaagtgaagcgccgccctgcccacctcatggccctcctgcagcatgtggccctgcagttcgagccaggaccactgctctgctgcctgcatgcagacatgctgagctctctgggccccaaagaagccaagaaggccttccttgacttctatcacagtttcctggagaagactgcggttctacgggtgccggtccctcccagtgtcgcttttgaacttgatcgtactcgacctgatctgatctctgaggatgtccagaggcggttcatacaagaggtggtgcagagccagcaggcagccgtgagccgtcagctagaggacttccgctccaagcggctcatgggcatgacgccctgggagcaggaactgagcctgctggagccctggattgggaaagaccgaggcaactatgaggcccgggagcggcatgttgcggagcggctgctgtcccacctggaggagacccagcataccatctctacagatgaagagaaaagtgctgctgtggtcactgccatcagcctgtatatgcgccaccttggagtccggaccaagagtggggacaagaagtcgggaaggaacttcttccggaaaaaggtgatggggaatcggaggtcagacgaacccccaaagacaaagaaagggctgagcagtatcctagatcctgcacgttggaaccggggagagccatccgctccagattgtcgacatctaaaggtcgaggctgatgagaagccaggccctgcagaccggaagggaggcctgggtatgtcttctcgggacaggactgttgggactcctggacaggacaacccaggagtctccctgcaccctctgtctacagacagcgtcgactcccgggaaccaggcgtggataccccgcaggagccaggggatacacccccacagggccctaccagcctggagcccctggcgcccccagagagcacagaggacaatggcgagactgagagccctgagcccggagatgatggggagccaggacggtcaggcctggaactggaaccagaagaacctcctgggtggagggaactcgtgcccccagacaccctgctcagtctgcccaagagccaagtgaagcggcaagaggtcatcagcgagctgctcgtgactgaggcagctcacgtgcgcatgctacgggtactgcatgacctcttctaccagcccatggcggatggaggcttcttccctctggacgagctgcagaacatcttcccgagcctggatgagctcatcgaggtgcactccctgttcctcgatcgcttgatgaagcggagacaagagagtggctacctcattgaggagatcggcgatgtgctactggcccggttcgatggtgctgagggctcatggttccagaagatctcctcccgcttctgcagccgccagtcgttcgctctagagcagctcaaagccaagcagcgcaaggagcctcggttctgtgcctttgtgcaggaagctgagagccgcccgagatgccggcgcctacagttaaaggacatgatccccactgagatgcagcgactgaccaagtacccactgctgctacagagcatcgggcagaacacagaggagtctacagaacgagggaaagtggagcttgcagctgagtgctgccgggagattctgcaccatgtcaatcaagccgtccgtgacatggaggacctgctgcggctcaaggattaccagcggcgcctggacttgactcacctacggcagagcagtgaccctatgctgagcgagttcaagaacctggacatcactaagaagaagttggtccatgaaggccccctcacgtggcgagtgaccaaagacaaagctatagaagtgcacgtgctcttgctggacgacctgctgctgctgctccagcgccaggacgagaggctgctgctcaagtcccacagccggacgctgacacctacccccgatggcaagaccatgctgcggccggtgctccggctcacctctgccatgacccgagaggtggccactgatcacaaagctttctacgtcatttttacctgggaccaggaggcccagatatatgagctggtggcacagacatcttcggaacgcaaaaactggtgtaacctcatcactgagactgctggatccctgaaggtccctgcccctgcctcccgcctcaaaccccggcccagcccaagcagcatccgagaacccctgctcagcagctctgagaatggcactggaggcgcagagatggctccagctgatgccaggacagagcggctcctcaatgacctcctgcccttctgcagaccaggcccagagggccagcttgctgccacagcccttcagaaagtactgtccctgaagcagatcctgctaagcactgaggaagacagtggagcggggcctccccgcgatggggatggggtgcctggtggtagggcccccggcccagtgcacacccaggagattgaggaaaacttgcttagcttagaggtggccatcagacaactggaggagttggaagaggaattttgtcgcctaagacccctcctgtcccagcttggggggactctgtcccccaacctggctgcacctgaacgctctgctcagacaggcctttcatgaagagaagagtgggggagaggatgcaggggggcccacccccacccccacagctgccacagcatctcacaccccagaggcctggagcagagggagattggctgaacttgatagcagacctgctcgggtccctgcctcccactctggcctctgcctttctccctcctgccttctgcttggggaactcagggcttcactcccagagcacccccttaatccccacttttcaggccgtctcagtattgcctatggggggtcaccctccttcccctaccccaagtgcctttgctatgtttttatatcctggactggaggtttatttttaatatatattatctaaggaaaaaaaaaa

SEQ ID NO: 1291 - DNA, 2760 bp, Mus musculus
atgggagaagtcgccggaggggcggccccagggcctccccggtctggcctggtgtccatcatcatcggggcggaggatgaggattttgagaacgagctggaggcgaactcagaagatcaaaacagccagttccagagcctagagcaagtgaagcgccgccctgcccacctcatggccctcctgcagcatgtggccctgcagttcgagccaggaccactgctctgctgcctgcatgcagacatgctgagctctctgggccccaaagaagccaagaaggccttccttgacttctatcacagtttcctggagaagactgcggttctacgggtgccggtccctcccagtgtcgcttttgaacttgatcgtactcgacctgatctgatctctgaggatgtccagaggcggttcatacaagaggtggtgcagagccagcaggcagccgtgagccgtcagctagaggacttccgctccaagcggctcatgggcatgacgccctgggagcaggaactgagcctgctggagccctggattgggaaagaccgaggcaactatgaggcccgggagcggcatgttgcggagcggctgctgtcccacctggaggagacccagcataccatctctacagatgaagagaaaagtgctgctgtggtcactgccatcagcctgtatatgcgccaccttggagtccggaccaagagtggggacaagaagtcgggaaggaacttcttccggaaaaaggtgatggggaatcggaggtcagacgaacccccaaagacaaagaaagggctgagcagtatcctagatcctgcacgttggaaccggggagagccatccgctccagattgtcgacatctaaaggtcgaggctgatgagaagccaggccctgcagaccggaagggaggcctgggtatgtcttctcgggacaggactgttgggactcctggacaggacaacccaggagtctccctgcaccctctgtctacagacagcgtcgactcccgggaaccaggcgtggataccccgcaggagccaggggatacacccccacagggccctaccagcctggagcccctggcgcccccagagagcacagaggacaatggcgagactgagagccctgagcccggagatgatggggagccaggacggtcaggcctggaactggaaccagaagaacctcctgggtggagggaactcgtgcccccagacaccctgctcagtctgcccaagagccaagtgaagcggcaagaggtcatcagcgagctgctcgtgactgaggcagctcacgtgcgcatgctacgggtactgcatgacctcttctaccagcccatggcggatggaggcttcttccctctggacgagctgcagaacatcttcccgagcctggatgagctcatcgaggtgcactccctgttcctcgatcgcttgatgaagcggagacaagagagtggctacctcattgaggagatcggcgatgtgctactggcccggttcgatggtgctgagggctcatggttccagaagatctcctcccgcttctgcagccgccagtcgttcgctctagagcagctcaaagccaagcagcgcaaggagcctcggttctgtgcctttgtgcaggaagctgagagccgcccgagatgccggcgcctacagttaaaggacatgatccccactgagatgcagcgactgaccaagtacccactgctgctacagagcatcgggcagaacacagaggagtctacagaacgagggaaagtggagcttgcagctgagtgctgccgggagattctgcaccatgtcaatcaagccgtccgtgacatggaggacctgctgcggctcaaggattaccagcggcgcctggacttgactcacctacggcagagcagtgaccctatgctgagcgagttcaagaacctggacatcactaagaagaagttggtccatgaaggccccctcacgtggcgagtgaccaaagacaaagctatagaagtgcacgtgctcttgctggacgacctgctgctgctgctccagcgccaggacgagaggctgctgctcaagtcccacagccggacgctgacacctacccccgatggcaagaccatgctgcggccggtgctccggctcacctctgccatgacccgagaggtggccactgatcacaaagctttctacgtcatttttacctgggaccaggaggcccagatatatgagctggtggcacagacatcttcggaacgcaaaaactggtgtaacctcatcactgagactgctggatccctgaaggtccctgcccctgcctcccgcctcaaaccccggcccagcccaagcagcatccgagaacccctgctcagcagctctgagaatggcactggaggcgcagagatggctccagctgatgccaggacagagcggctcctcaatgacctcctgcccttctgcagaccaggcccagagggccagcttgctgccacagcccttcagaaagtactgtccctgaagcagatcctgctaagcactgaggaagacagtggagcggggcctccccgcgatggggatggggtgcctggtggtagggcccccggcccagtgcacacccaggagattgaggaaaacttgcttagcttagaggtggccatcagacaactggaggagttggaagaggaattttgtcgcctaagacccctcctgtcccagcttggggggactctgtcccccaacctggctgcacctgaacgctctgctcagacaggcctttcatga

SEQ ID NO: 1292 - DNA, 44075 bp, Homo sapiens
  misc_feature (23457)..(23689): "n" at positions 23457 thru 23689  can be any base
  misc_feature (39458)..(44075): "n" at positions 39458 thru 44075  can be any base
tgcgcttcccaggtaggaagcaaggtctaggtgtcccgagcaggcctgcaatcccgcagccgcgccgctccagccactggggagcagtagagggcctagaaagaagctcagccaccgaaggctcttgaaggtgaattcctagggcttccaggtctggagccaggcttattcctgggagggggttgtaacggggaattgaagtgcagaggggctagtgaccccagcagaacacctggggtcctggttcccagggctacagaactgtcctagatactgtgccaaatgcactgcagaatattcttgcagtcttatcaagtggggggtttgtacccatgttataggagaaaaaactgagtttcagatgaccagtcagttggcagagctgagttgtaaaagaatcctggactcttgaggcccaggctcttctgcgtggatgggaattgcccttttcccatctcctgggttcacgccattctgcctcagcctccccagcagctgggactacaggcacacgccgccatgcccggctaatttttgtatttttagtagagacggggtttcactgtgttagccaggatggttttgatctcctgaccttctgatccgcccgcctcagcctcccaaagtgttgggattacaggcgtgagccaccgcgcccagctggcaattgcacttttttaaaattctgcactctaggaggcagaggtgggcagatcacttgaggtcaagagtttgagaccttggcctggagtggtggctcacacctgtaatcccaacacttggagaggccgaggcaggtggatcacctgaggtcagaagttcgagaccagcctggccaacatgatggaaccctgtctctactaaaaaatacaaaaattagctggacgtggaggcaggagaatcgcttgaatgcaggaagtggaggtcacagtgagccaagattgcaccattgtactccagtctgggcgacaagagtgaaacaccgtctcaaaaaaaaaaaaaaaaaagagtttgagaccagcctggccaacatggtgaaaccctgtgtctatgaaaaaaaaaattggctgggcatggtggtgcacacctgtaattccagctacttgggaggctgagacaggagaacagcttgaacccaggaggcggaggctgcagtgagccaagattgtgccgccactgcacttcagcctgggcaacagagcaagactccatctcaaaaaaaaaaatctgaaatacttcaggcatgcaagtatttagcattcagtattcataatgtaagaaaaacctatgaagcacaacccagtttaagtaacacaggcagggcagggtgcagtgcctataatcccagcacttcgggaggccaagctgggagaatcacttgaggtcaggacttccaggccagcctgggcaacacagtgagaccctgtctttacaaaaaatttaaaaaataggcccagtgcggtggatcatgcctgtaatcccagcactttgggaggccgaggcgagtggatcatcaggtcaggagattgagaccatcctggctaacacggtgaaaccccatctctactaaaaaaatacaaaaaattagccggtcatggtggcatctgcttgtagtcccagctactcaggaggctgaggcaggagaatcacttgaacccgggaggcggaggttgcagtgagccaagatcacaccatcgcactccagcctgggctacacagcgagactctgtctcaaaagaaaaaaaaaattaaaaatagccaggcatggtgtgtgcacctgtaatcccagctacttgggaagctgaggcaagagaatcacttgagcccaggagtttgacgttatgattatgccactggacaccagccttggtgacagagagaggccctatctctaaaaaagaaaaaaaaaaaagtggccagccacggtggctcccgcctgtaatcccagcactttgggaggctgaggtgggtggattacctgaggtcaggagtgtgagaccagcctgcccaacatggtgaaacctggtctctactaaaaatacaaaaatatagccaggcatggtggtggccgcctgtaatcccagctactgaggaggctgaggcaggagaatcacttgaacctgggaggcagaggttgcagtgagccaagatcacgccactgcacttcagcctgggtgacaaagcgagactccgtctcaaaaaaaaaaaaaaaaaaagtaacacaggaaataaaaccaagacaagatgagctctctgtgtctctgtgtgtccctccccagacccaaccctggcgtcccccagaggtaacccctcccaggaactgggcgtttgccactcccctgcacgggtctacacctctgctacaaacgtgtgtccctaagcagcggacgccttttgaaaacaagtcaactgtatcatgctacgatattttttctgatgtttgtgctgtttctgagacagccttatgacaccttcccctattctgtagcattctgttggctcactttgccacagtgtatgcacccattctcccacaaatggacttttcatttgcttctcaatgtttgctaccaaaaatctccctgcaataaatttattttatatatccccttgtatgtgtgtgagggtcccctaactgctcacaaatatctcagcaactccgccctccccactcagacctcatttccctcctaccagacatgctcaaaggaaactgggagcaacacaaagatgactttgaatctctgtccaccacccctagactgtatgacacccgcaagtgacaacctcccctctctggcctcggtttccccctctgtaaaatgggggatggcctaccttgccagtcatggcaggtcaatataaaacaacttctggctgtgcacagtggcacatgcctgtaatcccagcactttgggaagctgaggcaggaggattgcttgaggccaggagttcaagaccagcctgggcaatatagcaagatcccatccctcttaaaaaaaaaaaagaagaaaaatatatgttgttgttgttattattgttattattagagacagagtttcgcttttgtcacccaggctggagtgcaatggtgtgatctcagctcactgcaacctccacctcctgggttcaactgattctcctgcctcagcctcctgagtagctggaataataggcatgtgccacaacatctggctaattttgtatttttagtagagatggggtttcgccatgttggccaggctggtctcaaactcgacctcaggtgattctcctgtctcagcctcccaaagggctgggattacaggcataagccaccatagctggcctgtttttttaaaaaaagaattccagtaaagagctgatcatggttctcactccttgaataccaggaacaccatctcgtatcacataatgagacagggagacattctggtcctcatctcacagatgaaaaatgtcaagcttcgaaggatcaaagtgcccacctagtcacacgggtagtcagccacaggtcagcctgccttatttattcttcatgagtatttatagtgactaacatttactgggcgcctactgtgggccatttctgtgcatgtgacaacccctttaagtccttgtttctaatcccaagaagcaaggaaatggggtcagggaagggacaaggtttgcccaagtccaggcagggggagaggtcaagctcagaaccatcacctgcccatgacacatgcccaggactcaggttccctaggcttccttccaaaggctcagcagtgacgagccagcccttgaaccagcctcttcccccacccaagcagccacctctcaggggaattgtggccaccacaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggtatgtggccaaagggcaggaactggcgggaggtgggggaagctgtggaggctgcagagagggcacaggcagagggaagggggctcagggaaaggggaagaggaggcagaggataggggacccagggaagatgcctatagaaatcgtatctgtgccaagatgggccaaggtggggctggagggagcccagcgaaggagaaggggcgtccacagtctcacacagggaggcaggagcaagagtcacctcccccacctcctgttccccacaggccaaaataaggaactaaagttgctcttgactgagcaccagggctgggggcaggaaggggacttaggggtagcagcattcagcgtctgtcaaggggagaaaaagctttctctgccttaaacctcaggtgcctctctctgttgggagtcccttctcagcactgggggaatgggtgtctcatggactccccctcacctgctcaaggacagctggcaggggctgtggccacgctaacccaggagttcagagaaaaaggttccccacccaaggggacactgggagcaaggattggagttcacgtctgagtcttaagcccgtgacgatgagggtgctcggcccctctccccatctcttcctccttctctcttcctcacctccctcctccacctacctccagaagaggggactggccatgtgggaggcctggctgagagctggggcttcccagaggagcccggattggacactgcagccagcctgagccgcctcgtctcactcagagacacccccagtctccaccccgctctgagccccttcaatcaccagcagcccagcccaaggactgaactcacccctgacccctaggttgacacatacaacttacagagaatgagggccaggcacagggtcacaggccagggcaggccacagactggctcctcagcccaggcagggagaggccagggagccaagagtttgaacccagtgccactcctgactgcctggtgatgctggcaacccgcctgccctcccagagcctcagccatccctcctgtaaaatggggctaaggagagaacctacttctagggttctgtgaatgattacacaagaaaaagcgccaggtgctgggcctggctgaggctggggtgcaaaaatggaccgggaaggctgcgggaggaggggacgcctgcactgcttctggaaggagctgtctggacagcggtcctccagtgcctggaacaaacatccaaaatccagagagttcacagggccagagtacaaagtgggtatgcgggaggggggcaagagatggcgctgcagaggtgagaagggcctcccaggggtcttaccatcccagggagtctcattctcctctcccaggatatcctcacccaccccaaccaggtatgtcctctctccttcccaggggcttcttcactttcccgcatcccccctctccccaggatgtatcagcccctgtcaggggctctctctctccctccccacccaggagagtcctcaccctcttcccaggagtgctggaactgcaggggccagggctggggaaatgtgtcaccatccccagtccctgacccacccaccctgtctctccacaggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccgtgagtggcccagccctggcccctactcccactgtcccgctggggacactcggtttatctttgaagtggggatagagccagtaccttcaatgtgggtttcaaaccggcttggacagagggacggacattctcctctgcagagtggggtctctggggggtctggggccttgcaggaggtgggcggggccaggaggctagggagggcaagaggggccagggctctgagccatactacctccttgcagagccgccccccaggcccttcctggacatgggggagggcaccaagaaccgaatcatcacagccgaggggatcatcctcctgttctgcgcggtggtgcctgggacgctgctgctgttcagggtgagccccctcggacctctgagtcagccgggcgagggcctgggccgagggacccccaatacccaggtagccctctagagcctgaggttccccatccaaaacttgggagaatgaaagcacccaccatataggggctgtgggagttaaatgaatgaatataaagaagggacttgaactggcgctgagcccagggggtgtcttcaatttagtttccccttctgggctgtcctcacgtccacctccccccaagaagagtctcattcttctccctaagagtgtcctcactcccctcctgccctcacccaggagtgtggttaccctccaggtgtagccaagaccagggaaggtggggcctggtcctcccagaatctctgatctgtaccagcctctccttaggcactacagaaagtgtgactgttattgttattattcatggagaatagtaagggagtggagactcaagaagacgctagcttgggaggccgaggcaagaggatcacttgaggccacaagtttgagaccagcctgggcaacacagcaagaccctatctctacacacacaaagtcttaaaaaaaaattagccaggcatggtggcacacacctatagtcccagctactcaggaggctgaggtgggaggattgcttgagcccaggagttcaaggctgcagtgaaatatgatgttgccacagcacttcagcctgggcaactgagggagaagaaagagagagagagagaaagagagagagagagagagagagagagagagggcgagagggagggagggaaggaagggaagggaagggaaggaaggaaggaaggaaggaaggaaggaaggaaggaaggaaggagaacactggttgtagactcagagagaactgttacataaccagtatgtggccttggggacatctcttaccctttctggaaaagtacttcctggcatccaggagggtctgaaagatattcacctccccctgctcactgaggcacccaccccacccacccctacagaaacgatggcagaacgagaagctcgggttggatgccggggatgaatatgaagatgaaaacctttatgaagtgagtgaagggtggggatggggtaggggcagttgtgttaggggtgggggtgttccctctgggggtggctgggggcagggaccccaggtgtcagggtgctgatgttcgctgcctcatttccatcccagggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgcagaccttggcaggagtcgtggatcttacggaaaccgcctctcccacatgtccctcagacccaggagtcccagcccaagccactccctgcccactccccacacctgggaccaggtagccagtctgggctgccctcctgggagaacaagatgtctcttgggaaggtccccagaccaactgaaggactggtttggccctctttgcagggcctcaccctagggtcatatccttaagcaagaaggggacaagatcaagatggctgtggctaccaaattacttacacttttttttttttttttttttttgagacagagtctcactctgttgcccaggttggagtgctcactgcaacctctgcctcctgggttcaagcgattctcctgcctcagcctcccaagtagctgggattacaggcgcctgccaccatgcccagctaatttttgtatttttagtagaggcggggtttcaccatgttggccagactggtcttgaacctctgacctcaggtgatccacctaccttggcctcccaaagtgctgggattacaggcgcctgccaccacgcccggccgctttttttttttttttttttttttttgaggcagagtctgactctgtcgcccaggctggagtgcagtggcgcaatctcagcccacttcaacctccacctcaagcgattcttgtacctcaggctcccgagtagctgggatgacaggcatgtgctaccacacccagctaatttttgttttagtagagacagggtttcgccatgttggccgggctggtctcgaactcctgacctcaagtgatccaccatgcttcggcctcccaaagtgctgggattacaggcatgagccactttatgcgtatttaagccttggaaacacagggactatcttgtggattggggctagtacagaattcagactgcagccttttcccgatgcgttgacttacagaaggggcattttggagggtctgtggtcctaacctggggatagcagggagatcccggggcaatgacagagaggcacagagacacggatttcctgagaaagggagaggagagaggctgagacccagggatcatgaaggggacgagcaagggaaggaagagatgatgagaccctgggaatccgggagagagacagggacgtggagagaaagggacagagagagagcgagaaggaaaggaagagacagaagggagaaggggcaaccgaaaatgggcacgaagaggcccaggcacagcaacagctggggaaatgacagagactgagacggagatgcagaaagatacagagagagctggagagggtagagaagggctttcggggagaaagtgatggagggacagagaggagaggtggaggccaaggagggaaagaccccagtagagaaagacagagggacagagaaggggatgcagacgcaggcgggagcacacccacagaggcgaaggaagggcgcaagaccatgagaaccacagacgcggaaagccggggaggtcgtggctcggtctagggcgcacggggagcagggcttgccccccagcacctccggggaggtgaccccagccgggagatgcgagtcccgcggagcccgcgcccggcggacggaccgatggacaaagccggggagagctcgggcgcggccggggcgggggccggtgcccgcagggacccgggcgcagcggggaaaggaggggcgggcaagcggcgagaaggggaaggaagcggaggtgccgggcgggcgcggggcgcgggcaggaagcggggaggggcggcggggcgggggcctccggaaaaacgccccgacttcctgccccgccagagccaggaagcgggagccgggacccagggcccgggatcgccgagcccgacctcgggcgccccgccggtcacctccgcgcggacaccaggtactcggtccccggccccgcccggcctcctcccctcggctgttgggggaagtggggaggaggagggaggggctggggcgctgccggcagcggaggggcccccttcggaccccacggaaccagcggccgcccctccttgggcctcagttttcccatctgtcaaagggagcaaagaggggagaactcacacttgacgagtgccccataggtggggacgaacggtgcgaggccggggccaaggcctcccacctgctcagtggagaacggacgatcactaccattgtacgggtggggaaaccgaggcccggggagccaaaccgactcgtcccagggaacgcacatcgtgagaaagtgtggagttgggatttgaactcgcacgtgctttccgcaaagcgccatcctccaacccccgcatgctttagggccacctaaaaatgaaaaacaacaataacaacaacgacgagggtcgctgtgaagctgaaagttgcagagtgcatttgaaagagttttcggaaagctcttttctaggtcattaattataccgtgagagacaggtgtagggagagagctggaggccttctcccattgtacggatgggaagactgaggtctacagagaagtcattactttttgcagattacactgcatgtcagagggaaagttgtgctggaactcaagactattgcttttccggttccaaaggaaggggctgggggtgggagacggaggggattgatgtacgaggattggaaattcagcgggtcccctaagtggggagactaataggacggggagccccagtccgccgtccgagtgctcagcgctggggtgactaggagatctccgatcgaactcgggaggagttggacccatctgcacctccgggcgcggggcggggcccggggagtgacgggggcagtcgagatacggaaacgctggccctccaagacaggccagagcggccctatctggcctgcgtggcgcagtacagcgctagagcggccggcgggaggagtagagtcgtcggggccggagcccggcaggagccgggctagagcggctggcaggaggagtggagctgggcgcaaaggtggactcagggcggctagagcgacgcggcggcaggggtggggagagtgcggagcccgagcgcggaggcttcggttccggtggcggcgatggcttctctttccacctggagcaggtgagggacgcggtccccagcgggtgtcagaccctgactctgcacgtcctccccggcatccctggccgtgcacactgccacgtcccccgtaggatttagggcccgcgtaagacccgccacgtccatgtaagatttgggtctcgtgtagacccgcctcattccgtataaagtcttacagaccctccaggttcctgccagccccccatggagaactggcttcttatagacgtggggtcctcatagaccagtggcatcccctagaatccggggctctatagaccatgggtctcgggacccaccacgcacccctatggaattctgagtcccttttaagtctccagaggttccacagactggcagctgtccctatagaatcatgatcctgtatgatccctggatcctttagacccactgtgtgtcaaatagaatctggggagttacacattccaacgactcttttaggttctttaaggctccagaagttcttggagaccctgagtcacctgctcaacacattatagaccctgagacctccatagaactcaacacccatgtggccccccaacccatggaccttctaaaccagccctaaccccccagcgccccatgcacgcagtgttccctctgctggaccccccaggccttgtcagttgcctatagatccatctattctctgacagcttcacctataattctccagcctttgtgggactcccccaaacccctcctcctaaacaggcgacactcctcgcctccatcatctccaacccccaagcctctgtggagcagccgtatccaacttgcactcctgcctaggccatagtgaccacatacccgtgacttttccaggcatccataagaagacatgatgtgtctcagagctttggttcagattttagtttctgaagggtagggtgggggctccccatgctctgaagcaatgctctctgttttattttgttttatttatttatttatttatttttgagacgaagtctcacttctgttaccaggctggagtgcagtggcgcgatctcagctcactgcaacctccgcctcccggattcaagcgattctcctgcctcagcctcccgagtagctgggactacaggctcgtgccaccacgcccagctaattttggtatttttagtagagacagggtttcactatgttggccaggatggtgtcgatctcttgacttcgtgatccgcccgccttggtctcccaaagtgctgggattacaggcgagagccaccgtgcctagcctattttattttaagacaaggtctcactctgtcgcccaggctggagggcagtggcacaattttggctcactgcaacctctgcctcctgggctcaggcgatcctctcatcttagcctcccaagtagctatgactacaggcatgaaccaccacacctggctatcttttgtagagatgggggtttcaccatgttagccaggctggtctcgaactcctgagctcaagtgatccacctgccttggtctcccaaagtgctgggattacaggtgtgagccactgtgtccaccaaatgcagtttattttaaatgcgtaaactctgtagcccaactgcccaggtctgagtcctggttctgcctcttatgagctgtgcctcagtttccttctttgttaaatggaggtgagaataataatgatctcttggagtcaccgagaggattaaatgagttattacctgtcaaccagcgatgccatgcctggcacatactaagtgtctcttttgtgtcagctgtcatttcattattattgtgataaggaataaggagataagaacttggcaagtgcacagttccagacctggcaccaagcacttgcaaagataatgagtatcccctcctttgcctttttaaaatttccctgcctcagttgagcgtttctacctctgagtgggatgagcatgcaccctccacgtccgtggtcatgtttcatagtgagacagggtctcactgtgttccccaggctggtctcaaactcctgagctcaagcgatcttcccaccttggcctcccaaagtgctggggttacaggcatgaaccacctcacctggccagtttgcaaatttattaaagtgaatgtttaacagtacttgaatcttgaattgcccaagcttagatattggacaatacactttgtgggaaataataaaaatgatgccttccccaggtggacccacagggtggcatttggacactccagaaagcatcattgtttaatcatcaaaatcctggttaccatttactggggagctagggaggaggcccataaagcaggagaagggcgggtctctgctggcttgggttataaatagctttgggctgtggggagccccgccgctggtccaccccacccctctttccacagctccttcccacctgacacgggctccgtggcattagtcagactaattaaggacacagaagatgtcggtggaaagactcagagagaagtggagactcaaggagagacaaagatgggagagacagcaagagatgggggagaaaaagggatggagagatgagagacagcacatgagactgtgactcagagaggtgtgaggatggtggctgcagaaaccagatgtgggaggacagaggcacagagacagggacaggacagacggagctacagaagcaggaagggggtgtcaccgctgagagggagagatggagggaggagaggcagggatggtggggaaaatgagacagttctggaggaagggaaagagaaaaatcaggaaacagggtgaaaagagaccaagacatgagacagattcaagggacagacagccaaggagagctggctgcggacagaccaaggcgcacgtagggtggaggggacagacgcaccttggagatgggctgtctgaggccccatcacttggtttctgggactggaagcctgggaagagatgaggtccctgggggaaagaagaacttctgggtttggggactcccagtccctgagggaggagggttctgagttttgttttcttatgtggagagttgggggttgggggtttgccattgtgacttcctgtcacaggaagtggggctggtgggttccaaggcaacatcctgtcccaggcctgtcacagaccagaggagacccctgcaccccacttctctcccgcctctcctctaaccctcccatcccctcttgcctctgggctgtgccctcaggaattagcccccaggcccctggtccctccaacctgggagtccaggcccccagccccctcttccattagggcattagggaccccagattgcaggctgtcagactcagccttcccatggacccaggctcctgagcctccaacgcctgcccccgcaaggctcccgtccctgggctcccgccccctggcgggtctctgaagggctctttgtggccacacagaggccccattgagctgcggaggctgggatgggggaggctgtttactcaccttcacacctgggccaggaatctgtgagtaaccaccctgggccgcctcctcccaccctcctaaccacagcccctcctcttcctccagccctgcagagcccagggagatggaagacttcgcccgaggggcggtgagtggacagagcaaggggtgaggcgactctggggctgtgggtggagagtcctgtggactgaagctgccctccctttccacaggcctccccaggcccctcccggcctggcctggttcccgtcagcatcatcggggctgaggatgaggattttgagaacgagctggagacagtgagtgggagatagggtggaaaagctctgtcccaggctcagtgtcccgccccaggtcccctcccacctgcagatgctgtcttcttggccttttcccacggtctgtctcatcctctcatctccctggtacctccttcctcacctcgccgaccccacacagcagcatagacgcccacccttcttactcttaaccccatttcttatcgttgctctctcctcccccagcatggaccccaatttcttctctcctaatttctgtcctcatcatccaccattataatattaagtctcatccattctccctgaacacctgcccttgctgtcaccatcattttttggacactgtcaccactccccacttcccaggagctaaccctggcttggatcccttgtgaagtgccaggaatgggtagggtcaaccctaaggcccctcctcttctccccattgtactcaccccttcctgcacccccagaactcagaagagcaaaacagccagttccagagcctggagcaggtgaagcggcgcccagcccacctcatggccctcctgcagcacgtggccctgcagtttgagccaggacccctggtgagggcagggctgggtgggcacagggaggggtggggctgggacaggcacagcttttagcgaattaaaccagcgagctagtgcctggagggtctggaaaagcagatctagaacacagagagccagatctagaaagagagaatgctttagacaagagccagaaagcatgccacgtgacctcaacaggcttacaagtgcccagggtagatctcagtgcgcagcgggcagggtacacacgtcaggaccccgcggagccacagagagtccagcagcctggcagaaaccacatcccatcccactctgtgcctgtggcagcgcccccatcagcctgtggcagcacctttccgtgaactctaggggaccaaattcttctctccaaagcctttttggcagatgccagcacgcagtcattcacggttgatggttgggaaaaagaagctgttagccatcccaggtctagggagcacagcaggccctgatctggaaacaagaaaaccaccacacacagctcacaaggcagaccacacaattgtggatccagaagcctccggatgaggcagaagatacctgggagatgtggatggacaaccgtgccatccagaaacacccgcagagtctagaaaacccagcaggtgatttagaaagggagaggccacagtgctggctggcaggggatctgtagacaagggtctcatcccaagaagaccccgtccagcccagcacaggataggaggacagcctggggacagccagggcactgcaccatgtggacatgcatagtggacccctccagaaaacaaggaaaccgatagagtggggagaagtgcccgaggcatgcagaaagaagaacatgtcagctgcaagaccagaggctggtcatccggacgccaaaccatcagatatgcagaaaattaggaaattgcagtctttcccctgtctacattctctttccagaagagtggttcccccgacaaccacatgcacggagactctggccctctgagcaagggagtcccctattcaagccttggggtttctagaacaccagattgtggacatcagcccagggatcgtgctgactaccatgttcttttacagatgtggaaaccgaggcctagagagggtcagggacttgcctgaggtgaccccggcggcctctgggcattttgaggtttattctcgcatagctccctcacctcatcagcttgtggggagccgatcagagatagctgtggtcccctgggcagcttcctgttggcctgtcttagaattttgctatatttggggggtgtgaagagtggatatagatgtgttaaaactgtttaaagtggagaaggaggaccgggcctggtggttcatgactgtagtcccaacgctttgggaggctgaggcaggaggatagcttgagcctgggaggttgaggctgcagtgattgcaccactgcactccagcctgggcgacaagagtgaaaccctgtcttgaaaaaaaaaaaaaagtggggccgggcatggtggctcacacctataatcccagaactttggaggctgaggtgggtagatcacttgagatcaagagttcgagaccagcgtggccaacatggtaaaaccccgtctctactaaaaatatgaaaattggccaggcgcagtgactcacgcatataatcccagcactttgggaggctgaggcaggtggatcacccgacgtcaggagttcaagaccagcctggccaacatggtgaaatcccatctctactaaaatagaaaaattagccaggcacagtggtacacacctgtaattccagctactcgggaggctgaggcaggagactcacttgaacctgggaggtggtggttgcaatgagccgagattgcaccattgcactccagcctaggcggaaaaaaaaaaaaaaaattagccaggcctggtggtaggcacctgtaatccaagctactccagaggctgaggcaggagaatcgcttgaacccaggaggaggttgcagtgagccgagatcacgccactgcactccagcctgggtgacagagcgagactccatctcaaaaaagaaaaaggagaaaaagtcccactcccattggagtgagttcatttcccagatgagagcccccaggagccaggacaggttggagtccccactgtcacccagaacaggggcgggcactcaggaaatgcttgacgaatgacagagtgagccccacttgtccacctgttctttccaagccctcagtatgcacaaggcaccaccatctgggacacagatggatcaacctacaacacccctcaacacacacaaacccttaagctgctcacagtctttccaggcagtggagtgtagtagagacaggctgcctggattcgaatcctaactttgccacttagtagctatgtgattttgggttttatttatttatttatttatgaaacagtctcgctctgtgtcacccaggctggagtgcagtggcacaatctccactcactgcaacctccatctcctgggttcaagcagttctccctgcctcagcctcccgagtagctgggatcacaggtgcccaccaccacacccgactaatttttttatttttagtagagacagggtttcgccatgttggcctggccggtcacaaattcctgacctcatgtgatccacctgccttggcctcccaaagtgctgggattacaggtgtgagccactgtgcctagcctagttgtgcgactaagcttgactaaacttcttgagctccgttttctcatctgtaaaatggggataatgacggtccctatgattgaacacgttaatgcatgtagagggtgtagagccgtgtctggtatacactaagccgtcagtatagacagtagtagtagttgttgtcattattgccgggaggagaccatgatgaagaaccacaaaggaccatagcacaggatggaaaattagaaaatgctcatggcagccccagggagcctgcaggggaacccagggcctggctttaggggtggaggtcagggagtgcttcccagaggaagtggcagttgagtcccacagccataggatggccaggaggtgaggaaggcccttttcaaagggagagtgtggtttgaggcagggtgagggagcggagagtcatgctgtgtgtctcccccagctttgctgtctgcatgccgacatgctgggctcactgggccccaaggaggccaagaaggccttcctggacttctaccacagcttcctggagaagacagcggtgagagaccttcaagctgccccaaccctgcaatccctgtttgggcctgcagagtcaccatgcggtccccagcctctgccctgagggcagctgctgacccaggccttccccagcaccctcgcttagaccagggttcctggcagtcctcccggcctgcatctcagcacaccaagtcctcctcttcaccccattctctctcttgagcaggttctccgggtgccggtccctcccaacgtcgcctttgaacttggtaaggagaaggatgggatgagggagaggtgtctagcggggaccacacctcccaggaggccaaggggagggaggccgcactcccatgctctgctcggacagccgagattcattcattccttcttggcagcggcctcaggacgtgtggctgttggagtccaagggtgggtggggaccgtggtccaagccaccagggagctggaccctagcccccatgtgtgtccctgcagaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcagtgagtaggccagccctggtgggagcgtcgcccctccccagcacaagggcacccgtgctacctctggcatgttccatcccgtttgcaggttccctcttcagggtcagagttcatttcttggcactgggggtcttcctctaccctggtgttttaactcaccttgaatccgagtcttccctttccagctttggggttcccttgtcatttctgggtcttgtccatgatctggcacttggatcccatcctcctggatgagagacctccctccctcttatgacagtccttcccaatcccttccacagtgtcccctctctgtctctcttccccctgcctatcccaggacagcaaccctgagatgtatcctgggtggatggggaccccaggcctagcaaatatgtcacaaacatctctcttcctcctacagacataccatctctaccgacgaagaaaagaggtgaggggggcaggggaggcgtgcggcctcctgggtttgagggaggagggggctgagggcctggactcctgggtctgagggaggaggaggctggggggcctggacgcctgggtctgagggaggagggggctggggggcctagacgcctgggtctgagggaggagggggctggggggcctggacgcctgggtctgagggaggagggggctggggggcctggacgcctgggtctgagggaggagggggctggggtcctggacgcctgggtctgagggaggagggggctgggggcctggacgcctgggtctgagggaggagggggctgggggcctggactcctgggtctgagggaggaggaggctgggggcctggactcctgggtctgagggaggaaggggctggggggcctggacgtctgggtctgagggaggagggggctggggggcctggactcctgggtctgagggaggagggggctggggggtctggactcctgggtctgagggaggaggagcctggggcctggacacttgggtcctgggcattgggtaacagcccttgcccctgtccttttgaaccctctcatctctcctcagagtctcacaggaagtagttgtggggtcaggatgggaaggccgggcctctgcctctagggggagagagagagagtgtgtgtgtgagtgtgtgtgtgtgtgtgtgtgtgtgtgtgtgtgtgtctttgtgtgtgttgagccctcactgtcccttccctacagtgctgccgtggtcaacgccattggcctgtacatgcgccaccttggggtgcggaccaagagtggagacaagaagtcggggaggaacttcttccggaaaaaggtgcttccctcagtgccccgtcctgaccctttcctctccagagacgccctgggagcctcatgactctggatacctagcgtcaaattctgctttgttgttgtctcagagatgcttagcctggtcttcctccccgccctctcacaggtgatggggaaccggcggtcggacgagcctgccaagaccaagaaggggctgagcagcatcctggatgccgcccgctggaaccggggagagccccagggtaaggcggctctggcctctgccctcccctgtcttccccagctgctcccactcactgtctcattctctctcgtttcagttccagattttcgacacctcaaagcagaggttgatggtaatgtacctgtagccatagcatccatactgggggcctgtgtgggagaggctaggacctggacgcctgggtctgagggaggaggggctgggacctggacgcctggttctgagggaggaggggatgggggcctggacacctgggtctgagggaggaggggctgggggagctcctgggtctgagggaggaagggctgggcctggacccctgggtctgagggaggagggactgggcctggacccctggctctgagggaggaggggctgggggagctcctgggtctgagggagggaggcctggggcctggacccctgggtccgaggtaggagggattgggcctggacccctgggtctgagggaggagcggctcagactcggactcttaggtctgaggaggaagggctgggcctagacccctgggtctgagggaggaggggctgggggagttcctgggtctgagggaggaaggcctggggcctggacctctgggtctgagggaggaggggctgggggcctggactcctgtgtctgagggaggaggggttgagggctcctgggtctgagggaggaaggggctccttgtcatggtggggaagggcctgagcacagcctcttgcatcccctggcggttgtggatttgagttactgttctcttatctccctctttctccctcactgtctccccagccgagaagccaggtgctacagaccggaagggaggcgtggggatgccctctcgggaccggaatatcggggctcctgggcaggacacccctggagtctctctgcaccctctgtccctggacagcccagaccgggaaccaggtgagagtttcctgggccagggctccatgaggcccggcgatccagggtgggggtgctgcctgcccccttggcacccccagatagaagccattccccagcaacacctcccctttgctctcagcatccacttctccctgctcctggtcaccactgtcattcataactttccccttccctcagtttgccctttccacagctttgctcccaggctctgacctctctgctggtgctgcgtctcccacccccttggactacgttttccatcaacccttccttttccagaaccttccctgagtacatgaccagtccaccctctgagctgcattgctggccccctaggtggggagcccgccagccccatgagcttcatccctcaccatccttacactgctgtggcctcaggcccttggatctctgcatggccaggccagggctcacacaccagctctgctgactgcttgtgtttatttagtatcttggatatgactcccctttcttagcctccgtttgcttttctctaaaggagtatgagagggtggggaggatgaatggacgtggaggcagcacagaatccagggccctcccgacctcagggggctgcagtctggttgggtgggagagatgtttgtgacctatttgctaggcctggggtccccatccacccaggacacacaggggcacccacttctgttgcatcttcatgctcctgcccctagtggccatgttctgagaggtcttaacatctgtccgtcccgtgctgaagtacagagcagccatgtggtgtctgccaggcactgggtagctttagcccccgcaattccaggcccccagagtgtgggtctcgtggccgcagaggccttccagccagccctgctccctccaccccacaggtgctgacgcccccctggagctgggggactcatccccgcagggcccaatgagcctggagtccttggcgcccccagagagtaccgacgagggggccgaaaccgagaggtgcccaggctggggtgcaggggcgggaggtgtggcttactgggcgctggtgggtgggtgcagggtcaccgctgccatctgtgcctgcctgtcccaggctcttgctccccatgctcctctgctgctctctgggtctggccattcctctcccttcttctttccttttctcatctccctcctgcttcctcattgcccccctttccttttatccttcctttttcctctgctccttcctctccttccttttttcactaatccttctcctcctcccttcctctccaccactccttccatctccttttatttccccctcctctctcacctcccctctcctctctcacctcccccctcctctctcacctcccccctcctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccttctctttcaagcccccctgccccctgccccccaccccccgcctcgctcctgcctcctggtgcccgtccctcaaccccccacccctctgctctgtgccctgggggccctgtcccccttacagctggggggcaggctctgcctcctgcccgtccttgtgccgctgctttggggaccctttggtgggtgcggggaggtgggtcaggttccatctgggcccacctctgaccctgtgcccctctctccccagaaggtggaagaggtgggtgcctgggccctgggtgggggaagggctagcccctcccccatttgctcccagcccctcccctctccccatggccactccctccccttcactccctgtgaggggtgggtggggacatcaccctcccagttgaagagctaagtatggaaatcctccccaccccataacaccccctctgttgccatccccctgcctcagggaagggagggggtcagtcctatgctccatcctgggttccccatcccttcccccatcaaatttcagtatcccccctcccccaagaccccccactaccccagtgcccctaaaatcccaccactcctctgactctctcctctcttctgttgcatgtttgatccctgtcctggtcacccttgccccggtcctggtctctccctgtctctgtccctgtcctggtctctccccgtctctgtccctgtcctcgtctctccccaatttctgtccctgccctggcctctccccacctctgtccctgccctggtctctccccgtctctgtccctgtcctggtttctcttcgtctctgttcttgtcttggtctctccttgtctctgtccccggcatctgcctgactctgtccttggcctcggggtccaggctatcagggcgtctggggcgctcagagagcctgcgggtgagtgaccgccgccggccttcccggggcagcctcggggctaagggccggggtgggggccgctcccggagcgacgtggacatggaccccagttccgccacggcagtgcttggccctgcccgacgagccacgtatgtcaaccctctcccttcccccatccactaaggcagcctggagaatcagggagggattgttgtcagagtcacagaggaatgggcgttggagaccgaggtcattgaggccaactgtggtcacagaccttggaggaggagggggtagaatgcttctagagatctgggaactctagtgtggtccgatctagagacctggtctgctgcacgggccaccctgcgggcatcgaatgccaaggccactgaccggggttgaacgctctaagaggctgaaggctgcttcttgggatggcccaagctggggccctaacaaggcctctgtccacagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcggtgagtactgcccccatcaccccactgtggccaaggacacagtccagctctggcaaaggcaaagacaggcgcagagagatgttcatcttggtgtcatttaccatcgggagaacttgaaggcagcttcaaattccctcttgttccaagttcagattgtttcaacacagagcattttgatggaatgtgaatgccactgtggaagggacatttccaaacatttctagtagtgcaatacagtgctgatgttgagaacactgcatttctggtgcaagcttttatttccttgcttgtgaaatgtgggcattaatagttcctacctcagatattgtcatgaagatgagatgatttgtgtgaaatgtttagcatagtgctgggcacagaggaagagcattttattttatttatttttttaaatttttatttgaggcagagtctcagttggtctctcaggctggagtgcagtggcacaatcacggctcactgcagccttaccctcccaggctcaactgatcctcccacctcagcctcccgagtagctgaacaggcatgtaccaccatgcctggctaatttttgtattctttgtagagatggggtttcgccatgttggccaggctggtctcgaacccttgggctcaagtgatcctcctacctcagcctcccaaagtcttgggattacaagtgtgagccaccaggcccagtcaaggaagagcattttaatgagattgttgttactagtttgatcttaattgcttaggggagaaaagatccccacaggggaaagtttgggagaatgatcagtatattagcagtgcttgcttctgcgtggagagatgatgagtgtatcatttttgtctttttccttttttcctttgctaattgtgtggtggctagggaggctggtggcaaaaagagaaagctttttttttttttttttttttaagacagagttttgctcttgttgcccaggctggagtgcaatggcacaatctcggctcaccacaacctacgcctcccaggttcaagtgattctcctgcctcagcctcctgagtagctgggattacaggcatgtgccaccacgcccggctaattttgtatttttagtagagacggggtttctccatgttggtcaggctggtctcgaacgcccgcctcagcctcccaaagtgctgggattacaggcgtgagccactgtgcctagcccaagagaaaggtttgggacttgactgaaagcttatttacagattacttcatagtgaaaaagatacttattcaaaaattttaggggagtagttgagtactttttgggtcacagatccttctaaggacatgataaaaaaaaaaaaaaacatgagccatgtgctacccattaggactttctggaagatggaaatgtgctttatttgtactgctcaccatggggaccatcggccacctatggctggtgagcacttgaaatgcactaggccaggcacagtggctcatgcctgtgatcccagcactttgggaagccgaggtgggcagatcacttgaggtcaggagttcgagactagcctggccaacatggtgaaaccccatctctactaaacatacaaaaattagccgagcatagtggcgcatgcctgtaatcccagatactcgagagagtaagccaggagaattgcttgaacccaggaagcaggagatggaggttgcaatgaacccagatcactccaccacacttcaatctaggtgacagagcaagactgtgtctcaaaaaaaaagcactaaatacaactgagcactgacttaaaatttcattgcaattaacgaaaatgtaaagagttgtacacggctggtgactatcacgttggacaggatagcaatttctttccccagaaagaatatgcataatgtacaaaatcgtgcttttagtctcaggggacttctagggcccctgaaactcacacatatgccctccggggatgtgggggtccctggatctgaggctgtcaaccactgtataatgtggcttgatggttagacactaaacacagctgcaagcttgctggcaggtgggatgactagcttgtccccatttgctcaggatattcacagttttatcactgaaagcccaggcaggcaaatgaggaccattggtcactctggccagctgccacagcgaaaagggaaaggcagtgggttgaggaatcctcactggttttttttttttttttttttttttgagacgatctcgctctgtcgcctaggctagagtgcagtggcgtgatctccgctcactgcaacctccacctcccaggttcaagcgattgtcctgcctcagcctcccaagtagctggaactacaggtgcccaccaccactcctggctaatttttgtatttttagtagagatggggtttcaccatgttggccaggatggtcttgatctcttgacctcgtgatctgcccgcctaagcctcccaaattgctgggattacaggcatgagccactgcacccggcccctcagtggctatttaagagggcaaatgactccacccggagagtttttttttttatttgtttgttttgttttgtttttttgagacggagtctcgttctgtcaccaggctggagtgcagtggtgtgatctcagctcactgcaacctctgtctcccgggttcaagagattctcctgcctcagcctcccgagtagctgggactacaagagtccgcccccacacctggctaatttttgtatttttttagtagagatggggtttcaccatgttggccaggctggtcttgaactcctgaccttgtgatccacctgcctcagcctcccaaaatgctgggattataggcatgagccactgtgcccagccattttgttttgagacaaggtctcgctctgttgcttgagctggggtgcagtaatgccatcatagctcactgcagcctcaacctcctgggctcaagggatcctcccacttgagcctcccaagtagctgggactacaggcacacaccaacatgcctgggctaattttttttcttttttaaatttttggtagaaacagggtttcaccatgttgcccaggctgatcttggactcctgggttcaagcaatcctcttgccttggcctcccaaagtgctgggattacaagtgtgaaccaccatggctagccagagagagttttttcccaccaacttctaggaagctttcctccctgctctgcctcattcctctagcctgcccatgaggtcatgccccctagtctgcaccctccccaacatgcttcctgctttggtggccctgcagagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattgtgagtgcagagccagggtccctctgtgtaccccactgccccacgggcagctctgctctagccctgggttcaacctgctcgggaaccccagggttcacatggggtgggggcagatacgccatccggtcccgaggatcagacacagacacacctgcagccctacccccaccacaccgcagcaggccccgcacagcatcttccagaccctggtggagcatccctttcctcctgcccccacagccctgttcctcgatcgcctgatgaagcggaggcaggagagtggctacctcatcgaggagatcggagacgtgctgctggcccgggtgagatgcccagccctcccgctcctcccagctagacacatggaattcaggcccgggacgggtcctgagcccaccctactccagtcccagggtctgggcttccagcctgtcgtactttagtccctgttcttgcccatccccactgagacacctgcctggcctgaatctcgctgtagtttgatggtgctgagggctcctggttccagaaaatctcctcccgcttctgcagccgccagtcatttgccttagagcagctcaaagccaagcaacgcaaggaccctcggttctgtgccttcgtgcaggtgaggtggggtctggactccagcttcccagggaggaggggcctggagacccagactcctaggtgcctgcgccctggggtgagcccaaagcctgggccatcgcaacaccagcatgtttcccgcaggaagctgagagccgcccgcggtgccgccgcctgcagctgaaggacatgatccccacggagatgcagcggctgaccaagtaccccctgctcctgcagagcatcgggcagaacacaggtaccgcgggcctggatctctgggcctcggctctcctcttttttttttacattttttttctcactcattttcatcagtgataccatcacagctcactgcagcctcaacctcccaggatctaccatcctcccacctcagctccccaagtagctgggaccccaagggcacaccaccatgcccagctaatttttttagtttttttttttagagacggggtctcgccatgttgcccaggctggctttgaactcctggtctcaagctatcctcccgcctcagcctcccaaagtgcttggattacaggcgtgagccaccatgcccggccagctgtcctttgtctaaccttggctgcccaatctggagcctccagggcaggggttcaccagagctgctctctcccttgcctgcagaagagcccacagaacgggagaaagtggagctggcagccgagtgctgccgggaaattctacaccacgtcaaccaagccgtgcgtgacatggaggacctgctggtgagcctgggctggccccacacccgggacagtggatggtgtgagagcagggggtggaccctacctcagcctgtccagaagtcacaccccaccccttggcttgtctccctcaagggtcactgtgtgtccaggggttggcttggccctcagcatctccctctcagggtcattggaggtcaggcccaaccctcagcttgcccgcatcagaagttggtcttggctctcatcttaccaatgtgggtcactgcaggtcagccccagcacttagcttgtccccataatgctcccgtctctgccccagaggctcaaggactatcagcggcgcctggacttgtcccaccttcggcagagcagcgaccctatgctgagcgagttcaaggtgtgaccataccctcctgcctcccccgcccccctactccttggcccaggggattctgtgatacagcccccagcctgtcctgcccatcccataatacacccaggaagcgagagctctgtcccccacctcatgccaatcccatgatccccagcctgtggtcatccccggccactgccctgcccttcccctccccaccaaccccaatcaccccctgccaacctgcacaaaccatcaccccctcctgccccagaacctggacatcaccaagaagaaattggtccacgagggcccactgacgtggcgggtgactaaggacaaggcagtgggtgagtgccagagcagctgcctagtgcagggtgttggggcagtgagccaagggcggggagggggtcgcgcgggggcacgccgtgtgagcactgctcgccccgtagaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccggtgagtgcagccactgcatggcccagggcagagggtgtcttttttgggcagagctgcctgtggagtggggagcagaaccctctagagagccagggagccagcattctagcaaagaggttgagaagtaggtggaggtgggcagggcggggccaggcctagagggtttataagtgaggtaggaactgctgcaggtgtttgcacagaggcgtgtcttgtgtaaacaaggagaagaaaggccaggagtccagtgaggagggatttgtaaacatactactaggaagttgcaccagggccacaaacactggaagcggctggagggtgggagtggctggaggggtttcgttaggtaagccagggtacatgcccgattccataaggaggtgtgagaggtggggctcaggaggacacatcgggccctggatattagcagacagtgagtggtgagttgagccatgggagccctgagagcgccaccactgtgggtgacttctccagcttgtgcttagggaggggcaggcactggggggacctgggctctgagccccatctccccctctccctgcagatcacaaagccttctacgtcctttttacctgggaccaggaggcccagatatacgagctggtggcacagactgtgtcggagcggaaaaagtgagggggggtctgagttctgagtgtgggtggaggacgcccaggtttctgggttcccagggacaggagggctgtggggaggccctggcatagggtctgggggctctgactgcccagggatttggcctttctccccagctggtgtgctctcatcactgagactgccggatccctgaaagtccctgcccctgcctctcgccctaagccccggcccagcccgagcaggtgaggggggccatggagagagctggaggttcagggagtggggccggaaggcggggcaggcttccctccacaactccagaaccgtctctgtgtgagcatgcacatgtgtgaatgcatgtgtgtgcatacatgtgtgtctgtacgcaagtatgtgactgtgcgtgcatatatagtgtgtgtatgcatgcatgtgtgcgtgtgcatgtgtgtgcgtgtatggtgtgtgtgtatgcatatgtgtgcatgcgtgtgacagcatgtgcatgcatgtgtgtgtgtgtgcgcatgtgccgaccccaccactgccccgtctgtctcctgtctccaggcctctgtgtcttccattgtctgggcctctctgtctccctgtctcccggcctcgacctctgtctctgtctccggacctccctgcctccccacctccagctctctgtctccctgcccctgcggccccccagggccaggggtgtggggtcacccagcacttcctcccctcagcacccgagaacccctcctcagcagctctgagaacggcaatggtggccgagagacgtctccagctgatggtgagaccagagggatgctgggtgaggggccaggttggggctgccgggtgaagagaggcatccacaggaggcccggcaggatctgagctccctctctgttccccaatccagcccggaccgagagaatcctcagtgacctcctgcccttctgcagaccaggccccgagggccagctcgctgccacggcccttcggaaaggtagcccagctctgcccctccagggtggccaccagcccaaacagtgcctctgttccaactagaacaaggctctccacgtcaaaaatttccttacgcccagctgccagaaaacaaatgctccaaacccacccagcctgcaccactgtcctgggtgcccacgtccctcttctgcagccaccatcccttgcttgattctatatttagcctcttcctgaacacatctctgtcttcagtaccttcctgccctgtcccaaccctaaacccagcctcacttcttcacctccctttggatccccgaaccccatctgctcagccttgcctggcacccaccttcacctccagcccctacacatcccctttggaatcccccatcccagatcccagcccagccccctggtctcctgactccacccctccttgcccctggccagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggtggggcgggacgggccaggggtgccctgagtgggctggggaaggaaggggcccccctcatccatgacccccaccccaccaggagttggaggaggaattttgccgcctgagacccctcctgtctcagcttggggggaactctgtcccccagcctggctgcacttgaggttcccgcccaggaaggtgagtggggcacctgggggccagggcgctgtcctgaaaggagggtccccctccagagctcgcatccctacagccccttctgtccatctccctctttgtcttttctgaatctccccactccacctcgtgtttctcatctctgtgtctctgtttctgataatctgtttctctgtctctgtgcccgcctgcctctccccacctccccttctctctctgctctccctgtcttgtctctgtgtctgtctctccctgtctctctctccatctctccccgtctcccctcttctcctacatcccccaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaagagatctgtgtgtgtgatggcggggtggggcctggcatggcgtctggaactctctgtgactgtctggcgttgacatcctgggtctgtgcctctgcgcctccctccagttgttcattcattcattcattcatttctttgtttgaaccgttactccccaggcactccgtacacacactgggtatgaggcgtctccctgacaccgccctccagctcccacccccgatcccccatgctcagcactgggcaccccgagtctcactctctgttcttttatttctgtagtaaactctctggaggtgactgttgggatcatggggagctggtggggaggggggcccctcctgggtgggggctgggggcggggttattgctctgagctccctgtccccaggggggcctatatggggggggtgtcaggactggggccagcacagggggtttggagacacggccacacaaacacttggggcatagcacaggggtgggcgggcggggcaggctgggcgccatattgcactttgggagtggggccaggcggggacccccctcaaactggagcctggggaggaggccggaggccatcacattccctctgtcctctgtggagggggaagtgagaccccccccactctggggctggggaaggagactggggcagcaatgtgcccagacctgggaggtgctgagggctggtcctgggccttgggccaggcatcaagggcagacgggcagccaccctggtccctgcctcagcagaatccattgccccctgccggctcagctgccggtcccccctttgcccgcctttgccttggggggtgccgggagaccctcatcgccctcgctgtcagagctgcagccgctgacgtcggtgatctccagctccgagtcgctgtcctccttcccaccaagggcagcctctggacccccagcccctggcagcgccaggcgaggggccgctgccaggcccgaggggcgctcggggcccaggccctcccctgtcgaggccagcaggggcgtggctgtggggcctccccctgcccctgacgagggcaggtggcccagggaactggccagagggttggggtagaaatgcggggggtagagagagggaggcagcttggggaaggggcccgtgaggtacgggttaaagttccaggggtactcagggaaggcgcggccataaggacccagcaggccagggggcttggaatagctggtggcacctggggggcacaggggtaggtcaggctggggcacctgcctgcctggggaccagtaaagggggctgcctccctgccatatcccaccccatctccccgcatccctcctacatggcatcttaccccctcatacagcttcccccaactccatctcctcccactcccccacttgtcttcccattccttaggcacccctgaaagcccctgtctccctcatttcccctccctcacatcacatccttttctgggttttacacacacacaccctacaacctggccctgggcccccttccccatctcttctcttgtcttttctcatcctcttccctcaagcctgcagcttctcccactgtgcccccagcaccccagaacctccaggctcttaccagagcccaggaatgggaaagggctgtccagacgcaatttatctgtctcggaggtgaacaggggtgtccgggcccctggctctcccaggcgtggggcagagaacagggtttgcagggtctagagagggagtgggagaagccgcccttctcagactgtcccctccccagagtgggcaccaagtgcctcggttccaggaccccagtacccagactcacctcaggggtgaggggaggagcatctggccctggggcccccccaaagggactgggggtcagcaagagtggggagccagtggcagctgccgccatgtccagcagcgggtaattgacaagcacgactttgctgaagttgaacttgtaggtgaacctcttccctttggtcttgtggagaatccgcttgttgtagtagtaactgtggggagagtggtggtgttggggaggtgcagggggagccctggggcgggatctggggtttcttaatgcgtgtgctgtcccaggcatggtgcacagagcactagaacttggggaaactgaggctcacagaagtcccttaatagggatcacagggcaaggaagggatgaggcaggagcggggaccctgccctgcaagactccaaagcccaggtttaggggtccctcctcctcgcctcccttccactcacaagtagcgatggtggctactcacgcacagccctgtgccttgtgggatccagcaggaacctgccccaggatgcagagggggcaccagagggacagttgggggaaaaggacaaggtgggatccagccccaagcccttcctcaccgcagggcccggctcagcttgtcgtaattcatgtggggcttgcatttgcgaataccccacagccgggccacctcatcggggtctttgatgacgaattccccgtagtccccctgccaggctatgacgccctggtactcctccttctgcagcagctccaggataaagtgccacagctggatctgcctcgagccaggggatgactctggcttgtaggcccaatccgggaaggcaaaccctggggacgggaggcagggagtggcctggggtcaggatgccaagtccagggctctgggtcctgctggactcagtaacctgggaggcatgtagttctcctccagtctcaggcatctttagggacctggtttccacactccaaacctcctccctttgtgtctggtccccaaattacccaaataagggcaagaacccagtcatccagggaccctgggttggtaccagtctgatcccctaccttggcatagctcccccaggctcagcatccagaggtggagttgggagggactggcttcctgcacccatgacagtgaggaggaatggggaggggcacccgcctccaacagcgttagtcctctcactgcccccagccagccctaggaggtctctagtctcttgtaccctgcggtgccctcagctcttactgtctctgttccccattccctgtcccctgctccacctttcgacattccccagagccccccactgacccatcctggcatatccaggctgcagctctgtgcatgtctgtacctgcctgtgtatttgtacctttcccgtccctgtgtcccctccaccccatatccatgcccatgtccgtccaagagcagtccagaacgatgtgtgtgtgtgcgtggacacacacatgcccacggaagacatgtcacacagacatcagttcacttgcctgagacacacagccacactgggacacaggcacaccggagtgccacactcatgctgggggccaccaaggctgacatggcagacacaggctgcgcaagactcaaggtcacgtcatctcaacaaccccacagtgcacacccatcacaacacagaattacacatctcaagactgggacttactaacaacacaaatgcctgacaagacacacacaggaccccaaatgcccaaagaacacactgtacgatggagacggtgaacacagcaccaagatatccatgtccccagacacacagggtgacagcatgtcagtagagcaacttcccaaacctgcacacagaggcacccacatgtcagcactgacacccccggctcactcagcatcacgtctcacatgcagaggggagtactccactgtccacatacccccaggagctgggcaccccgaaatctcatctcccatgcagaaggccccaagccctgggtccaacttctgtgttcactcttatgccacatcctctgtccccttccccctcctcagagaccccagacccaggcatgaaaatagaaggcagagtgagtccataaaaagctggcagcagtgcaggagagaggagactgctgtgcgccagggcaggggagaccagcatcgccgtgtccacttgctgtgtgattacgggcaggtccttaccctctctggtttagaactgcacaggtggaaggcaagggggcgcagggtcccacccaggctgcctggtgtagaaaagtgggtgcttgtgcctcccggcctgaaggccggggagctccaggcagtctccttgagggagaatttttatctccattcatttttgggtctttctcacctcccatgacagggctggatccagactccagctctgacccattccacacccagaacacatcctactggggaggcaactgtatcacagacacacccacaggaccccaaggtgacaagaggacacccaacccgatactccatctgtcctcaaatgcacaccctcaaatatgttgtacctatgaggcacaggcacagctagagagaggacccccaaactcagtaggcagacacacacatgtgacagacaaacccccagaattcactcatgtgcacatggaccctacgctgaaaaccagacacagcccccaacacagaggcccagggatgcatcccccccacagccccaaatgcaccaagacagccatgcggaacgccacacaacccgagacagaccgcaagaaacaggcaaaggctcctcaccccactcaggcagaggcacagtcggagagctggcagacgcccccatcccaaaatgcggacacgcccagcccagagacactcaagtagcctcagatgtgcacgtacaagcaaatacacaagctcacacaaagacaggctgtgcagacacattctcccagtgtgaccccttctagaaacactgaagtgtgacacagggacacactgaaatgagaccccaaataaccaaggacagagtctctgtctgtctctcacacacacacacacccctcccgctgcacatcagcatggtgtctgaccagcttcaccgtccaccaaccccggttgcaagctgtcctctttcctgggtctcggtctggccgggtcgtgcctgcacgtacccctgactgggcagtgccgtctgtctacctgtccatccgtgcctggcctagtgccccctccagcccagtccctgctctcttttccccgcaggtcctgcgtgggagcaggctgagacgtgcgtggcagggatgcccgggcctcgggcccctccgtcctcacccctcactcacttccgtaccctcccagaagacccacctatccccccagcacgcagggggcaggggaatctggctgcgaagtttttagccaagtttctcagaaggggtttgatttgggggactgaccaagactgagagagaaggacccacggactagagtgagacacgtggagacccggagagaagggggatgcggctcatggggaagctgaggggtgggggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1293 - DNA, 3185 bp, Homo sapiens
gggcgccccgccggtcacttccgcgcggacaccagccttgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggagggtttattttttaatatatattatctaagaagaaaaaaaaaaaaaaaaaaaaaaaaaaa

SEQ ID NO: 1294 - DNA, 2739 bp, Homo sapiens
atggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttga

SEQ ID NO: 1295 - DNA, 96595 bp, Mus musculus
  misc_feature (81)..(100): "n" at positions 81 thru 100  can be any base
  misc_feature (20974)..(20993): "n" at positions 20974 thru 20993  can be any base
  misc_feature (23010)..(23294): "n" at positions 230101 thru 23294  can be any base
  misc_feature (24969)..(25093): "n" at positions 24969 thru 25093  can be any base
  misc_feature (34655)..(34840): "n" at positions 34655 thru 34840  can be any base
  misc_feature (43486)..(43505): "n" at positions 43486 thru 43505  can be any base
  misc_feature (63319)..(63565): "n" at positions 63319 thru 63565  can be any base
  misc_feature (87107)..(87126): "n" at postions 87107 thru 87126  can be any base
  misc_feature (90949)..(90968): "n" at positions 90949 thru 90968  can be any base
  misc_feature (92828)..(92847): "n" at positions 92828 thru 92847  can be any base
catccccttccctgcctgctaggggctgagatctggacaaaagtagtttctgttatatctggtggagggtgggagggaggnnnnnnnnnnnnnnnnnnnngcagagagggagagagggagggataggcccaaaccaagaaatattttttaaacttgattagagggatttttgcttaatgagagtctagttttcatagaatttatctggtacaggttaaaaataaaaaaaaaactggagttactattgttctataatttaatctctctaatcatatttccgatatgactaatcagagaggtcacagtagtgagcaaatgcctaattttgttatatataacagtttagctgcaggttgaattctctaaacttcattctggacttttgggcagataatgtaactgtaatcccaacctttcttagaggttttcaatgaaataagcaaatcagttaagttcagtaagagacattggccgtgaaggatgatgcctggtatgttagatggacacatagactagcatctcattagatgcaggcaggctgtacccaaagtttgtagtgaagaaataaacatgccaaaggaatgaatttcaagcaaaataaaatccagtttggaaagagtgagacaaacagcaggttgggatttttcttcagaacagaaggaaaccttttgtatctggagactgtaaatgaacaaagaggctcgagagaacagttgtggattgtggaatcccagccatgaaagagtttggatgacacttttactgtaatgtaaggagaaggaaaagttcattgtaacttttaaaagtctggtgacagtcaaaaaatagcgtagggcggctagcatggacatcagtaaccccattaccataccattctggttggttgttatgcgtagcatcagagtctggtagaggtagtgtactggctagctttgtgtcaacttgacatggctggagttatcacagagaaaggagcttcaattgaggaaatgcctccatgcgatccaactgtaaggcattttctcaattagtgatcaagggggaaaggccccttgtgggtgatgctatccctggcctggcagtcttggttctataagagagcaggctgagcaagccagggaaagcaagcaagccagtaaggaacatcctttcatggcttctgcatcagcttctgcttcctgacctgcttgagttccagtcttgacttccttggtgatgaacagcagtatggaagtgtaagctgaataaaccctttcctccccaacttgcatcttggtcatgatgtttgtgcaggaatagaaaccctgactaagacaggtagtgagcatgcaaatcagggttgaggaatgagcttgaagcaattggtggtgaatttcatgagaaaatcaggggaatggggaaaatcaatgccgttaatgatctgagttttactccctgaagtattacatatccacttagataaaagaaggtgatggggaaagaggcttaatcaagaagaaatgaaaagttgcaaaatataaataatatgttggctttgccttcaactcaaaggtgatagatagtaacaaatacatagagagattaatttcaaacaaagaatcatcctaagtagactggcagccaaatattggcttctatttttactccaaactccaatactctgtttagtgtctgtgtgtgcgcttgggcatgtgtgtatgcacacacacacacataggaaattacacaggtatgtgtacatgtgctttatgcattcatgcatgtgtaggtacgtccacctgtgcttgtgtttggggtccagataacgatgtctactgtcctgctctgtcactctttacctaattctatcaagacagggttatactggttgatcagtgagttctggctttcccattgtggcctgctccatcagtgggattgcaattatatctgaagccatacttttatatggctctttttatatgggtgctggggactcaaaatcaggcccccactttcaaaaaacaaacacctttatgcatttgtcttagtcagggtttctattcctgcacaaaaatcatgaccaagaatcaagttggggaggaaagggtttattcgccttacacttccatactgctgttcatcaccaaggaagtcaggactggaactcaagaaggtcaggaagcagaagctgatgcagaggccatggagggatattctttactggcttgcttctcctggcttgctcagcctgctctcttatagaaccaagactaccagcccagagattgtcccacccacaaggggcctttcccccttgattactaattgagaaaatgccttacagttggatctcatggaggcatttcctcaactgaagctcctttctctgtgataaccccagctgtgtcaagttgacacaaaactagccagtacagcattgaattaactctgcccagatatcttgatggttgttttttaagcttcctaggcatgaaactattattgtatgttgtctttagtgtcttgcataccagctttctagtatttattttatttataccaggaaatctaactgaataccaagaggtgacttttcactgctttggtgcctctgtagctgttcacgggatcctaagaatacacaaaagtatgtgtcttattagacatgaagagaatttatttttccctacactcctctccttaggaacaatgtgagtctctgatggttggctcctagaatggaatactccctttgctgaggttatctgttctcttgcatatgcatgcgtatttgatttcaagttttccaggcctgtttgtgtctgcttgtgctcatcacttgaagtgatggattgaagaaagccgatacatggaagcctcatctagcacattgaggatctgaatggaacaaaagagagatcactctgcatctcttggctggaatacctgtcttaccttcacactttgattagattggaaagcatactgtctataatcccgatttgtaggctcagtctaaactggaatttctcctagtgacactcctctaaagaccttcaggcttaggcaaatgctgtactctggctcttctagtctaaacttttagaagtttcataaaagtcacataagtctattttcaaaagtctttgttttctcattgaatataaagagatatagtatgagagaatgtgttgtgtgtgtgtgtgtgtgtgtgtgtgtgtatgtgtgtgtgttgtagattcatcttttgctcttttctgtccctttggagatagttaaaacaccttttgttcatacaagtgcagaactacagaaatatttagcttgtttgatttttaatctccagatgcccaccactctgtttaaaagttttagttcttagtgatctttctgtaacacatgggatgaatgaatgcaaatagactcaatagagcactaatgatgttcatgttggagcaggaggaagaaagaactccacatgtatttagagacattggtttgatgaatatagcttaagaatcactctagaagactcaaagaccttttcatcagactcatggcagcggattaatttcccaggagcactaacatgtttttcctacctctcattttctcatgagtatatactcagattgaatgaagatgtaaaaataggaatctgagtagcttttattaagttgaatactattatttgaaaaaataaaaacaatgccaatctttttggtattatttttcataggagaaacctatggggctgttgattgataaacaaattagtaattattttacaggtcttattttattttattgacttttgtggttggtttgttgtttggatacttaaatcagtagaagaatatctgcctgtcaagtccagggccatgactgtagtcaaacaaggaagaacaaatacatccattctcagtctgaatttcttgtaacacacggattctccaacttccaaattccgtgaccctttattacagttccttgagttgtgctgatgccccaactataaaaattatttttttttgctgctcatataattttgctactgttatgaattgtattataactatttttggagatagaggattgccaaaggtgtcgtgacccacaagttgggaactgctgtcatatggtgttgacagaacttagaattgatatactgtttgtttgttaatgattggtgaattaaaccgtgcgcctgtgttcctgcaagctgcgtttgttttctctgtccacctttacacaggttctgggaattgaactcttatctctaacctcttcccactgagcctgctcactgtcctggtaacctcagtatatctaatttgtataggcattctgaaactaaaaaaaatttaggatctattacttaaagcaggactttcatatagatatgttgctatatgggtaagtgtaactctaaaaaacctgtcaggttcataccttcaaaccttgcattattccatcaaataattctttctctgaaccacctaagtcaattccaattacaggttgattttattgtttctacagtttggagtatttgttggttgactgttatggtcaccttgttatccagtcaatcatttaataattgtttataaatatttaaaacatttaaatgtatagcatgctcttctagatgcacacttgttgggttgttgcatatcagtagtttggaactttagaattccaaatgcatggtttattattgctcctgtgatacatttctgtttagtagctagtatggtgtcccctttcatgcttgaaatggcttcttttctttttctcttggacacaacacagctgcttgtgttacgtggataaaattcatacagtcaccagtgtgctttcagcccaaactgtgtctgggttaccagctacactgtcccttgttgctggtgaccatttcactttgacattctgtatgccctgcctctcgcactctgttgcccaggtctcgtctttgcttcttttgcatctgtgtacccattacagcctaaccagttcagggaatgtcccagccatcccaccaaaccttttatttgaagagctgagtcaaacagtcacctactcactccctgtccccacccccatgggcagtaggttattttaaggttttctttggaactttttaaaatttttaccttcttctgtgtaacatttctctacctaatgcttttctgttaaatgtaccacctggtttcacccttaggataggtcagtcatgtgagacaatgctattttttttttaattaaatatatttgtgtatttgtgtgtatatgtgtgcggcagtgcctgtgcaaatgcacaggtcagccagagcacagcatgtagccgtcagtctcctctctccactgtatgagatctgggattgaactcagttcttccggtttgggagtaagtgcctttacatcctctgctctcaaggtggtggttcttgttattgtcttgatggaggatagcccttataaaggattggcatggcacttaattaaaatgtgtgtacaaataccttataatgaaacaccagagtcaaaaattcacaaactatgagcctgttctgagaaaaactcttgtatgtttttgtggggaaaaaaaaagttgacaggcctgtcagattggggaagatggtctgtagaagagggagtgggaggtgaatggctaccagtcctttcaatcaagaacatggataggtgtggcttctgagtttatctcttaatttgtaaggtgtcttaagtactttgaataaccagcttagtgaaatactatgcttgcatgccaaagtctgaaataaccttctatgttatgaatacctactatgaatgttttaaatgatatttttaatgactatatcattgctagtcatactcattatttataactactaattgtatattattgaatatgtagaattcttttattttttccattttaatcaatataatgagatgcattatcttttcagttatatctttgttaatttacacaaaactttttttcattaattaattttatatttttcactttatatctctcactttatatcacagtcctcccccacccctcctaggtccacccttacaaatccttttccccattgcccctccccccttcttctgaggagaaggggaagcatcctgccctcccccagggtaccaccagggccctgggacatttagtaccagcaagtctaggtgcatcccctcccagtgaggtccaactcggcagtccacctgtggaataggatcaaatggcaaataccagaatcagagacagccccctattccattgttaggggactcacatgaataccaagctgcacttatgttacaaatgtgtaggggcctaggtctaacccttgcatgctccctgatttgtgattctgtctttgtgagcccccaggggcccaggttacttgactctgtagttcttcttgtgttgttattgactcttctggcttgctcagttctattccactctcttccacaagagttctggagctccacatgttgtttcctggtgggtctctgcatctgcttccacttgttgctagatgaattctttcaggagcaagttgtcctaggtttctatctgcatagcaaaatatcattaatagtgtcaggagttgactcccttgcatgggatgggtcccaagttgggccagtcattgggttggccattcccccagtctttgctctgtctttatccttgtacatcttgtaggcaggacaaattgcctgaaggtgttgaagttttatgggtgggttgatgtcttcctccctccactggatgtcatgcctggctacaagaggtgacgttttgtagtgcatatttatccattttgaattaccacattaggggccatatatgtctttcaaggttttgcttattgccaaactgctctctagaaagttgcattacttaaaaaccatgcaaagacttaagtttaggcactttcccttgactgatgaattggagaacctcaagcaatctttccctcaagttatatttagggaagtataaatgtgtgacttgacatcattaaacctttagatagctaagcctccatcaaatactactgaacacttactagaaatttgagggaacaagaataacagtaaataaagttttgtttttaacatcaagagtgagggacttaacatgtgtaaaatttccagacattaaatatagagggccagttgttcttggatattgtagaagtaatcttttgaagttcctaagaacacagtgctggctacatttaagttgatggagggaagtctgtgtcccagctgcagctccacaggcaccagctgtgtaaattgccactgtatcaattctgtagacagggctggaggttgttcctgcttgtttctcctttgtagaactgcgcggtaagtgcattattaatgcacataactcagccaagggagccatggagggctctgtgtaaataagactatttatcccaaccattccatagaagtgaattatcagcactaatttttcttattatttaacctgtgttgagtggcagtaaaatgctgaaatagttaggataagcttttatttcatgattttcatctttctaatgatcaaattggtaagaactaatgatgactagcgcttgttcattccatttctttaataagaaaatggttgtagcttaaaatgcaaatggctgaaaattgctaaatggtcttaatggtaaatataatgcatttttaaaatgtgacacaaagcatattttactccaaacgttattttatgatagtagaaaattactattaggaagctaataagtcttttgagctctacactttaaaattggtagtcagaagctaaacttatggaaataaatatgccatttacttataaaattattcatcattgggtaaacaggacacagaaacaggccagtaatgatgcttatagcttttttagggtctcaggcctggtcatggtcatcacagaaattagtctaattcaaattggcacactgtagaaacattttgacagcttagttattgatgttaaaaatgtgagaatagccatgaataaaatcattctttttttcttttttctttttttttttttttttttccaaattaggttaagagccgggaaatcttgttttgttttgttttgtttttgttttgttttgttttcattttggaagttgtttaccaaaaatacaccgatgatctttttatcctattaatgtactgtctgtgagaatcaagctaaaatgtaatcccagcacttgagaaacgaagactgggagacacaagtaaacaataacaggaattactattaatatcgtatgtgtattctgtacttgactgtactgaagtactagaaaaaaattgtcataaaactttgggatcaaaaggtcccttctaatggcaactgtccagattgaaaatttgatttcttatgtagctgaagccttcctctctgaagtatttttgtgttctgtctgtttgagctccaggttgtcaattaactgagatacatagacacagtcactgaggtttttggatatcgtggtacaatttattatgtttcagaatagaatatagaagagtagttttgcatttcaggaagagagggccaagtgcagtgtaagaaaccttatataaaaaaaatagctctctaatatgactcctaatgtcatgctgtttgacaaaatgatatcattacatttttttggaggttcacatatttattcaaatcttctttgcatgagaataatagggagaataacagcatgtctttctggagagctgcttgcaatagtatagtagaccagtgccagcctcagtgaatagtcactgtatgaactttgcccttagcaaaaccaaaaaaagtgttggcgttctgaaagtaggattctgactgtgtcatttacctcacaagatccagaatgagttaatggttactcagtcaatgtgacctcgtgcttgcttatgtcctgctttagaggagcatggtggtcagtgttaactgcgggggtcagaagtaatcttaccaagatgacagttttgagtcaacagtgcaccagctatgtactagagtcaaattaagaatagttggacattagggggttggcaagatgtctcagtaggtaaaggattgataccaaatgtgggatcggagtttgattcttaggtctcacgtactgaaagaagactaccaattccctcaagtgtctgctgacttcaatcatgtgccctggcatgcatgtgtcgacttgtgctctctctctctctctctctctctctctctttctctctctctctctctctctctttctctctctcatgtatatcacatgtataaaattaaaatatttaaaaatatagaatgaaaggaaaattgaatagtagctctcataaccactttacaaagtattcttactccataacttgatgttctcaggacttagtgaatggcaaaagtgcatatgccttaaataaacaaaaatattagtatttgaagttggaagttattccacttcctgcagtcttccatttctctgctttaacatttgtgttaacagagaaaacaaaagaagaaagtactttctgtgcatatcaaaccaatacatttacttgtttcatttttcaaaagcttactattttgtaggactagggaaattttagagagagtgttgaacctgaatccgactcctgcttgtctaccatctgaccctaagttagcagttatgtcccatatttctatattgtaaatcagggttaatatcaagttgtagagatgaataaactgtttttgtctagtttatgaaatgttagtaagaaatggatctacgtgatgtcttgactgatatttttctatggccctgccccagaagacattttaaaatttaatgttttcatagagtaatatcctataatactctatgaaattttatagttgtaatattttacagttgtttgatacccctggcttatcaatgttcttagctctgttatttgtaatgtcatttcaggttcctatatggttgtggactcctcaaatcatgatcctggagaaaaagccagacttcagctgcctaccatgaaggagaatgacacccactgcattgatttcagttacctgttatatagccagaaggggttgaaccctggcactttgaatatcctagttagggtgaataaaggacctcttgctaatccaatttggaatgtaactggattcactggtcgtgattggcttcgggctgaactagctgtgagcaccttttggcccaatgaataccaggtaatcccctgagatttttctggtttgtgctgtcttgtattgggtatctttgtatatatagatataaatactggtcctgcaggagtaggatccctccttcttgtttcccaactccttcttgaggaggagtttgagtgccttgacacagaaccttctaactatagaaaatatttccatgcatagaaaacagtagtttggcccacaatttgttgtctactttgcaaagagttacttacttcttattctgatgtacatatttctatgtctttctgcaggaagaaatagttttgttttgatttttttccccattagactgcaatattctgactggattggcttactgatttcttgaaaataccattttggaaataaacaggagatagaattttgtgaaatatatggtctttgatggtggcattagatttttcttttccttaactaaatggaatatttaaaacaagcaaacaaacaattcaggctatccataagaacctttgggtggttttccttggaatgctcaatctgatagtgatggaaggatataatgaattatgttaattgccagttcagggttcttatgacagagtttgcttggtttaagagagaagtcccacgcaccgacttgaagacatatttcagtcatgcagactgtcaggtttaggacctgcaaatacataaccattttgtaggaactcaaagcttgtgttttacatgatatttcaacattttagaagacctacctcttcatggcttactatagaacttgtgagagtacatttatgtacaagtatattccacaacacccaatagcaaaattatttcataaaaatatttctttatggttgtaactcattaagtacaaaaaacataaataaataaataaagcatccccttacttgctttttcctgtgttgattattctagttgcatggccatagttttaccgggtgaaagctatgtctctcattttcaagttgtgtgtctgctgaaaactcggtacatttcattaggtactagtggcttccatcattcctgttcagaaaaattgctcccttttattctgacaggaaaaccatggttttgttttttgtttctttttgaatctaaacctaaaaaaaaacaggtggtttccgttgtgttctcaactttacatgatttccttgatgggtgtttaaattggtttagccattcaggtaactatttgtacctgtgcagtttttgataggtgacttagctgttgatcatctctattccaagagacacccatttgctttaagtaccagttattagagacctattgtgagatgcctcccgaaaaatgtggacgatgggcttctattcctttgtaagaaaaggaccacctcattgtgatacagaagcactacctagacttgctttcctatttatgacttaaataacttgttttctcagatcaagccttctccagctcagcttggtagctccaggaggttagtctagtgttcaggaaccaggtacatgaggcttgccctctaaattcaagggtagcctgggctatagtttgaatcttattaaagaaggaaggaaggaaggaaagaaggaaggaaggaaggaaggaagaaaggaaggaaggaaggaaggaaagaagggaagaagggaagaagaaaaaaaggaaagaaggaaagaaggaaagaaggaaggaagaagaatatccaagctttaagtaattgcttaagatttcagaacttctttttacttttgaaaaaaaaatttttagaaaaaaaagttaaaataaaaacctttttcctcgagaaaaaaagtactaacatcattgtctaaatcatcaaatgatttagctgagaccatcaaatatgtcacttaaaaaaattagacttgtaaggagttgttctcttcaggttggtgaaagtgcactattgaagtggcgcactggattgccttgtttggtatttcactctttaatattgttttaaacacagtttatatagaaatctaccagttctgcgtattcttactcttcatggctggtccatcttgggagatactagctacaaaagaatgacagtttgtgtttgcatggtagccaatttaatcagataagtgccttgagtacacactaacattgttaaatggaagaagcaggtgtatattttatattttggcaatcatcatagtaacccaggactatataagaagttggtgggttcttccattttccatctgcacccataattgatcccgtgccacagagctccatagccagatagctctgagagagagctagcctcccaggagtgtggacaagcatgtgcctgcaggtaaaaccaccactgctgctcaaagggtccctactggaacactcaggacacaagaaccaaggagtggcctagaacaagagtcttctggtttccttctgtgtctatagctaatcctgtgacacaatacaaatactgccatgagagaactggtctctcaggagtactgacacagctgggaacacaggtaagacgatcacttctcttcaaattcctgacccaagaaggacccttccagagccatcaggacacaggaaccaaggaatagccagggacaggatccttctagtttctgtctgtactccagagctgaccatgtatcacagctctccatacataaattcttccatgagaaaactggtctcccaggagtactgacacagaggcttgcaggagggacaggccacagtcagagacagcaagaccagctaattccagagataaccagatggtaagaggcaagtgcaagaacacaagtaacagaaaccaaggctacttggcatcatcagaacctagttctcccaccacagcgagccctagttaccccaacacactagaaaagcaagaatctgatttaaaatcacatctcatgctaatgatagaggactttaagaaggacacaaataacttccttaaagaatacaagggaatacaagggaatacgggtaaataggcagaagtcattaagaaggaaacaaaaatcccttaaagaattacaggaaaacaaaaccaaacaggtaaaggagctgaacaaaaccattgaggatctaaagatggaaataggaacaataaagaaatcacaaagggagccaaccttggagatagaaaacctaggaaagagatcaggagtcatagatgtaagcatcaccaacagaatacaagagatagaagagagaatcccaggtgcagaagataccatagaaaacattgacacaacagtcaaagaaaatgcaaaatacaaaaagttcctatcccaaaacatccaggaaatccaggacacaataagaaggccctaaggataagaataataagaacaagccataaggataggttcttctatacctaagaagagagtgaagattcccaagttaaagggccagtaaatatcttcatcaaaattatagaagaaaacttccctaacctaaagaaagagatgcccatacaagaagcctacagaattccaaagtagatagaagcagaaatgaaattcctcttgtcacataatactcaaaatactaaatgcacaaaacaaagaaagaatattaaaagtagtaagggggaaaaggtcaaataacattaaaaggcagacctatcataattaccccagacttctcaccagagactatgaaagttagaagatactgggcagatctcatacagaccctaagagaacataaatgccagcctaggctactatacccagcaaaactctcaattaccatagatggagaaaacaagatattccatgacaaaaccaaatttaaacaatagttttaaacaaatgcagtcctacagaggataatagatgtaaaattccaaaacaaggcaaactacaccctagacaaagcaagaaagtaatcttctttcaacaaacccaaaagaatatagccacacaaacataagtccatcactaacaacaaaaataacaggaagcaacaatcactattccttaatatctcttaacatcacatcaatgggctcaagtccccaataaaaagacatagactaacaggctggatacataaaatggacccagcattttgctgcatacaggaaacatatctcagtgtcaaagacaaacactacctcagagtaaaggtctggaaaactattttccaagcgaatggttccaagaaacaagctggaataaccattctaatattgaataatagtgactttcaaccaaaagtcatcaaaaaagttaaggaaagacgttgaatatttatcaaagggtaaaacaatctaccaagaagaactctcaattctgaacatctatgatccaagtgcaagggcagccacattaataaaagaaaacatattaaagctcaaggcacacattgcaccctacacaatactagtgggattcttcaacaccccactctcatcaatgggcagatcatggaaacacaaactaaacagagacacagtgaaacttacagaaattatggaccaaatatatatattatataacatttcatccttaaataaaagaatataccatcttctgagcaccttatggtatcttctccaaaactgactatacctaataatagtaaaagcaatatacagcaaaccagtagccaatatcaaactaaatgaagagaaaattgaagcaatctcactataatcagggataagaagaggctggccactctctccctatctattcaatatagtccttgaaggtctagctggagcaactaggcaacaaaaagaggtaaagagaaacaaattgaaaagaaagaagtcaaaatatcagtatttgctgatgatatgatcatatatgtaagtgaccctaaaaattccaccagagaattcctaaagctgataaacaactttagcaaagtggttggatataaaattaactcaaacaaaccagtagccttcctctactcaaaggagaaacaggctgagaaagaaatttgggaaacaacaccttcaaaatagtcacaaacaatataatgtatcttgctgtgattctaaccagaagatgctccaacatgtaataaggacacatgcctcactatgttcacagcagtcatatttataatagccagaagctggaaacaacccagacgtccctcaccagaggaatggttacagaaaatgtggtacttttacacagttgaatattactcagctaataaaatcactaacttcatgagattcacaggaaaatagatggaacttgagaataccatcctgagtgaggtgactcagtcacaaaggaacaaccatggtatgtactcactgataagtggatatcagccccaaactttggaatacctaagtttcaattcaaagaccacatgaaacctaagacaaaggaataccaaaatgtggatgcttcagtgcttttttttaagcagggtgaacaaaatactcacaggaggaaatatggaaataaattgtggagcagagacttaaggaaaggccatccagacactgccccatctggtgatccatcccatatacagccaccaaacctggaccctattgtggatgccgggaagtgcttgcttatagaagcctgatatggctcttgcctgagaggctctgccagatcctgacaaatacagagatggatgcttgcaggtaaccactggactgagcttgagggtccctgatggaggagttggagaggggactgaaggagctgagggagtttgcagccccatggagggagccactgtgtcaatacctcagatcctcggagcttcctgggactggaccactaaccagagtacacatgaagggtcccatggctctggcagaagtgtctcatatgtggcagaagatggccctgttggatatcagtgggaggagaggcccttgggcctgagggtgctcgatgtcccagtgtaggggaatgtcagggagggagaacaggagtggttgagtgtgggagcaccatcatagaggcaggataaggggtttctgaaggggagacctggagaggggaaaacatttgaaatgtaaattaaagagaatatctaatccaaaaaaagaagaacaaggaggaggaggaggagatgatgatgatgatgatgaagaggaagaagaagaagaagaagaagaagaagaagaagaagaagaagaagaagaaggagaaggagaaggagaaggagaaggagaaggagaaggagaaggagaaggagaaggagaaggagaaggagaaggagaaggagaaggagaaggagaaggagaagcagcagcagcagcagcagctggtgtgtgtctcccttccagagaattgttcccttcctcctagtatactgatagaatgtctcacatttatatttattttatgtgtcatggtatgaagatgcagtgacataatctaggacttgaattcaggactgtatattcttaagttgactgccgaataaataacaaacagaaatgcttgtttctaaaggacaaaaagtcttttagaaacagaataactggttgcattaaagctaaagctctgccaagtaaagagtaataatcttccctttagaagccagactctgcttgtgttcgggaagggagttttgctttggcattaaacccatttgctttgaacagcaaggttgttactaaatgaggcggagagataacgtacataacctgtaaaactcttagtggagacttaatctgttgctttctattaacaggacacacatcattaatctcaaaaatgatgtgtggtgaatattacagggctctggcctggaactaaattgcaacaatgtagcaagtgcaccccccccccctcccccccatttaggagagacaagcacagacctggtgcaatccattttctctacttttttttctggtgctttgatgtaagaacatgggctgtagcctctggctttgcctcctttttagagttccattcacgtgtgttgtgctaatattttggcaatagagtaattcctatgctccaagagattgctatagtccagagagcggagattctgctggttctggatcaaagaagatgctgagttaagtcaagtaagcacatacatgaataggttgcctgtaaaagactgcatatggtgggagagcagcttctgtatcaggagcctgctgctagccatcctttagaggtccaggggtggtaaacatctcctccacttcttagatcttccaattttcctagtccttatttgtctatgcaggccccaccttggatatatactataaagttacatagtcccagtataaaactacattgtgtgaacattgcataaagttacatactgacattataaagttcaaattatttggattatataatccaaactatgactcattgttgtgaatactgagatgtatttagatgctgtttgtgtgtgtgtgtgtatgtgtgtgtgtgtgtgtgtgtgtgtgtgtgtgtgtgtgtgtgtgtgtgtgtgtgtttgctaaccactgtaggctcctctcacactggaaggacttctcatttcatttgcatttctcattccttttgtaggtaagggtggggaaatgacaattctctggattgtgagttaggagagggaaataggaggaggcaggtcattactagggcactcctctgaagaagaaaatgattgactagccttaacaaggcagcaagagtatatagaaagggccttaccaatatccccaggcaaagtagtacaatatataataatagcaataaatattgtttaaattgctcgtagatgagtattttgcttcctaaaatgatatgtacggggtcgtttttctcaagttgctcatatttatggtttacggcttgcacaggaagacatgtcagaagtgaacgtatgtatgtctgtgttgaaacaaagtcacatttctagtgtcctaatatatagaacataaacatataaattcgtacaaaactataggttgcatgagagtgtctcgatggattgcaggcagaaaggaaggaaggaaggggattatgcctcccatatatgcagtgctgtcctcgatcagctgtgtatcacatcctttctagtttaccatttcatgtaaagtaaatgtatcttaccttcctaggtggaacaggtttccaattagtgagtggaggattaaaattcctctttgccctctttagttacttagcctggctgataaaatttggactctgcacctctctgtacctattgaatgtaactgtgtacgtaggcttcttttagtaatggcagctgtgatggctctgcgtcgtcgtcattgtgtctcacttttatatggataaccgttcagttttcagtttttctcacttattatcaaggtggatcttccctggctgtcttttcacctctatgcttgcctttgtttcacctaaggtccaaatgaggatagaaagcctcgtgagttattacacagttattgttttttctaaaacttcagagtatgacttctctgcttcctgaggcaatttggaatggaatgtctcctcttctttgatgttagactctgtattgattggctgatgaatgtgagctcatgtaaacaaacaaagacaaatgaacaggagctctgcttttaaccacaggtaattgtttgcatacagcctgaccctctacttagctagatctgcttctgttcagaacctgaggagttgtcatgacaccctaggctacatagggagccactgattgttttgaggactcttgccatgagattaatttaattcctcttaaataactgattgaaaaataatggccattaggagagtcaggctttgttcgatatatgactctctccttgagcatgaatttgtcccatggggacatggaagagtactacattctttgcttgctcaaatttcttgcacttttagtctggttagctggatctgagacaacacacttacattttgtctttattaattatttagccttcatttgattgagacagtctttacacagcaatataaaataacatggataaatgcaaaaacatgagaattgtttccttatcatcagcttagtgatactttctgatacctcaccttcattatcaattcaattccatactgtagatgaaaagtgtgtgcatcaacttcaaattaattctcatttcagctgttgtctgtgctaatatttgatagttaacttgtatgagtctgtgatttttaatttccagtacaaagcaattgaatatctggtttgtgtgttgtcattttcaaagactaatcttttttcttttcatctgcatgtagtatatgaaggaagtactgggttttcaaagagaaaacaaagttaaatgtatttatgctttgtgcagtgaatatttcagtgtcattccatagactaaatcagaaaaataaaaatatctaattttctatattagtgtaaatattttaagtgtttccttcaagagtttaggaagaaaatataaggaaaatagacatagaagctggtatctatttttccttcagataaaaatgactataattgttgcttcctataaccccatttaaaaatggggctcagagctaaacaaagaattctcacctgaggaatacctaatggccgaaaaatgacctgaaaaaatgttcagcatccttaatcatcagggaaatgcaaatcaaaacaaccctgagattccacctcacaccacacagaatggctaagatcaaaaattcaggtgacagcagatgctggtgaggatgtggagaaagaggaacactcctccattgttggtgggattgcaagcttgtacaaccactctggaaatcagtctggcagttcctcagaaaattggacatagtaaaactggaagatccagcaatacctctcctgggcatatacccagaagatgttccaaccggtaagaaggacacatgctccactatcgtcatagcagccttatttataacagccagaagctggaaagaacccagatgcccctcaacagaggaatggatacagaaaatgtggtacatttacacaatggagtactactccgctattaaaaagaatgaatttatgaaattcctaggcaaatggatggacttggagggcatcatcctgagtgaggtaacccaatcacaaaagaactcacatgatatgtactcactgataagtggatattagcccagaaacttagaataccccagatataagatacaatttgctaaacacatgaaactcaagaagaatgaagaccaaagtgtggacactttgccccttcttagaattgagaacaaaacacccatggaaggagttacagagacacaatttggagctgagacgaaaggatggaccgtctagagactgccatatccagggatccatcccataatcagcctccaaacgctgatactattgcatacactagcaagattttgctgaaaggacccagatatagctgtctcttgtgagactatgccggggcctagcaaacacagaagtggatgctcacagtcagctattggatggatcacagggcccccaatggaggagctagagaaagtacccaaggagctaaagtgatctgcaaccctataggtggaacaacaatatgaactacccagtaccccccagagctcgtgtctctagctgcatatgtatcagaagaaggcctagtcggccatcagtggaaagagaggcccattggtcatgcaaactttatctgcctcagtacaggggaatgccagggcctagaagtnnnnnnnnnnnnnnnnnnnngagcgcgtgggggacttttgggatagcattggaaatataaatgaaataaatacctaattaaaaaaaaacaaaataaaaaaatgactataattacatagcatgctacaatgcctaatataaaaatgttagactatgaaaaggaatttttaagattgtaaatatctattcatataatttagtgaacaatttatagataaatagttgttttaaggcaaacccaatagtgttaaaatataatgttttagaggttgaagtaggagggtcattatttaagaaagcagcctctaatatgtaaagactatatcagaataggctaaccacacaaccagataaccagttaactcaccaatgagttaaccaaccgatcaatcagtcatacaaactaccagataacaagatcaattataatgcaactatgccacccccaaacaaatgaccagctagccagctaatttacagactaacccttcaaccaaccaactaatcaacaaaatagcagctaaacagctaaattacccctcaactggtcagctaaccagttaacttactttcttaccaaccagccaatcaaccaacccactcaactaattagcccccatttagtcacatccctaagcccagtaaactggctaggcagaaacaggcacagtgatcaaaggctccccccccaccccccccacccccaggatatcatggatatgttttagttaggtgaagttttgcaacccaagagcataagcttttagagtttttattaagagacctacccactcttcttagagtctgtcagcaaactaaatttgctttcatcttcagtctttaaaataagtgttcacaactcacagctctgctcaggggctacctcaacaatgataaccattttctaatcatcttaatatatcagctatatatcggttacttttcctggatggtaattctcagacatcacaatattttctttgaattaaattttcactctccatgctccaattgttacttgtattttttatttattttttattttatcttattttattacttttgagatgtgatctctctatgaagctctggttctcctagaactcactatgcagaccaggctggccttgaaggacaagtgtaggcaaccacattatgatcacatttcagtactggaaccagagtcaggttctggtcagttaatggctgtacgctttctctaaaaaaatattttttattgtcatttggtattatctcttctgaagtactggatggtttgcatcaattctctactcaagagatgagtagacgagacaagctgaatataactgtacaccttgatgaactgaattttgtttccttgtcatgagcatgcattgggatgctatgcccttcttaatattcgccagggtttagagagaaaaataaacaaacaaaatgtatacagagaagtcagaatgagccccctgtgagtgggcagccacacagatgtagttcaaggggatggcctctagatgataggaccagggactttatgctgattcctctggacattgttggcaagggttcccaaatccagttctggagacacgtctgtgttgattctaaattggagtttgtcatcaggacactgtgatgacaatgatggtctttaaaggtcctcttaagggctgagttcagcagatcaaagtgagtctaccttctgtcagcagacgctcttcaggcacacactgctattaaaacttgtacttaggaactgcttttctagaaagcactgactcttcacttgggcccacagagtaaataaatcaggataaagcctgccttctttgcattggctttctctcttctttacttgggtcagccttctatttaactctgcttgtaggtatgttcattactcctgggatgtttctagtcaaccttgtagaatctaagctgtttcatattctttggagtctgaaggcaccatggcttccactgtgactactctggacctgagtgttggagtgagacccttgaagtcctgatagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttctaatcttttatttgttttatgtaccagtggctccaataggacaattctgtgttgaatatgccaaccaagttcccttgtgccataaaagggcatgctgcttctccagccagccccagaaatggaagggggttctgttcccaaatggacctgctgggtttaatgcatcccagttagcaagtggctttcacttgctctaaagccaggagtgccctgttgattggcagcaggaagctccttgttcatgtggagagttccattttgcaggggcactagcctctgagacttgtcagcatatggcctttatgatacagtaaaaggtcttttctgcttttctcatagccatttgtggctcagtttggaaccttttgagttacttagccatggccctgaactgtaagggacagcaattttaaatgagtttgttgtttgaatctgccttggtgaaggtttttttttttttttttttttttttttttgttctttaagatagaaaactagcaagcagagagtagatagagccaagctaactgctgtttctcagtcatcactgtactaacttcatttcaatgggctgtggtgcccagaggttaggctcagaattgaatttcagccctgagtcccactcaggttccggggggagctcatgttgcagaaacaagcctcttacttcggtcacggaagccttcttaacaaatccctgcatacaatcaaatcgtggctatttatctgctacactagggttcctgacaatcagactggatgagggtaaagcccaccttctctgttcttcaaatcaaagtgtgacagattcttggtgacataacaaggcagaatttctgccaggccaagaattgctaaagcatttcagggaaaagaacagaaaaaggtgacaagccagtcattcactggttcatgcttttgattatctacctgtgtgtgattgcatcactttggtttatgggacagaggctagctttgttttattttttattttgtttgtttgttattttttacatctcataaccactattaactaggggtcaggatggtaagaattggtgggtcttaacaccattatttgtgattatattgcttagaattagtgaactgatctcattctgagcatggcaagtttagtataataatggtaattactaatggaatttgaatagaagaaattaaaaacatatattttttattttgtttttttttgtttaactgggtatttatttcatttacatttccaatgctatcccaaaagtcctccacccgctcccccacccactcccacttcttggccctggagttcccctgtactgaggcagataaagtttgcacgactgatgggcctctctttctactgatggccgactaggccatcttctgatacatatgcagctagagacacgagctctgggggatactgggtagttcatactgttgttccacctatacggttgcagatccctttagctccctttttttttttttttttttttttaatatcagggaaattgtctggaagtataaattaaagtgacatttgaaccttaaaaagtaacctaaccaaacaaacctccttttagttgctgactgtgaggaaagcttttttccttgttggggacactgaaagttttactgtgaccttcaggtaacagattttgaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcttccacccccttctttgcttttagtcctggtttgggaggcccatatacagtgaacacctggacccaaggggaatctggcccctccgaggaaagaaacttgtccttggtcataggtctgaggacactggaatgcgatagatatgatgcctgtcttatgaactttgatgagattccatgagccattctagcaccgtgttgattggtttgtagtgcaggaaggagaaaggtctgtttctagtaacaaactcccgtagaagagatggcctagcactcagaacacttgtttctgaggacctaggtttcatttgaaggacccacatggcaggtgacagtctgtaacactccaaggaatcttctggcctctcctggcccctgcctgcactgcacacatgtggaatgaaaatccacataggtaaaacaacaacctactctgtgtgttgtggggcatacatttaatgcatgtgagtggtgcatgcacataagtccctatccattcacatggatgtgggagacagagtaggacatcaaatatcttcactcttgctttctccattccccatgaaacagtctctcatagaaccataatcttgtctttaagtacaagctctctggcctgtgattcatttacctttgtaggaatagacctggctctctttcttcttctattggaaattcaactgaggccttcaggatttcactgtaagcatttctaactgcctattggtcttcctgctctggaaaatccagcattgttttgcaattcatgccaagtcggacaatttttttttattgttgttttgttttgattttttaaaagaactttttttaaatggatggctaaaaaaatgctttatttcaaaaaggaggaagaacattaagacatcaaaagtgcacaagacaatgagaaaacatgtatcagaatgagaccatagttcagccatattgacagctgcaccaagggtggatgggcaaagggcgttaatttttaaaagaaattaaaagggaaaccttgtctcaaacttccctgttagttagtttcatttcaaacattaactgcgtatatccaaatagctacgactacccaaaggatagcttctaacaggtagtcctagaatctaaaaaacacttcctatgttttcaaacttacatttaaatcttttttttttttttgagactttcaccaagattctatcttagaaggtaagaatagagaaatttaacactcttcccaattattgaaacaactaagcactttttggtctttcttaataggggtaaagtactccccaccgccatttatagggttaaaaactttaacctgaaaggtttgcctgatcttactctctaacctctgctgtcagagacccattgaccacatggaatatgagcatcacacacctgacagtggctgaacaaaccaggatttgtcttttgttcaactgtcttttagaagacgtaggtgctttgtgtattttactatgaaacatttcttctcctctctagcttaaatggaaagagtgttttcattgttaccatgcactgaaattacctctcctatgtgacttgtaaatcctggggagataagtaagttccaaagtttctttgatacaagtctgctttctctctgtgatgtatccagggtcagtgacatgagctgtgttccccacctcagcatcctgcctctgtgtggattggccagactatgaagacacacttcatctctagtagtttctcagtgaggagtagagacgcacctagggctgtattctcatttctattgagtacaccacagacaaagtatcaacacacctctaggcagttttcatgctcagaactgtacaactaattagtgtcttccaaggctgcgccctcccacctaactatagtgaggcctttgtcttctcaagatagacttctctgtggttctccttgtctctagacttcacgtaattatttaatgagtgttgtaatggaaataagaagcccttggaagtacaatcataatggaaatctcatgctctttaaattctaggcaaaacatcttatcatctctcaaagaaaaatagcttaaggaacttgtcttagtgttgattcttagtgctgtttttttatactttctttggtgttagaaaaagttgaattcctggcttctgtccgaggcccagtggggaaagtgctttttctataagggtgaggacctgtgttttgttccccagtatccataaatctgtaatctcagggtgaggaacaccctgggcccatcctgactaatctattcaaaatggtaaactttaagttcactgacacattgtcacaacaaaaaaggtagagagttccaaaggaatatatccaatgctagcctctggcctccagatatacacacataggcaagcatacccacacatacattagtgcatgccattcacactagagggattgttaatatccacttggaaaatatatggttttaacacagtacagtgtgttgatatggtatcataccaatccttaagaactgatttctgtacaaataaaacacagggaagaacactgatgagaaatgaaagagggttaatctcctaaaagtgtttattctcagtcctgatcttcaactgtaggcataccttcatacacataattccacactaaggccatcttttctagataatagaaacctaaagttctgaaagcaaacctaagcctcaggagaatgtctaggtaagcttaggggtagattcagtgaacagaaaggggaggctggcttcagaagatcttgtgaacaatgagagccaatctcagcactggtggggctcattgatttagtatagccctattctcgttctggccagatacatggaggaggtgctagaagagatttgtgggagtggaggtgagaaaagtcagttcttgtcaaaaacagtttggagaccaaccagaagggagctgaaaattattgtcaagttagcttaagggtaaggaggcagaattttcaacaatttccaaagtggctgttaacacacttctctaaaattgtactcaggatttatgaggcatgccattctcagcgttaatgttacaaaatcaaactctgccatgcaactctgccaaccatagggacagctctgcatcctacaacatcgagtatcaagcagagatttaattctttaggtaaaaataatcaggcacatgtaactcattagtatggaaatttattctcaacttcacaatgtttaaatgttttgtctaacaaagaattacatgagcatgaatttattacttgtaataagtaaacttgactttaaacctatttcatatgtttgtatacctgggttcatataaaaatttctggggtagaagggggccctatgtggaaagtaaattagagagacctaatttatcagtagcttcgggagtaagaatggctatgttgcaataaagccttatttttgaacacccaaagtctattttatatattttaggtgttgtaaaatattattcatttcttcttgtttaactccaaccatctatacatgtagaaaacattactgtgtggaccacaggatatgtaataacaagcctcaggctggctttggctggttagaggtgatttagcaaactgttgtataatagggaataacttcagggcaagactggcttattattatttctcaaagaaagtataaataaccatccttccatgccaggacagcatgctcccaagcattagaacttttgcccaggttcttaccctacctgatggtttcctagaaaacacgctcctgcctcaccatctttctctagcatctgcacggtgacgcttccacagaccattctgtttgaattaacaacctgccccctcctcagctttcaaggtataaagtcacccttagatatgactaatcacaaatatcttttcttaaattacaattttaacttgtagatagaggctaacctgtatttgcttggggcagggctgtattttctttccagagctgttattaccattgagtattaactaaaaccacaatggatggtctgtctcctgcaagcccaactcctgcccatacataacacttgcttctttactccatggcacatcctgagttctccaaactgttgcatattcgcagttttaatatgcaactgagaatattataattaattttataactcagttataaaacaggggcttctatcagaaattattgggaaatatttgctggataaagaaataaatattataaactttaaaaatagaatgcacaaataccctcattttctcaaccaaccaaggtccacagagctccaagggactaaaccactaactaaagagtatatacatggagggacctatggctgtggccacatacgtagagaggatggccttgttggatttaatgggaggagaggtccttggtcctgtgaaggctagatgccccagtgtaggggaatgccacggtggtgaagaatgagtgggtaggtgggtgggtgggtgggggagcaccttcatagaagcaggcagatggaatatagagtttccagtgggaaaaccaggaaaggggataacatttggaaggtaaataaagataatatccccccaacccccaaaaagaaggaggctggggaaagtcaaggagaaaagggtaaggtgctttatatgggagaatattaataatagaatattagtgtgatatatttatataaacaacaaaaatgttttttttaataataaacaaaccatttcgagattaataataaaaataagaaagttaaaacaaaacaaaaaaaaccctcactggttgttattgaagagggtctggttcatttcccatcacccacatgctggttcgtggtatgttgtatcctatcctgtcctctgcagaacactggatatagaatgcacagagatacataaagggaaaccatacataaacattaacatattcataaatcaaggtactttcctcctactttgtgagaaaccttagataggcaggttacaactaatatttggtaaatgtttattcataaccctttctttagctggaaagggttctttctatacaatgcaaatgattaactagtcagttaggtctcctaataggaaggcaatgaatggctgttaaagatgcccgagaaaatgcatcattggaattggcactcttctcctctctgtactgcgctgaagtgttaatcaattaatcagccctgcaaaggctttgatggccgccatacttctttcttgggaataacttccatatggtctcttatgaaatggttcccaacttttgcactataacagattttctcagtgtgcactggattgcctggaagttttgttttttaaaatgttctggcctctaatcccagacattctgatttcaacgtatagagtaaagactaagactgtagatgcagttgtcagtgtatggaaatggaccaaccagaaggttttaggtttttcttagcttttttctaaccatgttgtttgtcaattattcagttctagaggaagaggaggaagaggaggacgaggagaatgtggtggtggtggtaaacgggttatttttgaatgaaccttaatagtatcatgattttgggtcttagaaatttattctgaggtgtcttttcacatatgcctaaggatattgtaatatagaaccagtcatgtgctttctgaccacagcttacttcaaatcttacatcatttctttgtacttgggtatcctgggacttaggagcctttgtatgtacttttaactgccctatgaaaatggtgattagacattaaaaactcactttttttgtttgttggttttgtttttttcttttgtaccatctctttttatttccaagtcaagtttctaaccttcaaatagtaagtgaacccagttgctgtcgtgttcatttataaaatgctttgcatatgaagagatgttgctaaaaaagtttcatgaccgcacacaggagtttcttacattgtgcacatctgaaatatgtactgatcatccagttatcttttaaaaggaaatcaattatcagtaatggaaggattttcacacagaagagtgaagttatatgtgtaagtatattcctctttatcggggctatgatgcattttttatactatattataattgtgtatatacacaaaaacatgttctctttttattgctactgcaaaagtatactgtagctcacaaatatatgggcttagtataataactaaagatcatattctttcaatgtattatttcttttcagcagttcagtctactaatgtttataaaataatccatttctgtacctatattatttaatgaaatataattttgtttagtctaaagtagttagaatgtatattatcaacatagtatgtgaagtgtgtctcaagttttcataataagtaaacaaatagctggtgtctgtttgcaactcagtttatatttgagttgcagaatatggagaagtcagggtagtgttcaattagaagattcatctttccgaattagtgttcttggtgctggaaggtgctacacactctgcaagcagagaaaagtaagaatcaatttcacccaacaatggaccctgaaagctacaacagatgtatgggaagatatgtacattagtgaattagtgatgtgcacgttatgggtgtaacccaccagttctgatctgctctaagtcccatttcatgagatgggatttatagttgtcactattaaaggagcaaataacctgagactagatggcatataggttgggagtggggctgcacaacaatattgttagtaagtagctaattcttaaaatatgttggtcctagcatatatatatttcacattcattgcaaatactctatgcccaatgaacaagataaaattcaataagttttttctttgccctccaatagcatgatcaattgattttatacaaataaatatgtaaattgtaggcggacattttgtattatttactaattgcagagaagcaagaggctagactgtaaaatgcagaaagatccctcagtacaccagcttactaatttaaataataagagaagaacagtcctctggtagcatttctgtttctgaattcactccattgaaaactgagtgaagcaagagatttctttcatgactataccaataaacgtggagagaaatctgttttgagataaagcgtctatgtaatgaagaatagacacttagaaataaggttgttactaccagtgtgaggttaggaataaagtgatgccaagttctccatagccataacataatagtgaccatttttcctttttcaaatatatttggtcctaaaataaaatttaatattttaaagttgtaaaatgcatttaagtagtgttcgtagtatgataagatatctataagagtttgtgaagatctgtaagacaagataattattaatatggtgggaatgtttcctgtctaaaactcaggtgttggtgaggtggtgataaaagaggagatgaagccacagattcacctccttctgtaccttagaaaagaagcatatgtagcagaggatggcctagtcgaccatcagtgggaggagaagcccttggtcctgtgaaggttctatgccccagtataggataatgccagggccaggaagcaggagtgggtgggttggggagcaagacgagggagaaggggagaggggattttcagagaggagactaggaaaggggataacattagaaatgtaaatgaagaaaacacctaattaataatatatattttaaaaaagctaacctccccctcccgttccaccacagaaaggctggattcatcattcttgagactgtagatatagatagtatcctcttataagcagaacacagcctttgactaacacccaaacattccagtcctgtgatctttaacttcctcaagaattgagagaaataaatgtattccatgtaagcaaccctaactctgttacttggtcatagcagcatgaacaaacgaaagcaaattacttattctgtacaaacaattttacatggattgtcatctttaattttcacatggttaattaaaattttattatttcacaatgaggaaactgaagttttaactagcctgttgcaaggctagtgaccattagttgtgtattgaaatcctcagtatttactaaataagtatttagtaaatgtccaagaggactgtttgatttctttaaggaaggatgttgcaaattattttgcaacattgaaattcttttccatgtagagatacaaatacaaattaatatagttgttatattgccatatttttctgttttgtgtgtatgcagacaaggcagtaaatatttacatcagaattcaaagttaaagcttgtctttattggaggtggcacaaaggaggaagaacacacacagcaaatgtgttgtatccttaatggaagttgcgttgtgagttttgaaagaagggagaatttcaggaccagataaaatagcggctataaattcacacagttgtgaatggtgtctgggaaattatggttctttgcatttgaatcttggaggtaaaatataaaataatatttgaaatggaaatgctttccaaagaagaggggcctttgtatttgttcacactaatttgttagtgttgctgaggttgcaattggagtatcagcagccctaacaggtttgttgttatccatgtcttaaaagcattctaggtctgggacatgcttctatgtttaaggacatggtgcagtcaagcctcgtgacctgttgtgttctcctccccctccccccccccccccccggcctccgaggtccacattatagaaggagtacataacatctatgaaaatttattcacatgcatacatatgcacatacccaaattcaactcaaaaattgaaaaatgagctggacaagatgacttagtggttaagaactctttgttatttttacagaggactgggtacacttttttaaacttctctgggcactaagcatgtgggcacatgttatatagaaatacatgcatgctaaacatttatacatataaaataaataaatctaaaagagaataaactataatattctaattacctatgctatctttttgtatgttcccatcttaaaatgcgtttgttcagttttcaaaataaacttggtgtgtatttcaaatacagggtacaattcccttgagaaatgcattgattacaatcataaattacacagaaacatcattagaacttgctgatacaaatttgttttttctgtaataaaagtaattttttctcaacttttttttggtgtgtgtgtgtgagtctttgagatataataatttttcttttggatagttgacccatcagctcagtaaattcaaataggcctttttctttcttcaacttctgattggtagcctgggatacttatctaaatatatctaaatggatatatacatatgtatgtaaatcttatatatttaataaataataaatatacaaataaatatatctaaataagaattttctacttctcttttctctttctatcagcaggatatacttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagccctccttgaaaacatacatgtgcaggctggatataggtcaaggactgctatattttggccatagttggccaatggcatggtattccaggagagattctgaactgtgaccagagcaacttgaaagagataagtgttccataaggtgcatcagctaccagatggccacagtatagtgatcagaaaagagaataactgttgggagaaggattttgtgcacctgagttctaactataaccaagcccttagaaatattttgactttggatgcatgctatactgtattagtttcctcttgcaatgtaagaaatccccaccagttggtagttgaatgttgcagtgcaggtatgggtcactagtccacagtcacagtgttgacaagagtgtgtcccttttagaaacattaagaacaagtatatttccacacatttcaaggaaaatttccaaatttgttagaatgtaaagaaatttactctgccattgcaccacacagccctatgctgtagccaatccaggggtttgttgaagtcctgttttaaactgaacctactaacaacctgagttccccttgtgcaacatccttttggaatcctcaggtcagtctgttgctctttcctttggaaccattattctgtctgttacactgaacttctattttgattttccttatttgtaaattaaatttctttgtaaaaattaaagcacaaagagaaagtacgttaaatacctggttgaatgtctgatatactataataattcagttagtgagatctatcatgacttcttacttcccatattgcttgtcttattattttccccatttcttgcttattgtaccacatgtaccacattttaaacatcaatatattttctccagtgattagacatttcgatataatatttgtacactatcgagagtatatgcatggattcattatgctagagatttcgagagcttaaatattagattgttcatgagtagcatatgttaaagcactctgcgggtctctgatatggctcccgttcccctaatttctacatcattaccttccaatcttgagcagaccaccagagtacctcagcttctattcccactgtctcactgaacaggataggaaaggactcgacatctcaggtttctagcatgattgcagtggctgttgatgtgattggtcagggaccacactgtgtataactgctctagaaacatctatgaagaaagtagtgtaattgtctttcttcacgtgtgtagtaaacatgtttctgtgaatttggctgagagctacccagaaactgaagatagcagagtagttttactaaaaatgcatgcattaaaacaaaacaaaacaaaacaaaacaaaacaaaaaaccaaacttctgaaagagatctgtcttgcaaagtagtgtcatttcaaagagaagtatgctttaacaacaggtagctatctatcagtgtgtctttctaaacaggaaagagtatctgataaagactagcatggggttttcttttttttcccaacttttaccagtatgttgagcaggctattcttcaatcatgaaaatcataaaatggaattgctctatctgagggtgcctctgcttcacaaatcaagtgtcttttaataatactgtcttgcggttgctaaacatagtgctattattttgcaatgtgacatttatgcatcatgaagagacttcatttttatataatgcgtgaaaaacgaaacatgggattaataatgttagacacatccttgaaattgcccttgaattatagcagtattaaacacctaacaatttatgtcatgtttagcctgagattgctttgataaagggaccttgtacaagtttctagaatttactttgtccacatgaaatatattaatatgacagaggttcacattttctgagcttgtctcttcagtgggaagctgaggttgtacagacgggacaggagctcaactctgtcacatttaagtcttcaggtgtgttatttaaaaaacttgttctcgcaggtttaattgctctcttaaaaaccatgagtttgaaaagtgtttagtgtcattgcattgattggacaataatagaatatcaaatgcattgttcccataatttgatttttcagccacttaagatatttaaattgggcttctgttttaatacctttttatttagactgggcatggatttttttttaaagattttatttatttatttttattatatgtaagtacactgtagctgtcttcagacaccccagaagagggagtcagatctcattacggatggttgtgagccaccatgtggttgctgggatttgaacttcggaccttcggaagagcagtcgggtgttcttacccactgagccatctcaccagccctgggcatggattttgatgaatttgatttgtgattcatttccttcaagagaatggattgtgtttgatgtaatgtgaatgaggactgggatgtgttcataaggtaatgtaactggagatttctgtaccctgaaatagacactgctcttagaaattcaaggtgaacagggatttccagttagctcactttataatagcttacaagtgtgtatagattttctagaggtctttaaaacgtagctctaaaagccttattattcagaagtacctcagtcaatctctactagaaactacagagttttcacttagtatgcatgtttatgatcactcaaatgcacatgactcaaaagacccatggaagagcaggttatagccatgatgttcaatgagtgtttggaaaggaaaagggaaagatcatgcgatctggaattcaccaggttgataggaagtgccatgtactgttgagaggcagaaaaaaatgataggtgtgaggatatgacagcagacggggtattggatattttcaattttaatttacaagcactaaaattatagctgacaattttaagcatgatcagtttttaaaaataggttgatatgtgttcaatattaaccaactgtaattttttttcattgttcatttattttatttttagatttaaactaaaatatattatagacattagattatgcttttaaaatgttttattaaagtatttctaagttcaagttttttaattgctcttattttcatgagaattattcatactggaaaagtgcatagaagactaaaaaataatattgcccttaccatattttttttgtaatatttgagagcaagggactttcaagattttatgaagaaagtgtattttcttccagggattattatttaatacagtgttgtttgcacttttaggtattcaattggtttggtttcatcatctgtatgtaagcgaatattggaacttgcaagtaaaagtagactagaaaacacaacagaaacttcattctgcttgcaatgaatgctgtgacagattgatcattattctctttgctccacccttctctaaattaggcagttcttaaaggatctaagcagaattcattagaacacacatagaaatgtactatctgcaaagttttctctataaaattaaacatgtattggatgggggaaatcctagattaacttttatacagttatgttcagaacatggtataaacttcaaagaatggtcaatgaactactttttaaaatattatttaatgtgttgatagtctgtgtgtgctttttgtatgtgctaagtagtctctcttcagttacattgatattaagggggaaaatgaagaggatccaaaatgaaaacagccagtgactatctagtaaagtagcagtcagcacatctttcccagtaataatagcctcaagctctgtcaggtgcttatgtggtagagtgtacagatatacagtgcagtccaggctccttggtcccaaagcaaagagaatgtttctatcctactttgtctatactgtgaatatcattattataagacttcatagactttataaaatgtacatctcttaaaacatgttttttttttgcatttgagagaactttttaaaattatgtatttttatccatttatttttaagatataacttaattacatttctctattccccttttccatccaaactcttctatccacttttttccactcttattcaaattatgccttcctatcctttttcccaagaccgagtttctttgttgtagtcatggctgccttggaaatagctctgtacactaggctggccttgaattcagagagatctgccagtctctgcctcccacgtgttttgattaaagacatgcaccagtacctccagattcccttttgtcactgttattgaatgtatagatatacatgtaaatacatataaactcttaaatatgacctgttcatccttataaaggtacttggatatatgttttcagggttgaccatttggcattggacaaccaactggtgtgttcttccctggggaaggccacccctcctattttcagccttctttagttgctttctgttctttctgtagggttcaggactggtcggcttttttagttcagtttgtcctgatcattggtgtctttattgtcaacctcggtttagggtggtcatgttggtaagattttaccaatgtaacgtctgttgttggtaggagatacaacttcacaagtccctgattctcttacagtcttttggctctctcttctttccagtttcctgagcttgagctgtgggactttttttgcagttatacatcctgcaggataagggtccatgaccctgaattttgattagttgtggtttttccatgccgatctctgttgcaaagagaagtttccttgatgaggactgaagacctcacttacttatagacgaatgtctataaatgttttagggattatgctggtttagtaaacaagtggtcacaaattctcctctgatgactcttgactttactagtgctctgtagttggctaggtttctattgggcatcttccacagtctctcttgttgcgtgtgtcatatatccgattagagaactattggttggcatgaacgttttagtgccaatcttaaatacatttttcctataatgccatgcagatttctgtaaaggtgttttgtccttcaaaactatggggaaatgtgatataacctttagaaatgtggttcacaaggtgagacatgtattctttcactcaacacctttaaaggagtgggtatttgaagcaaggtaacaagtaacccaaaaggtagaaggtagagggtttgcttttgttttccttttattatttcttttgtcctaaaacacagatggctcagtatctacagtctattcattttatatgtgtgatttgggatgtgcatgctaaatgtgaagggtggggaaggctcattgccgagtgtaggggtggggaggagggaggaagaggaggagagctcttgaaatgttaggattttctctggtgacattcacttaaatggtgttaaagaatgagagagggtcattttcattggtttgctgaagtccaaattaggtagaagttagcatttgttttgaaataaatgttatgaagatataaaaggatggatggattcagatggtaaagagctgtagtagccagaaggtatcaagcctggagaaatgatgggagggagaggggggttagaatactgaatatctacaagaaaaaaactgtatacacacacacacacacacacacacacacacacatattcacatgtagctgtgtggagtcaggtgaatctattggtagacttttattatttttagtttaagtgtttaaaactaactatcgattgtcttaagaattattgatcttagagtgtgtgtgtgtgtgtgtgttttatgttttgcatgttttcctttacctgcacatcatagctgaggaatattctttgtggactacgacatagaagattattccattcaccaactgatgtttagaatttatgtttattaaataattatgtctattaaaaggtacatgtatagctgggcagtggtggtgcacacctttaatcccagcacttgggaggcagaggcaggtggatttctgagttcgagggcagcctggtctacagagtaagttccaggacagcaagggctacacagagaaaccctgtctcaaaaaaataaaaaaaaatgtatatgtattataataccccttttaaaaataaaaaccctgttaatgttgagacactagaaagggagaactagcttgtatgtggtctcctaattgtgaagctatagtctgaagctgaagggattgtttgcttagctttcctgaacaagtttgtctccctagtcagcatcactctgtttgttcactggctcagacttcattcaggccttctcaggcatgtctttgtgtcaccttgtcaagttttaagttgattgggcacccctgggggaaatggtgtgggaaagacatgaacactcttgagtgccagcatagatatggcgtgaggtgaggggcgagagaagccaatggtaagccaagtcctggcagaaatctgcctccaggaggctcaagatggtcgcttaggggaagcatgtcctactctgacccttagtgccagggaggcttgcagttctgcttacaggaaggtagtaccagcagtttttatatttgttggatcgaatctattcataatctctctattttgtttgtctaatctttcaagagctgtctcattcactctgatcccaactaccattcttctcttaagtttctttgctatattattgcttgtcccttcttaatctcacacgttgcagcataataagcctggggcatctctacaaacaactctctctctccttctctctctctctcatctctctccttctctctctctcacctctctctctctctctctctcatctctctctccttctctctctcatctctctctcatctctctctctctctctctctctctctctctctctctctctctctccctccctccctccctctctctctcttcttttataaaagatttcatagttcttcctaagtgtatctgctaattaatctttacattacccctgtgaggtagacagctgaataggatattctgcacacaaagcactagaccatgctgcttctctgttatgatagaggattattgttatgttaaaatgtttatacaccaagtacataaatttgtagagatggatgtaagccgattccttgggcaaaatatatgaacgtggttatagcataaaactgcaattgtaaagcaagttttatcagcttctggtatttaaaggattgtcccagatctgcatactaaacctctgtatgatagcctctttccattctccagcctttgggtagtgacaggacacagtaagctggcgaagcaggactgcagcaagcagctatctgagatcctagatagcattacttttagactactggaagcttctttggtctttaggaatacatatacataaatcactagagtaatagcactagtagtttttgatgataacctgatgatagtgaatggaaattggttaggtgttgtacgctttgtatagagtttggtgtgggtcttctagaacatagctttttaaccctctattgcagccccatactgggcatatgactaaatgtgagagtctggaaacgttggggtctgtataggtggagatggggacttttcatgtgtaggaacagtggcctggaggatgggctgagtcttgctagtgaggtacatcctcacataagttgcttatgcatggatcatgacagtagtggcataaggaaaccactgatagtggacatgggaaaatgaggttatttttctcttgccttaaaatggcttggaatttgaatcttcaactctcttaaccctttgcctgttaacacatgtgagtggggaaacaaggaaattgctttctctataaaatatacttaaatatgtgtgattttaaaactgaaagatgctaagatcaaaaattcaggtgacagcagatgctggcgaggatgtggagaaagaggaacactcctccattgttggtgggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatccccctccttagatttgggaacaaaacacccatggaaggagttacagagacggagtttggagctgagatgaaaggatggaccatgtagagactgccatagccagggatccaccccataatcagcatccaaacgctgacaccattgcatacannnnnnnnnnnnnnnnnnnnacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtggggggtgggtggatatgggggacttttggtatagcattggaaatgtaaatgagttaaatacctaataaaaaatggaaaaaaaaaactgaaagatgagtttacttttgttaccattggacctacagttaagtcagcgactcttgccttcactttgtttagagaagttcatatctggctccattcaaagcttgctctgaaccctgctttaccacagtctgtctgtcctttgaccctagatcagggttcagcacattgtatcttgtctgtgggggcagctcagtgtcaaactgtctttgtgtattgatgtagagaagtaattgctgctttctgccctcatgtgaccccatgtcacaggtattaggtttctttgcctcctataatcccagtgaagggtcagaaggagtaatcactgtcatgcagactcccatctggaagtttattttgcttaattaatgatatacactgaaagcattctttatgcctataatataaatgtataagaaaattatctttgtgttcaacattaaaacaatatatctcctagagatttctgagtatataacattttatatgtaaattttaaatgttttattgtcctaaggttgtttttaccttacgttgtctttttgtttataattttgaaaaaactggaaaacatgctcatataacttccaaacttgcatattctagtgaatcctatttttgcttaaaatttgcatggctcttaaaaaaaatgtatgcttgtgtgtaatgtgtgtgtgtgtgtgcccacatgtgaggggctgtaagatatctagtagccccctcattcttttcttctctccctaccttcctcttctttctccctctctttcttctttcccggtgagagctaatttcaaagcttccctgcctggtgacattttataaactgttgttaactattatgtacaaacattctgttcctgggatgatgagctatgtctgggtggaatgtgatggctgttgattataaagggggtgagcatccatgaggacgccccctcttctcactgcactcaaatgcactaaaagttgctgattaggggggaggagataaatagcagaaatgccactattattcttgtcaaaatcaaaaccatttcagtggtcaccgaaaaacagagttctgccttttctttgtgtttaactctgaaataatttttttcagccaatactgtgtgtgtgtgtgtgtgtgtgtgtgtgtgtgtgtgtgtgtgtgtgtgtgtgtgtgtgagagagagagagagagagagagagagagagagagagagagagagagagagatgttttgggttacctttatgttgtatgtccacttggcctctgactgtattgatccctctccgtgtgactgttgctctcgcaggtttaactgatgatcattctatagtcctccgaggaaagccattcattggggagagtgaatccattttctctgggtcttaattaaatgcatctaatcctgaagtgcctgttgcttttttttttcattttctcaaccatcgtgaatcaataactttctatttttcttgatctggggtctgacttatattaattttttgtcattaattagaatcaacctggaccacatttagcaagcagatcaggctttggcactgggtgattttttttcaagtatctatttttcttcctcctcttccttctcctccattttaaatttgccctcagtgggaatggcgctttccctgggaattggcctcatttccagctctgttcaatcctgtgtgctgtggtcacagtgtgagcttcctctacgctaagtcagaacttgggataattaatgactgagtcggaaagccaacacttaggactttgtgggcagaagaacacctcacaccagttcagatcctacctcccccattcctgaccactttgctcagacctcctcccttgactctgcttagtactgatgacaattccccagtcatgtgacatgtgcatttgttcaagtgtaacaggaaatcaggaggcttgtttgagaaccgaggatttataatgttcttattaaattttactttgttagatgcatcttactatgttagcctacggattcttgtccttttttttttttttttgagccattttctgtagacattctttaaaaaaaataataattttaattatttacattcaaatgtccgcttttctgttctcccctccgtaaaacctcacccccctcctctttgcctataagagggtgctccctccccccactcctgcctcactcctctagcattcccatttgctggggaaattaagcctctcccctcccattgatgccagataaggtagtcctctgctacatatgtagtgggagccatggacccactcacatatactcttcgggtggtggtttaatccctgggagctggaagggatccagttagttgatactgttgttcttcctatggggttgccacccccttcagctccttcagtcctttcccttactctttcattgaggtccccagggtcaggacaatggttgcctgtgattatctgcctatgtctttgtcaagtactggcagagtctctctgaatacagctataccaggcttatatttgcaagcacttcttggcatcagcaatagtgtttgtgttttgtgtctgcatatgggatggatccttaggtggggcagtctctggatggcctttccttcagccatgtcctttagacaattttatgttaaagattttgagatgagttggtggccccatccctcttctgggggccatatcctggaggcggtctctttaggttctatctccctgctcttgggtatttctgctaatgctatccccattgggtcctgggagcctctaacatccctagctcatgggactttctagtggtccctcatccctcactgctgcatatttctatttattctcttggctctctggatttctctcatgcctctttccatacctgatgctgccgcccctttcccctccccttctcctctctcatccatgtctctccttccctctgcctcctgtgattaaaaactggggtgcagaactaaacacaattctcaactgaggaatctctagtggctgagaagcacctaaggaaatgttcaacatccttactcattaggaaaatgcaaatcaaaacaaccctgatatttccccttacaccaatcagaatgactaagataaaaaactcagacaatagcagatgctggcaaggctgtggagaaagaagaacactcctccattcctggtgggagtgcaaactgttacactcactctggaaatcaatctggagctttgtcagaaaattggaaatggatctacctggaaacccaactatacttttgtgcatataccacagggatatgtgtgctccaccatgttcattgcagccttatgatagccagaaactagaaacaaccaagatgttatcaatggaagaatggatatagaaaaagtggtacatttacacaatggaatactactcagctgctaaaaatgacgacttcaagaatattgtagtcaaatggatagaactagaaaatatcatccagactagaaaggaagtacatggtatgtactcactgataagtggctatacccatgatgcaactcacagaccatatgaagcttaacaagaaggaaggtctaagtttgtatgcttcaatcctacttagaagggggaacaatagacacttataggcccatttgtgtttgataaccattctctagctacattctatgtcgaaggttggataatgttgataagtagactaagagaccaggccctgagcaggttgcagtcacttcatggtatgtaacaatctcttaaccaaaatatttcctggtgttaggtctgaaatgtcatcactctttcattatctgactcatgtttctgcctcttgactgtaaatgaacagcaggagtcttgacagatgccttactgaagtatgggctaattaagatgtatcctgtttcttttacctgttattctgatactttggacttttctttggaaaaaaaaatggaaactctttatttaaatgatcaatgtaatttacaagttttagttacttggtttggaaatacaggatataaggtgttttgttaaaactattttccttctgattttaaaatgctagggatctttttgcccttaatttcttatatattgctcatttatattgttttttgttttgtttttgtttttgtgttagtaaatagcccattatatctttccgtcgttcatttagacaaacaaacaaacaaacttgtaagttccagagaagagccagatacttcctcacactttcttcatattttagggtctcatgctttcgtgaactggcagactggaattaatttcatcctaagccattggctgagttccatccataaatcacggtagaatgttattctaacaacatagaaatggatgtgtgtcctttccccaacctttacttctttggtcaggagtcagttatgagctaggctgcccaaacttcacatgtgctcccagaccttttattgatcttctttcagaatctgtctctattattactatttcaagactcagtgtcagcagaatattgttttgagagagcaggtcatatatttcattaggatgacatatggttgttctctgacctctctcctctaagttaattctcagtgttttggccatactctttgatgcctgatatctatgactcctaagagaggacacaagacaatttttttttgtatgccagtttcatagtttgtcaacacaatcaaaaaatggaataagttgacaactgtttgcacagctgtgttattttctctggaattgataataagactcttaatttaaaagacccatccaacagtttagtttgatttattcttcaaggaaacttttagaagcttatctctaggttaaatgttcagtgtgcacgttattgaattattttctctacgagtttgagcacaaagcaaaaaggttagagaaatctattcaggctgtcataactatgcctggctatgtgtgacagatgctaagtagcagaacctttacgttttttttttttgtgtgtgtgtgtttttgttgttgttgttgttgttttgtttgttttttttgtttttttaatacacacagagaaggtttagaagggatcctttatgcctgtgaacaaacactctgcaaatgaggaatccccatttggacaaaaaaaattgtccatttttaaaaaaggtttaaaaatatatacatagtttgctaaaagtttagatttgtcaaaacatatagatctggattaaaacatcagcttgaatctttttcaggcagcggtcttgaagttataggtgagtgatagaagtaatggtcgggcaaggtcatttgaaattgcgccagactttctcccctcacatttccccattttcttcccaaataaaaccagatctgtagggacaagataagtctgtgtcctggtggtatcgtgtcattttatcagagtccattgggaactgcgtgctgcatttattgctacaaagcttagagtctgtgcatggatgtctaatacagagagttaaatgtttattgtaaaaatacttgatatttttgggcaggggttaacctatcctttcagccattactagtcttttctaggatggagtcataaacaatgtataaaagaatatacaacttgagaaaatgaatttgcttctttacaacttctgttttgtgatgagagacaatatttttactattttaaaacattttgttaaattcatgtagtaggtttaaatttatatttatattacttatagataacagaaaactctattttgtacaaaaagagtactgttattggttgacagtgtgtgtgtgtatttgtaactaaaacctattgtcacatattaatatgctttaggtattaatcactaaataatcaaattttatatatatatatgtatatgtatatgtatatgtatatgtatatgtatatatatacatatatatatacacacattatctcactgaaataagtgctacacatggtttataattatattgccaccattttaaaggcttgagcaactattttctttcagtccccacaaaataaagacagtatatcacatgcccacagaataagatacaagattttgaaatcttaactcattattattagtatttcattaagtatatttttttaatgaaatttgaatactgaacagacctgaggaagaattttgcccagttttctcatcatatgagctcaaaggattggagtcctgcaggaatattccacagggtgatgttgtatacttcattattcttgtattaggggtcagagccccatccttggcaggagtccatgtgcctttgtatttcaccatgtcccttatggcaatatgtactataattttagaactctcaagtgactattagaccttctgacattggggccatctttatctcctgattaacttgatatagagttgaacattctgtatgtcattggctgtgacttagttagtgaagctttggaacttcctctccagaaaggagcctgactgtcttcctgatgagtcagaatgatgagtctgctgtaatgggtaaaatggagcagtttcatgccaggtattactagtaaaacacagagtttcatgtacatggttagcatgtatattagcatgcctcagtgatctatggtgacaggaacatactaggcccatagtgtactaaattagagtgttcaaggtggttgtatatcagcaatgtgaggctgtgtttatttttattgtctttggggcttaaaacaaaaaccaaaacctttcttttttttcttgataacctaaactgacacagaaaaatatattcgtttccatcaagccaaaacatttcagcccatctctctacacattaaatacattgacatgtctctgttaacttataggagggtacttttgaacgacctgtttagacagattaaagatatttttatgactctttatgtggcaatcattggaacaaactgacatttttatttctgtgggaataccagttgattgtttctgtaggccatctgcctgggggactgtggcattcttttacctttattcaggagaattgtaaataccaggaaatactttaaatggacaattttaaaatgctcacacaaatgttttccatctgagtatcatgagtcacggcattaattatgccaggaggacctcaaggaaactgtctgcgctgcctagaaggctctatggaagcctgggttaaataccatgatcatgacacttaataaagcaacacaaaaagcaagcacacagtgtgtttcatattgagttttctaaataatcttttatttttagacccagagtaaatttagtaaaactctagataatgggtttcatttttttggcatttttgaaattgaaaatatattaatgagatggaaactagaaatgtagcttatcaaggacaacctttcaacagatgacatcaagccttctgtggtgtcagaatgcgattcccctaaaaactaataatagaagcaaaatagttcttttgtgttgtaatttgtaagaatcatgtttatatggggggaagggagcatcaaaatttcaacttgctataccagcagccagttttgtaagtgtaaaatttgtataatctaaccttagtctctggatgttgttaatctattatttctgcaattttccctcatactcttaccaatttccaccgaatatattttatctgagtagtgacataaaagtaacatgctgctacttttgaatcaagactagtgttccccccctgtccccgaacatctgagaaggctgtgtgtgtacttaaaggagacagtgctggacatcccccatctaaaataggactgttagctatggcacttagacaacatgcatttttgtaagattcagttgtcaagtggctgcagggaacggtctataccattagtttgaaagggtttttaacagctgaggttcatcatttggggtatgtgtatcactaggtttctttctttcttttttttttcttaaagatttatttacttattatatgtgtgtacactatagctgtattcagacactccagaagagggcatcagatttttgttacagaaggttgtgagccaccatgtggttgctgggatttgaactcaggacctttggaagagtagtcagtgctcttaaccgctgagccatctcaccagcacggatcactaggtttctgtgcttcaaaggcttgcaaactcaattttacacactcatttaagatggaagaaatttgttttttgtagaatgagttctgagacttctcaaagattaagtactactgctgtccaaagagttgaaactttcttgtattctatgtagaaaaggaatccattgtctgtggctttaatttatgttttaatgattagttcatatatgaccaaatacactacaataaaagtttaaaacttcgttgcctttgatatatttatgttgttttaagaaagaaaattattgctgtatttaactttactgttaatatagcatctttattttgttggtaaactccatacactttctgttttctattgtatgtgcgtttacatgcacatatttctctgcataagcacatgtgtacaagtgcccaaggagaccaggagatagtattggatctgtagagttgcaattgtgagctgtctgatgtgtgtgaaccaagctaaggtcctctggaagagcatcatgtgataagtaggctccttaaactgtctgtgcagttcaaggacctttggttttaatattcattttaggcatattcgatccaacttttcccagataatggaaataaatcagtaaaatatgctacaactacaaagtttcagccagtggaatttcatctgtagtcttagaactgacaaagatccacaatcacagtagaggttgagccacgagtctttcaaagttgagaccatatcttgccagcacttcctgaattgctgtaaactttgatggaggaagggctactgagtttagtctagtattgcccacagggatttgtacccgattagacctttctctttttgagtagttaataactgcttctgccagaaaaccagatcaaagcttagcgggggagatcagtacattggttttatcagccattttccagccacggctcttctaacactgataacagggtggtggtgagggaaatcaaatgcttgcaaccttcctgtggtgccgtcctcttgatttgtttaagaacctgggaggaacatgttcacagcagggacacctggacagtcctcgctccatcctgtcagagtgtaaagctctttctgtgaatccctgctctgactctggcaactgggtgccatgttttctttgctctgtacttggcaagtcaccatggctccttcaggacctggtcatctgccagccatctccctggccttggattgactgcggaagagttttgtgaggcttgtgtttcttcccctattatcaaggcaaagctctgctgcttctgttccctccctccatagactccaggactcctgaagccttttgtctctcctttttactcattcaaggctgctgttaacagggagaaaaagtttgtgacaattgaagtcacaattatagcacttgcctataacaagaccttggcatcttagtgctgtctctccttttatccatcacattagcagctttaaaacaaaaactaaaacaacaacaacaacaacaacaacaaaacagagcagaagtcacaatcttagtctcttgatgcttgacacatgtgaagatttccttatgacaagaatctattctggctaaatttctacagaaagacccaaaagatcatatgtttcagagccttttgggagtagggaatgtataaaaatctttgagcagcattctgaagaaatgtgttttatgtaaagtatcaccagaaatatattcttagggccaccgattctgcatctgcaatctcactagaagtccttgtctaaatggtgttcctatatgttgtacatgaggttaggaatacatggataatgccaggaatggatataggagaactgaacctttagcaagcatttgtttaccttgtagtaatggacaatgtgaattaacaattgctatatgtgggctgacgaaggacaaactataatcacatgtgaaactgcttggcctttataccgcttgatccaagtccatttctgttgtaaacagaagtgtggatgcttttgaggtcggatcaagctagaaacctcacgttttaatttgaaaaaaaaaaatcgtgacctttcatttagagattttataagattttcatagtataaaaatcctaggtgatatgtgacatatttgtatggcttaaaatgttaaatgtgtacatgattatatattgacattttgtcttgtattaataatcccttgttaacgttgctgtcacatattgatacctgagtcttttatctgaattctagcatcagtccagtgggaagacctaattccttttatagctatttgtttcataatgtggttccaagaaactatcatgggccccaagcaaggaccagctgtttaggggctcaggataatcgactagacgatataatcatcagaaggaaaagttaatttaatttgtttgaagactttcttgcagccacagagaatgccggattgatttttgttttactacatggaaaatgtgcaacatgttataggagaagaggcacatttgtagaataaattatcttctgtgtattacatcactaaattcaggagacttaaaaaatacctaagaaatttaagaggcattcgttgcatgtcaggtttacactgtggcttgcacggtcagcacaagaaaggcacataaacagattttatgtagttgtgctgggctattttatttataaactgtccccttgcctgtgatacaattttatctggtcctttctgactagaaactttgtagcgaggtgactcagctgtaaccctgtgcagcctcccctcattcacaaagaaaatcaattaatgaagggtggtgtctttgtaacttatgccatgtctctccattccactgtcacatagattcctccatagattttttaggcaacaggactccctagctctaatcctaattagagcaaattataaactttttctttttaactccaactttggcattaatcaagtccatttgcagatatttagccctgtgagatcatggctcccttttccttcatgtgagttagagttagctctgaggccatgcacattactcttatgctctgtcctctgtggtcttgcacgtttatatagatgtctctatggaagatcctcctacagatcctcctggaaccaactttctgtttcttagtttctagcttcttgcctcaattatctctattttagccttatattacactgccccatagaaatgcctggcacattatagatgtatgtatttggtgagtttttttcttcagtgaagacaggacccatatggtttataatttaatcctccttttcatgccgacttctacagtaccagtcacaaaatttggttctccagttaagagtgactcctcagctccttcttgctattccttacctattcttgatttatgcttggtattgttttttgtttcacagatatttatctgtacaaaacattctttgttttattacttaaatgttacagacttttttaaaaaaaagtatgtgcagttgtgagtgtttattactggttatcctgaagtacttgctaatgataattggtacaaagtttaggtttgcttagctcttaccctgccaatgagattaatgagcttaatgggtaaagcatctatactcttcaggacacttaggaaccaattctccctcctttcttataaggttagtaaactttggaatttcagaacaacgttttaagaggacatttttctgaatctcttttattttactgaaggcaataaaattcctgttctgtgggtctttgctaatagtaattagatttcaccaagtgagataggagattcttgtaaagttgtgtactcgtcccatttgattttatttgataagggcattactgattgtgtacttgacatcacagtgataggttattatgtgttttttcacccagtttgttcctttcaatcagagtgatgctacaggaaatgatgggagaaaatcatatactgggtgaatggccaaatgtcattctcattaagagttcttattcacattgtattcatgaagccaatgataaaactaataaatgttccctcagaagaattaatcctacagtttccagttcctacaaaagtaggagcataaacttagacagaatttctccaagggatatgggaagtgttacttggcagacctgttgattcagactttatctcatgaaaactagtaaagaataatatggtgagtgtgagtactaaaactgttttagttttgataactgtatttaaggagcactaggtggttcggatacgggactgaatcagactttagaaatgggatattgtgcagcagtttaacgggaagccattatgttatagagattgtgaaataaatgaattgttaaaaataattttactgttcaatggggcatagtgattattgcaggataatgactttctattggcaatgtaagcagttaatgtaattgtgatggtctctgttgcctcctgcctatagaccctgtcctcaaagaggttgccatcataagcatttgttaaagttttaacttcttttacataaacctcacttaatggccccttcactttcttttcatttatatatttcttctcatgtagaaaagatgctttttcctgctcaataatgtatggcccttggaatttagtggcaaatgtgctttaatttaaatcatcatcatcatcaatttaacaggcacctctggtaatatgtttttcacttttaaaaagtgtgtcatgaagcaaaatgtgtttctgtggggaacaggaatgattataagataatcacggacccggagggtatagagatgggaaaggtgcaagccaatgtatctcttcctttgacataatgattatttcataataactgagtgcctcattccagtcttctctgccagcaccatccaatttctccattccattctaccagactgagacaggaataatagaatttttgtgctaaaatataatgcaggtgattctatgatggttcagtatatattttagctgaaccgtgcatttccttataagaagtaagaatggcccattaacagatggagttgaaataatagagaaaataagttcttccaccctttgctgggctatccctgagttgatttgccaggattcttgtttaagagaactgcagtttgtgacatgacagtggtgtgtgtgtgtgtgtgtgtgtgtgtgtgtgtgagagagagagagagagagagagagagagtcttggggacaatttctccctatgagatcctggcttgtgttgaactcatgatcttatcgccttggactcctgagtgctcaatgcccaacttttcaagagtagttttcactgttccttttagaaggtgtagtttactttattaacctttccaagcaagatgctttctacattattaatacaaagaaaagcaactgttaggtacagagttatgtggttttcaaagagcgtaagtttgaggaccaagtctagatataatgaaatctcagctgcgtcttgctctgtgtatacttacttatttcgtccagtctcacatttgtttagaaatgctagaggctccgtcttgcagatacatgcatactgaactttcatgaatctttcttcccttggacgtcctattctgactttggttggagtatttggggtgggtaaaggaggggtagattaaggtagctgctaatggctttatggaagagacccaggccttgctgttctgttctgggataatgtgattgactccagctttctgacctatgtcagggaggactgtttcttgtcagccagctggaggcctctggtgagtgcagtgcatatgagcccctcactgaagccatgaccctgtcagtaggaaattacagatttattgagtctcttcaaacagatcgcatgattgcatgtccttctctaaggaacacagtttagggttcaaaaggcttgtgaggtaaagtcactagagtcacacaaggggccagcctttgtgtgtggaggttgaagtgtcacagctggaaatccagtttacactaacagtcaaccttaaaggtgcctcttttagctaggtatgtaaaatggtttcaggttatcatgtttattaattgtatacccagctgattttgaatctcacactttccgtatccagctgcctcccttagcttctcttttcaccttgctgatgggcatgcaaaactaaaagaatgaaggttttcttctcaccctgtacacacccagaaacacattgattttaaattatacaccaccaaaacctagtttgggtgaagtaataaataaattaggaacagtggaaggaacataaagcaatccatattttattgatactcctggtgatttcccttcttggcctatgggttgaaaagtgaattccagtttttgactgatgaaaaagtagtagtgtgtgcttttccagcagatacccagcaggttttgtggcccttctagtagtccaccgttgatgctgacttcctactctccagctgtatattattgtgtatacattttgtttctgcttatttgtggaatttaaatatgaaagttcacatgtagttgactatgatgttatacatcgagaacataatattaaatataaaatgtttcattatgctgttttgcatatcatgtttttattaattctttgagaatttcatatatatatatatatatattcatattcactttttatttcctccctagcttctcccagattcatctctacacctctcaaccttgttccttattttctttttagaaataagctactgagtccaatatctgctctctgtttagttttggtacaggacttccactgggatgtgttcggtctagcaagaaccatattgagaaagttgtctgactatctttcaaaccatcaactgtcaacagctacagccaggggtagaggcatatgaccctcttgctcttctatgctggaagactgtctgacttgatcttgcctaggtagccatagctgctctgattttactcaggaacacagtgatcctgtcatattacaagacacgatatcccttctatcctcctcatgctctggctgttaaactccttccacttccttttctgaaacagacccgagccttgcagggtgggatacagacatcccatttgctgagccctccagagatacttactctcatcaagaaaaagttcttggataagccctgagaggtgttctcatctataagtatagagatacagatttagtttgtagtttgaattatgttcaattagcaaaataatagtagtaactttacccatcaggtccttcgaattctctaatgatgaagtagattaaccataccaggtgtacattttctcctctgaaataaaccttaattgtaagcagaaagtgtttggttgcccgtataacattgctgctactattgcattcatgggtatgccttaccacacaggtcattgttttagctcacaggtttcatagttggtcaacattattgatttctgttttcccctaagcagtcaacatagcaccttttgttaccatgaaaattagccagcagcgatatgcaactattactttttaaaaagtgagatgtaattttcacttgtatttttcagaaaattttcctcaaattttttctcctgtgttttcttttgcattttatggcttacttgctcccctatggaagctctatcagttggacttgcttagaaatgttttgaggagatacataaaactttctgagttgatagtcaagctagcacttacttgtttctgatagtataagcctattgtgaatttttcccattccctcttttgtgtcgactcccttgtactaatagatgtgttgctttctgtgtggaagatgcaggattataattttagaagaccttttagctattatggacagcatttgagtttatgagaggagcaccgcatagattgagaccctttgttcagcagatgcacaggtgtcagcagcacaactaagatacaacatctgtgcctgcataggtagcttatctgagagtatgcagtcttaaccctgaatgatgggtggcaatgggatgcttggttaatgccttctgtgtaatgagctgtgtacactcattacctataatagtctctacagtttggataatgatgtattattatttctcagtttcaagactttgtcttctgcaccttcagccatatttgatatttgatttgtttctacaattttgccatcctttgtgctaagaaaaggcgtctgccctattagtgcctcaggctactatggcaaaataccatgagtagggtaactgataaacaacagcgatttgtttctcacagttctgggaggtgaaaagtgccagaccagtgtccacaagccagtgccttctagatctgttttctgactcatgggagaactgcctccccatgtcttcatataggcaggcgtgaggcgtatctggagcctcatctgcaaaggcaggaatcttagtcctgcctcctaactacctccccaaatcccaaagacctcaccttctgacacatcacttcaacttttaaattctgaacagacaaatactcagcccacagcccatatggccccttttacatgattttatggctttcagatgccctctgaaggatccagtgagtattggattacttccgagattatcaggtccctttttgtttgcctttgagctcaagggagcagaactgaagagtgctaccaaggatgaatctgtgtgtagctgatgctgttcaatcagtatggtatcaagctattaatgtgtttaaatcctagaactacctcttttttgccgtgtttccttggaaatctaagcatctatatcttcagtgcttctctacactgagtgacaccgatgtccatctgaattaatgttttaaagcagttatgatgagttgtgtgtgtatatgtgtgtgtgtgtgtgagagagagagagagaaagagagagagagagagagagaaagagagagagagtaacaattattaatgtgttagtaaatgagtgacaataatgtatgatgcttactttaatagttaactttcctggacactgaaagttgagtctgtgttagcagagtttgctgctctgctcaacaggtatatgcatattagccacagctttaatagtagtcaaattgttcctaactatggaggttgtcctaatacgtttgatgctgaccacttggctgcaagagactttcagcatgctcacgtgttggcttttaggtgaacgtgtcaatttttctcagcattggttgttcatttttagcatctgtaaggtgttagtattagtgagtgttttacctaccccggtgtctttccttgagaatcaaatgaactaatgtacattaaagtactttgtaaactctcaatgcttctctaaagtggctgcagtgtcactgttaatgacagagacatgttcatttaagcacattattatggtactttgcattgcatttggtttaaatctatgctggaataatgcccacatgaaaataataggaatacacatgctcacacatgcgcgagcacacacacacacacacacacacacacacacacacacacacacacacacacactttgttagcactggcatctcttctaagtcatatatcctttgtgcatatttgggtgtcttctggaggtagcaggctgtagccaggactggcctgccatgaaatggcccatttgttgtctaaaattgctttagaatataaaatactaacactttcctccttttggatttatgaccccagtttcaaaatcatgaaaagatgcaagagctcacctttgattttaaaatggaagagtatttcatgctgtaagattcatttcctaaagtagatacttcattcaaatgttgaaatgtattcaaatattcaatattcaatattcaaatattgaaatgtaagtcacaaaggagaagggagacattaccatagcttctatgcttacactgattttccaaaatattggagagcttgtctgctgctggggaagggttggttttttgttttgttttgttttttccttctatttctccagtaagtacctccatagcctgttagtggctctaattttttcaagttacagaacttaattctttcctcatgattgttattctgttatttggatcatcaaatatatttcaaaagagctcacagaaggtgaaaaatgtaggattacaaaatgcaaatattgattattatttcctattttaaattaggaatcttaaacatattttccaaagagagagatgctctgttttgaagcatcatggtttttattttcacatgaaaagtgtggttgtattctgtaatttaatcgagtttcgcacactgaatctagggagaaaacatgttggaactggatataacattggggtatcaacaattctgggttggagtataactttggtgctgtgtaatttgtcatccataaaaattgtgatggcatccaaacctggaaagtaatatttgacagttatagcaagccatatagccttatccacacaaagcatgcttggtcgcttctgtcatttgcacatgtggacaagcttgtttcgggctgagtaactcttcgtattgtatcctggacttagtcaagtgactcttgctgttaatgccatgaagtaattagtccatgaaagggtctagcttgaaactgtccttaaaattagacttgactcttctggaacttgtgttatgtgaaaaaatttcaataacaaaccagttgctccttttccctgttgattgcactatctttgatgcacttacaaatgctattccatgagcctgcggacatttgtatttcagaggttcttgtgcttcgggatagccaattactatagttatttatttgttgattcaagctaaattaaattttagaagctagacatagtgctgggtcaagagggagaaaacaagagaccgttgctagccatgatcaggataaaataccacgtagtgatgccagcttgtaactagagagaaagatggagaagctagcagaaagtaaatcagcttggtcattttggtcaaaataaaattttcagatttttagatgattttgtaattaaataaacacttttgcaagtggctttaatgatacccagtccccccaccaatgtctctcagtgtttcagatacatgccttggtatcagttgtctttcagctttataaacattgtcatgcaacctacctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcctattcctcggaataagcttctttaactcataattcaaattatatccctcttctgacatatacctgtactgcaacattggcaacattatctaagctattaaaaaaaaaaaaacttaactctgtgtgtgtgtgtgtcctgtataagtgcagttgtgagtgtggagagcaaacctggtcatcctccctttccacctcatttaaacaaggttccttgtggtttacctctttgtatgccaggctaactagcctggttgttttcagggattctactgtttacccttccatctcaccataggggcatgacaattacagatatatgttattctgtcagctgtatatgggttctgggactgtctctgtacgtccttatgctgtatcagtacctttcacattgacttaccaccaccaatctgcaaagaaactttggaggaagccatgtcatcaaatgtaatatgcagaggatatgcatatactctgtaggccaagaaagattttctaaactatatcaatgatatattgattcatggttataaacatttaaatacagtaacctataaaatttttctgtctaggtgactattgtaaggttctgtgaccttaagaccttcttcaatgaaataaaagccatcttattcattgctttttcctacatgcagcatggagaatgaaaggcattgtatgaatgagtctctttcctttttaacttcataagctataacttctagtgctaaaaagtaatgtcactaggaagtttataatcttttcctgaggattatgactttcacataaatgaatgaaaattgaaaatgcactgaatcattcttggaaaatatatttccaacttctctctctctttctctttttttcttctattctcaaggatttatttgaaagggtctattttatttttatggaaagaaagagaattcaaacttttaggaacacagcccatgaccttctttattcaactactgcaagtttgtttcacataatgaaaccattgcagaaatacagccaacctgatagtaaactacagatttgcccgcctttctccctagggatgggcttggtcaggtgtgtccctctggcctatatctatgtgaactcagtagtatgtgaacagtaacacgtaatgtttcagtttctccaatgacttttcagagagctttcctctccatacaggttgtccacaagctgtccagatctaccagactcttacaccttagcgcttccactgtggtgtgtgtttccatggtggtcagtattcttggcagtgtcattgcaattgtaaaagaagtctcatgctgggaactcagcctattaattggagcctagaactctgagctgccatgtctatttctcaatctgccatacagcagttatctttttacttgctccatcatgtgagttacctgttagaatccatatgtccgtctctgagttcctgtgttgcctttttagagatctgtaccattactctgtttcctcatagcttctacggctccttctccatgcagggcattttctgtgatacattctctgtagttggatgtttttcataagcctcttattttcccctcatgttgttagcctcttatacactattagatactgggtatgaatagttgtcttctatgcaggtataaatgctatgccaaaatgacaggagataaactcagattttaattccatgtttatcctttttaccttttacaggtgccttggatttttgttatcagttatatctgctataagcatgggcattgttaaaagaagcaaagtacagctattagctaattagactgcatgattaaccttgagatttcattgagatattttgaccttttcagtgtagtcaaatggagggtgtaattattaccgtgtttccacttagtcctgtttatcaatctttattaaaatatttcaaacactttcatgaagctaatttccatctttcagaataaaataaaaagtatggtgctttaaatatgctactaaaaaataaaactggacactttagtattaaggaggggatttttattttttcactactcctggctccatgtgagtcctcagattatattgtttaaatcattcttaatcctaattgatttctagggaaaacatattctactcattatccgttgccacaaggtcattgatgagctcctaagcagctaagtgtaaatctgcttccaggtcagtctcgcagttctgagagctgagactctgaacgaggctagtccagtcagctgggttgtttttgatgatctgcactatggtgactattaaagatgaacttaactgccctatcggtaaaaactaaattaagctttttaagtgaagggcacagaaagctgtcatttgattccccagactttaccctctttctcttacagggaaagtttatatttaaaccacaaattaaatctaaataaattctctgtagaatatttaggtattcatcttaagaatttaccttattttccaatttgggatttgaaaggcatttaaaactgctggacttagtggagcacacctttaatcccagcactctagagatacaggcaggtggagttctctgggtctgtggccagcttgctctctgtagagagttactagacagcccgagctatatagagagactccacttcactcaagaaaaaaaaaaaaatcaaataacaggtaggtcaactgagaaacctagtctggtagatagaaatatctgtatggtccacagtaaataaataaagtaaagcagccatataatctagaactcctttgcttgtggtccacaatggaagggcagtatttgtttccttgcaggctgcctgaagcctgtgcatgagtaagtatgcttgttgttaatgcacttttgattttgccaataagctttcaatcctgcaatcttcctgttgctactacactgactgtttttggttgcagatcaatcacatcctctcttttgtaaacctatcaaaggcattgctgttctgtaaggagaaagggcagacccaccagtgtcgctgcaagacaaggcccatcttctgaccactgttctctgtttagtttatcgtttgcactaactgttaggacatcctgttgtcagtctttcagaaatgggcctgatttggtagatgatgcccctcacgccctttctttgcttcaagttttaacattctgacctggaatcatttgcaatcagtgctttccaagtagaaaatcattagtgactccctcccaggtcccatgccattgctcacatgttcatagatgggtgccttctggtgattgttctctatgtgcctcctgcctgaaatatgtaccttctggtcactgtgacttactgtacttagaaatatttttcagaaaggactgctgcaaaggactgtcacttcctcagaagctttttgtttctcactaggtggacacattttctgactcctttgaactctgttatcctctgaccttgtttaacaccaacctctatgtgtaagattgctgaatatgtttttgtcttctgccacactgtgactctcttggggacaggaatcaaatggtagttattaaaattttagaattcataaatgttcaggtaaattaatatataggccatccatgcctgtatttttgttgtagctgggtatctaatgaagagactgcaacttctcattcggcttctcctctgctgattggagcacagtctagatgggtggtgcatcatcgcctatgtgggcatcacagcatttccgaaccattcccagtgtcctattgcctgtaggtcagaggactacatcttgagagaatttgctctgctttctcgcatgattctccaccttcagcatctatactatgtattgttacttgcccatgtacagtatcaatgcaaaggtgcagtaggttaaatatttcctgaagacactgggaattgcctctgatctccacaagtagtctatttctttgaggtaccagaaaggaagtaggtatgtttctgctctttgtatatgtcattaaactatgcaggtagtcaatgtggtatttctcactttcccttacttccgtttaaatcctaccagtaaaattaaggatttctatcctttggtctttcacccaccagatttaatctacaacctttgtttcatgtagctttcacaactaatctatgaaccagtctcagtctcatatttttggtagattcttttaagtctttgtagttgtatgagcagaggcaaggcatgttttaccttcactattataatttcttaaaccttctgccactcatatgtctactttattcgttgccataggctagttgtatttatcacaaaggatgctggctttgtgggccattctgttcttgtttggattgatcccttcatgaatctaaatattataaatagcaacatttcctttgattttaaaacatttatttctaagattaaaagtcaggatttgttccacacaaaaactatcagcatacctctaagaaattaatttaatcataatcataactgttgtaccttcatggtttttccaagattctaattgttttttgagagagaatcttgctatatagtcctggctgtcttggaacttgcaatgtagaccaggttgacctcaaactgaatgaaacctgcctgcttttgcctactagtgcttagattaagggcatgtatgagcaagctaggcttccaaattcttaaattcttaattctgtatgttgctgatttatgagatatgagcctatcagatatttatttcaatattttgcaaagaaggaaacgagccatgcatttttagtttattcatcttaaaaggcttccttaattaaaagtcaatacaaagtccacaagtgtgcttttgggtttacccttcatgtttttaaacgctaaaatcctggaaagcttcccgttacatttcctttgtcaaaatggtgtagaatgaattgtttactgcttcttatggttttgaactttgaatagtcctttggatagctttaaactccaacatcattaattatataattgtgtttaaattatttaataattatagtcaagaatgctactttccttgatgattgtatactcagaataaagtagaaagataatttttctatccttaatttcaactaacaataggtactctagctattctgtgaagttttgtaaaaacctatccttaccaaaatcataatttaattctagtgaagtaaaactgacagtaccatggatattatttaattcttaaagccgtatctttttttttttttacactatcgtattctttacaggtgttccctctccccccacccccagacagagtttcagtatacagacctcagtcttgggtcattctcctgcttctttcttgcccagtgttagtgtgcaccaccacaacaaactcctcctaactggttgtgataaaacgattgactattggtatgcttgactctgctgtgatgggatgagtttagcttgtgtgttaccttcagttacagcccatcacctagtttacttaaagcttacctttcctccttgtgcatgtaattctatggattccacatgaaaataggtatttacctatgacagcacatgttgaacttctttttttttttttcttaactgaatcatatggttctacattgaggcccatgagacatgagaatcacttaaaattagcagacagcaggcttgctgtgtagcaaaataagctttttttttttcagatatagttgtgtgagaatagtgatatacttctgctatgtgtaagattggactgttggtgttaaaacttaaaaggttctacttgtagattgtaggaagacaaatggtgcatcttggcaagtgagggaaaatagtactgtaattcagtgttacggtgaaagaaatagaaaccttaaccagtcatcttttatttttagctcagacaagtacctataaaatatagcccagatggggaagctatgatagtaaagatacggaaatgacattttgctgatgaattttctcctgccctttacttcccatttttatttttatacaaaatcttttatgctgaaagttgcttgcttatgtgtccaaggacagatccacagaatgaacactgtctttttcctttttttcttttttcttttctttcttttttttttcctttttgtggtgtgttctgatcatgaattatttcagtatacatttatttatttatttatctatttatttattttggtagaaattcattccattctcctctgctaattgtcattctggttctttctgtattgcaaaactccaatctaaataaattaggatattctttgaatagtgtatcatatttcatgcttacttctgaatgtatcttgttttgtggttactagtttctttttgttgttgctgattgttttgatttagtgagacagccttaatatatcacctttggtggtcttaaactcactgtgtagacaagaatggtgtaggactcactatgtagacaaggattgcctggaactcactatatggaccagacaacactggactaaaatttactatgtagacaagggtggcctggaggttgctatgtaaacaatacttgcctatagctcactgtagacaatgatggcctgaaattcactatatagacaaggcaacacttactctatagacaaaactggcctgacgctcactatgcaaaaaaacattggcatatatttcattatgtagacaatactggcctgaaagtcacttggtagacagggatgacctgaaattcaatgtgtagacaatgtttgcctggaactcatatcctgcctgtgcgtcccaagtgatgaaattaagccctggctagctctttaggtttgttttctgagtgcatcttttgcaggctccacctgcccatttgcctactgaagctgtaactgcctctacatatatcaaaacgttgatacagtttgttcagtggtctctaatctcaggcagtgtcaccatgattatgccttgaattgaagtgagaaaggaacccaggaaggatacataatgattgagatgtgagaaatgcacagtgtggttgtgtgatctgtaatgcactgagaggtgcctctccagtcttagagcctcctgcactacctcttctgcttctcatcatccttgtattctggttcttcttatgatacatcagtctcctgaggaggtcatggaatggatccctgatgccttgtaaactgtatatgatttctttgacagcctaaaattcactatatagataatactatcctcccagtggccacatgaagtaggcactaggatttgaatggaagtcagttactcagcacggaggctctggcatttcaagctgctgcacatttgtcttgcatggatctttgtgtatgtatatgtgttgtgtttgtttgtgggtgtgtgtgtgtgtgcgtgcacacgcacatgcactcatatgtctgtgtgtgtttgcttataagcatgatagatatataaaataatctttgatatattcagggccccaatacaaaaacccttgacagaatgtagatgatactgtttcctcaaaggtatatttgtgataggaagaccgactgtgcagagaacccaaagacttgtatttatttcatgaatatcattaattttcaatggaagttttaagagctcttttcagaggtgaaaatcttgtacagaacactgtttatcacattgtgattaagaaatcatatctttgtgacctatattaactggtgatctatattaacttgagctgatacatactaaaatttaaaagtccgttggcatctttttttttaaagtgaaagatttggggaaggaacaattgacttaaataactaataagtatcatcatgaatgggaaacacttgagcataagctgtaaaagtgattattgctgaatcacttaggtttttctcaagcctttgttgacactgttagtgacagccaattctctggctcacccgaagcccagcaatgcactgagcttccatgtttattgcagtgtgcagtctttggagggactttccttcaggcctttcctttaaacagtctgacatatcagagataaattctacttggcctttccacccctcagtagtcattattgtttcctgcattctgcctatagctttgactttcattgttttaataagtgttgaattgtttattgaggtgaggtggttctgtgcatacagttttaagtcacacaataaattcaaatcactattatactagatagatggatcaaaagaccaacaggtgataggatgagaggatgtgcactcagtgctgtgtgtaaagacaaaaaaatatatgatagcacataccctggttattactgtttggcccatcctagatccacacaatagagtgtttagttgactgtctctgaagccctgattatccccttcagactgttgcggtaaatttttccaacccaaatatgccctggcaatgaaaacacaactcagttaacatgaatacacgctgtgagactagattgggcagatctaccattacattaccatcttccacatctatgagaccccttagaacttgcggttactaaaggccctgtgcttctgctctgcttttcttcttcttcctcctcttccgtatcatctccctcttacattttctccttctcttcccaccttcctctccaccttcccttttatctgcccaatcatcagctctcctttattttacaaattaaggtgggaagcaggtttacaggaaatcacctgagtgctgactcattcctcgttttcagccactcacaggagaacagaattatcaaatataattagccccagggctatccacaacatcagacaattaaatattgatgggaagtttgatagactagtctttctaaggaaaagtggatcgtaaatatatctaaaggaaaatcaccagttttgagtgttttatgcagagtcatgaaatgagaagggtgcccaacaatcaaaatgggaaaagctgagatgaagaaggaacaggatggctcaggggttaacagcacttactgcatttgctaagtagtttcagttcctcatgattatcatggctcacacctgcctggaaccccgattccagatctttctgctggcctctgaaaccacaggctcacctatgtagtccaaactcaatgcagtcaaacgcttatacatgtaggacaaaaggaaatcttaagaaaaataaatttggacttgattacctgccataaatgtttcctcgattcagttggcatttaatgagactacgttaattactctcccaagcagcttacacccaaggaatggcgctgtatttccatttccatgtacttaatatatgctattgtcaatccaggggcacatctcctttagatattaaacaaatggctaaaccaacagacaggaattgttaaaaattccttggtttcagagaacgtcaaggccttctcttgagttatttttacaagttggattcttagaagggagctattaccagagctagccagcaagctgaccacacatgccctgacaccttccactctactgttactttctgctaatctttagttgaaaagaagtgcaaactgatcctgggtctgtagttgctaccatggcagatgattggcatcaccttttcttctgtgtttgctcatctttacatgttcaggatgcatgctattcatagtagagggcagataagattgctcactgaggaaaggtctttgaaccaagcttgacaccacaagctccattctttttattttttctttttcttttatcgaaaatagttttcccctcatataatatagcctccttctctcagtttcttctcatctcccctcccatctggatccatcctttttctatctctcattagaaaagaaataggcttctaagaaataatgataaaataagatgaaacaaaagtaacactttagagtcagagaaaacagacaaaccaacagaaggaagagagctggagagaaggcacaagaaacagagacacagttttcaaaaatccaggaatcctatagacgctatactagaagccatattatatccacaaaagacctatcagataagacagaaaaaagacagaaggaaaaaaaagtataaataacataagattaaaaaaaaaagagagataaatttaaggggaaaacaaaagaaacagcctgactaggcagcatgagacaaagctaccacagacttcattttctattggctgtttactgctgggcatgccatggacctcattgtccattggctgtttactgctgggcgtgtttgtatacccactgtggctcgcttagagggaagtgatcttatgaatttcattctaaacaaaagggatggtctgcaaattttacacatatgcatatacacatgagcacatgacacccccccccccaaccacgcacatatacacacaaacacacatacacatatatacccgcgcacatgaacaaatgcataagctcagacacatacatacacaggtgcacacacatgtacacacacattcacacacactcacataaacaagtaaatgaaagtaatgattttttattttaaagaaaatatgcttaaaaagagactcaattcttgaatctttagtttccagttaagatactctacagaagatcctttggggcctatcagcagaaacggatgacttaccgtgttttaactattcaagggcaggaattatgttctcgtgattcctaaattagtgtggtaaaattatgtctaacggtctcaagggagcatcagtttattatgtcaacaaaattttatgctaggtaaaatgagctaaatacccaatcctgcctttccctaagctgcaaaagagttaactagaatccactgatattaggtcgtatctttctgctgcacactgatacatgttttcatctctgactaacaagaggattctaggggttctgccatgatgtacagagtatgaactgtcagtgccccaagtgaccttgtatttcactaaaggagctaaacaacaacaacaacaacaacaacaacaaatttagttttacagggactgaagaagtgagttggtagatatgggtaattgttgcacaagataggacctgagttttaatctttaccttctgtacagccacacacatggctatcgctcgagtggtatgtgtggtgagataggagatttgttaggcttttctgagaaacagctagctttggttaaatggatttttagaataattttacgttggacataactttctacctacaaatgctgcttcttctactatagtcatcccactcagatctcccagcatcctcttctactatagtcatcattcttagctatcccagcatcctcttctactgtagtcattacacttagctatcccagcattctctgagtaaacttcagtataccaagccatcattcttgtcaattcattatttcatattaaagtttgatcatattgtgattttcatatagttttaacattttaaataaattctttgtttatttttactgtagccattttgtgagggtgtttaatcaacagaaattatgctaacaagttataccacccggtacattttggcggatagttcttcatagctctcagcttcagtttgccctgtaatcacactagctacagtgttttcttccattttcttcttattccccttttctttctgacatttggtgaattctatactccaaatattgttccctttaaaaaaaagtgggaaaattaaggttctcctctaatcatacattctaaagtttctcgtcaattgaactgtacattcaatgttacatcattatccattctcactgtgatgtcctcaaatatttcctatcaagatgaatcatctccattaacatagaaccatgcttagggatttctcctcttaacaacacaaaacaaaacaaaacaaaacaaaacaaaacaaaacaaaacaaaactctcctttgatgtcatatgttcttagacccttcatttaattcctgtgtattcactcatgcttcttttagaaggtcaacaccttttctcctgtggtcaagtcccagaatggtttcagttctgctagctccatctcagccctctggcctccggggcacagaatgctttacagctcagtttgtccagtagttgaacagtattgattgtgatagcttccctgcttctttcaatccttgatctctctttttctccaaggtagagttgtccttttacatcttgtagttaatgctatctgtaaccttgtccttttccactcatctactttgttcccagaaattctgagacttaataattcataaataaatgtcgatccaaaaactttgtttgttccccagctagctcataacttaattatccatttattctattctaagtcctgccacatgactgataattttatcctcagtttgactttgtcctcagtttcatgtgaccatcttcttctgcgtctggagtgagtctccttcattcccggctctcttcccataaacccctctctctgctggatgccccaccttgtaatcccacattggccaataagcttttattgacaaatgaatgcttttgtacaatgtataagacatactctctacaacatccctacatatttatatctctttcaggttcttgaccttctcttcctctttaactcagtgccattgaggtagacagtacgggggaggtaggaagtcccagaagctcaggctttcaggggcaataatgctcaaattcatgtgaataattctagtattggggagctgaagcaggctgattttacatttgaggtgattctgtgatgtagagttgagtctagcctaccttgtaagacagtatctcaaaacaaaaatgaactactaatgtttatgtaatgaagcttacataaggaagagaagtcagcaatacaagagtgatttaaattgtttgtaagacggtagaatttgaagatcaacatccacacttaaatgattggactttgaaagtcttttgtgtgatgagagatatgagaaatattgactgttgaaaacttctgtggttaggagctttagtcacatttatatggatttcaaatgaccagtttgtcattatttcagtctgcccctttataaatgaaggcaatggctaattagtgcatttttcttttacactagcacagtttcctatttaaaagttcaaatcacaaaaccacagatttaagattgtgagagtaaagtgtcagattattttgtattctttggaaattgactgtgtgcttcatgttttgaagagagaagattaggaggaaatttgacatcgaagcatttgtctttaaaagatgccccccccccccatatcgctgcaatggcacttttcatatacgagtctctgtaggccaggatttgtgctgtttcatattcattatctcagttaatccttcacaaagctctgaggtagatattaatagttcctgctataggagaagaaactgaagtttaaattttatatgagctaaagctatataagttaatttatttaagttttttttatgattcgaagtgataattaaagaacgtgaattcaatatatatctgagttgggagcttgagcatttacggcaaggacatagtgaaggaaaattacgagtgaatgttattctcatttctctagtgctcgcagtatcttacatggcctttcatacattgtttcatcgttttccttataccattcagtcttcacagggatcttgctttttaagtggatcagaggtgtccaggtgaagaagctatacagcctcattttcagctagttgtttgaggtacacagaacaccaaaccgaccactagatgcaagcttgctaacaccaagtttggcaatcatgatgtgagatgtttcctcctctctattaattccatttgcaggaagataagattgtccttcttctgtagggaataccactttacactctcccactttaattcaattcatttatttagttaataatccaggaatgttgctggattagcagaaatgtgattagaatcatcaccttcagtatttcaggtaatggagtggaggagaaatagcacaaaaggcagaacccatgcaccccatttccagggtgcctccaaggacaggttcacactgacatctggcgtggcttctattgctctcctcttcctggaagccccagtcaaccacttgacacccagcattagctctgacccgaagatcagcctcagcaagctacataattaaactgttgggatttgtttcccctgactggacagaagagcctcccaaggtgaggactgtgaagtgataatgctgattctgactttaggagggaaggaacacgagcgcagaaatctcttgaagcttctgttaatgaggcacagacggtacttagtagagaaaatgaggttactagaaagaaaacttacccttttcccctctttgataaagagccaatcattgcgccttcttttgaatccaggcctaaatttattgtcctgaataaacctcattttaattaaacaaataagtttttctcaagggtgtagtaatcttgcttaaagtcacatttaaggggaacgaggaaagttagagtattaagaagtagcactaagctgtgtcttgagaagttgaaatccttgaattggttccgacaaccacaaactgaaatagctacaatgattagccgtttgggatcctgtgctttatttgttaaaatatgttttaagaagccagtattatgttttctttgaatacttactctccttgaaacattattcaagcaaatcaaacttattctcccaggatctaacttcactgccattgcatatagatactacaataatagtcatgatgaccatatactactatttaaatttgatcataaaagtgatattatacacctataatattcatgttgtgtgtgtggggggcttctgatctctgtgactttcggaagagttggggactaggacagcttaaggtcctagcatggccttccatgcttacaggccagccctgtgtctcggtgcctccatgaaacattatttaactgtttatattctgttttctatttcttaccaaactcacccctgttcatgtctcaaaccaatggagatgtgatgacattcatactaaatacatttgcttgaagaaagaatcatgtgcctgtgagggccccctctcaccttcactcccaattccgtgctcatgaattaactgtctttctctcctgaaaccttttttccctcatataagaccacattgtctttcagtttcgctccgttctagtgaattctatagtcacaaagaacacagtggaaacagagaagactgaccaggagaggttgtggctggagtggatgaaataaagaggaaccacatattcctgactattttttccccatttttattgacttttggcaggtgcagggatatggcaaatgaatggggtttcatgttaaaaactctgtcgttctgccccataatatctcatcagtgtactcattgaaatggcaaaaattttttaaacaatttaagtgtatttaaacgttagattttttttcaaagaaaactaaagcctaaactctatttcagtgaaatcccctggacctgttggcttcttcctgtcaggaagttatctgatgaacttaatggaaatccactccaggctgcagggcctggtgcagtatggctccctctgtctcttcctgttctgaactcattttaaaaatggagtagtggaaaagtatatagctatcttaatgtggctgtaggaagagtcactattccagttatgagggagaaacggtagctggaggccagtccatggtattgggaatcatctgggctctccagtttgtgtctattagatggacagatagctgctgtgttctgatcattgtaactcagctgatttaccaatcagtgttttgccagtgctgacatggccaagcctcctgggatctctttttccctagccaccaggcctgggtccagctctgttagaattcctgctggctcccttgtcagccttgacttccatggcagtgctttcttctctccccttctcttcccttcccttctcttctctgcccttttagtctgccatcttgccatcatgttagctcttagctcatttccttgcagttcagttcccttctcttctgacttacccattcttcctcagagctgtccagttatacatagctaagcactctccccctgtaggtgtcacagggaagtcagatttgaaatagtaaaatgtatttggtagtgaccttgaccttcaagtttgtgtacagtcctttattactgctctgacttggttcccatccgtcagccagtagcctacactaaaagccattgacttcatctgtgtttctccacacctcctgaatcagcatctctgtcctgcctgtttcaatataattattatcttttccctttggttatcatttaaattctatcatacctactagaaactgcctgtttgctccttttggatagtctcccacctaataaccatgtttttccattagcctcattttatattacattgttactttaaacataaactcccatagcatttcctaaagtggttttcagaataattcacaaataatctatttaattccatgaataaaggagtcaagtagaacattgaattgctgaatactaaatctgtttttttttcttggaaaattgttgtaccacacattattttaagagaaatgactgaatacaattttgttaaatataatgtgtgtgtgtgtgtgtgtgtgtttgtgtttgtgtgtgtgtgtgcagggtggggggattggtgtgggtgtgtgtgttgactagagcaacaaaactctacaacagagcctctataatttttttttcctgaaaactgataatttgggacttttgacaggttagtgtcctgagctaattggcaaattatcacaaagtatcacaaaatcttgcaatacttgctagtacgtgcttaagcatattggaactttgtgaacacagcagtttagttactatgcaaactctactatggttatatgcagatggcttaagaaatcaaagtctagataaggtatagctaaaagtttctaggagaaaaaaaatcggattttcttttagggcgttataactatcatctactgtggacattctttaaaagtgactgttgtaaatgttttctatttcttcctgacaggtaatatttgaagctgaagtctcaggagggagaagtggttatattgccattgatgacatccaagtcctgagttatccttgcggtaggttttgattaagagttgtatttttctgtgtccttttaacacatggccaggactggcagaggctgttgatcgtttattgcctggccattgttggccattttgttgttattcccagccttcctggaatagaacaccaaaatgcttagtagaattttcaaatcaaggatttttcagacttccaacgacatgcatgataggattctttcatttctttttgattagtgaaaacaaaaatgtaagtgcaaacttcattccagtcagatgttttaagctgttgaggtatcttataattctataggggaaaaaaataaacaaaaaacaaggaacaaatctgagttcaataacagagcaagcaaacgctgccttgtatttgatctgctaagtttatactggaagaaatgaagaaaatgaatttactcaactcattctgaatttaggtctgcatttttttattattattccaaatgtctgagttaatcagtattaaataaatgacctcaaattcagtctgggttaattgactccatcttgtgaggtccttgttcaagcactcattgtttctcagacttcatacttaaaattgtgcttaaccacatcccccaaaacgactatcgctatcattcagtagggtcaggcagaatttacagacagcagtttacacttccttcatgatatgatttcccagcagaaaaatgtgataagtcctgtgtaagaggacttcgtgttccatagtcctccatggtgagccatttctaatgcactgaaaaaaaaaggatttatgatgtcagcatgttgggagcaagctttgtaccgcaactgagtggttatatcatgataacagagaacacttaggctggctcctttctggataattgtgtctagactggggcctgtgtgtgatatgcgtggaacggtcacaacctgatcctgctccaagttcaagttagcttagtaagcttgtttattccacagtgcaactgaactttatatctctccgccttccatgtctacacctcatgtatcagatgacaaggaaaggcttttgtgaatcaagaaattgatggtcatgaattgggcagaacagtcgccgttccagggtgattggtctcttgaagatgtttctcattgttcatattcaccaaggcttaacttggcctgtgtgtatttttcttcaatggtaaacacttgacgggacttcagattcagaaggaaatttgtaccaagtactgattggacagtcaaatcacccatgcgaaactatgtgactacagacatctcctttgttgctctgatcattctttggataactttcccatggctataagcaaacaggaaggagatactccttttcttttaataaacaaaaatgtcttctctgatgtacagctgttaaggttttttaaaaaactgaaagaacggtcagcttgtgggtgtgtagttaaatgtccccatagctgtcagagtgtgagatgtctttatatgcaccaactctgtttcccattagactctgatcggaacttgtttcatcaagcctgcttactttgatataactgttattactatgcattaacctatgctatggcagctattagaatatgcgtactagctctgcagagtcactctgcatcgatccatctcgaaaaggatgagttactttgtatgagacctgttaagaaggaaaactgtgagtgtaaggtaggaagcagcgtggtctagaagaaaggaacgtcaagttctttctggatattaatcttaagggtaggcttattaagaatgatattcttttgtgacaattagcatggcatgtcttttcttgtgaacaaaacatgcatttcccacccacccccctttttttaaacagataaatctcctcattttctccgccttggtgatgtggaggtcaatgctgggcagaatgctacatttcagtgcattgctacagggagagatgctgtgcataacaagttatggctgcaggtaaggccctgtgagctgctgagctaaagggatcacttggtttaaaaaacactgcattgtttgtggttgtgacttttctctctcttctccccgtttctgtcccatgcacaagggcaggctatttgtatgcgtttgtttggatgactggagattttaaacacacccttcacttttaaataatccaactaaaaatgcatgtaactaattgatactggccttggggtctagtaacactcagtgattccctagtgtcaggctggaactctaaagaaaaattctctggatactttggaaaagcagtaaaaatgaaaatttccttccttccttccttcctttcttctttctcccccccccccctctctttcttttcttttcctttttttttttttttttgttgtttcttttttgttgttgttgttttttcgagacagggtttcccctgtgtagccctggctgtcctggaactcactttgtagaccaggctggcctcgaacacagaaatccgcctgcctctgcctccagagtgctgggattaaaggcgtgggccaccacgccccgcgcaaaagttttcttaataaatattttgaaaagtgaacttctaagaagataatatttatgtgggaactgccagacatttttaggataagaaactaccatggacacacacacacacagagggggagagagagagagagagagagagagagagagagagagagagagagagagaatgaatgaatggaagagaaacaatgtaaaggtttctttgtttttgtttcttttgttcttttctttttttctttctcttttttagaagtttgtgtataagagttgctagtagatctcacatttgagtatctcccttgtatatgttaagtccttaatacctccttatttaattgattataattgacatagacgttgttggagaaatgtatatgtcatgaagcttccagggcatcagagaaaaatctgtagaattgagaattgttttgccctcgtagaacgtgttaaaggtgttgctgtcactgttaggtgctggaaagagggtcacggtgcaaagtgtgtgccaagtgcattcctaaccccagaagactggagctaggaaagttgcctgtttagctgactgtttcaaggcaatttttttttaacaatgtctttagcatctagacttccatttttcttctctgtgtgtggagtttaaataggtcgtgtgtagatgtcatgagaggtgcacatcggggatcttctttcattgttgtctacattgttttgagaggagatttcccattgaccctgggaaagctttcacagtgcctctgagctggaggtttgcctgcctttccctcttcagcactaggcatgtgctgccatagtcccctgtctgttggtgatttttacccacccctgacctgttagtagcctgtttctttctgcatcacggtaaggaaaaggctttagtttctttagaattttaaatacctgagaatcccaggacatttctaaaagacaaacctttaaaggtcaagttagctttttgagcatggacatcatgatttacttttgctgcatccttcagaatagtgcagttagtgctaggggtccttattagcttccccgtatttagggatgatgcttctagtgcatcatcattaaaagcaaatttagtataatgtctccaatgatggttacagggattataagtgtcacctgattcctctttcagtccaatgagatatgaccagagatgtacctcacattacattagcccacaaatcactactttggtaatttatttgatttgtagttattataatactttctgtttggcccaaatttgaaaagaaaaaaaagtgttttttttttctcttgtcatgttaatttttcctacctatagtttttgggaattagaatatttgacccaagagcatattatataagctacagtctatttaatgctgaacccattttctcatactttcagtctgtgagtggtttaaattatttcaatcctatttcctcatttttttttatttattttttttttccaatgggaacgttggttgatatttggtcttagctctgagtctggtcagcccactcttcaggaagcagaaatggctcctcagccagccactggttttatgctccaggatttaatgtgacattgagataaaaagggtctgtatccgaagacaccagctggcttgtggcaacaaagcccttctggaccgtgctggtctgagtaggctgccgagaaaacactgctcattttttctcgtttcctttccctgtggattggctcatttttattatggtcttttgatattccttctgccattttctgagcagtgctgggagaaaatgctctcagagagttttactctgtttctctctcccctccttggagtctcggcattggctgcacaaggtgattttgtgtttgtttccaacgttgacatggttgtcacatggtccccagcctgcacattgcatggtctccagcactgcacaagtttaccttgctactttctcaataatgccacataaatttccttaatatttttttgtcaaaaattcttctttacactccaaaaagatattaaaatataccatttacttagtttagtcatgttttcataaaaacatttttaattaaaaaacttatatgtgtgttaacctttgtcattttttgagacaggtctcagtgtattgccctgcctttcctaaacctcactgtgtaaatcaggctggccttgagctcacagaaatttgccttcctgggcttcattagtgcagggattaaaggcctacacaggcttattttgcctttttgtatgctgtggatcacattcatacttggttctgcaagccaccagaagagggaatctctgggattggagttataagatagatcaatgtcagctgttatgtgtgtgctggacattgaacgcagtttctcaggaagagcgatagtgttcttaaccactgagccatctgttcagtccctgaaataaaacataaaacattttcgtagtggcgatagatagcaattaatcacattggactgactgttccttacatgtgtatgagacaaccaaaaactgattattacttcaaaaactattcatcctttgcccaaagtcgtaaaaccacaggtaaacaggaagaactgtggtcccaccatggatgcctctactcagtcgttgaaacaggtaccaaattatttttatttcctatagaggacaacatgcgaggggtcgggatcctcaactctgactgcatttctacccttttggaacctagttaatcgtgacaggcttagatttcattggcccatctgggcctgtatttccttatctagaaaagaagatgtttggtggaaactaaaatcccttccacctatcacatgttaaattagggctctatattatttgtgtggatctgaaacatgaccttaatgacctccttttatttgatgaaataatgtagaaattttaggctattagttttatatgaaaagaaaggagctcttaaattaactttcattgtaagaacaagtacggaaaatgtctgcccagagtccgaagaaggaatgtacttgaatccactcagttaaaggtttcccattctgtcagaggaagtggaagagtaatagggcaactaccatgtaatagtaatagtaatagtaatagtaatagtaatagtaatagtaatagcaatagcaatagcaatagcaataccaaaagcaatagtaatggtaatagtaatggtaattgtaacggtaatggtaatagtaataaatagtaatagtattagtaatagtgctctaccatgggacaggtgtaataataagtgatggacatcctcctaggtcctccacacgatcacttggtagtgcctcagttagcagaatggcttgatatgggctaaagtaacaaaagctacagtggcttccaatactcaaatggaaagaaaaactacttgccacacccctccctgaaaggtctttacctgattcctcatcatagttgtcctttcccgagttcccgtgttcaagtacacctgaagcacacgtttttcctctacgtgtagtttgcaggttgtgctgctcatttcatctcagtggggatgcctgttaggtggattgagaggtgatggagaacataggatgttcagagatattaaactaacccacaacacttcgcaacctcgctcatgagggatttagatagttaggtaattaaannnnnnnnnnnnnnnnnnnntaaccagaaccacagaatcttcacaatcaaaacagcaatggccctgaaaagagtctttaattttccctctgaaatttcacaagccaggcctccatcttctgcactgttttcaacattatcttacaagctcctacacaacatctgacagagctcttaacactgaatggatcttctggcccaaagttccaaagtccttccatagtcctccccaaaacatggcctggttgtcacaggaataccccacttctggtaccaatttgtcttagtcagggtttctattcctgcacaaacatcatgaccaagaagcaagttggggaggaaagggtttatttggcttgcacttccatgctgctgtttatcaccaaggaagtcaggactggaactcaagcaggtcaggaagcaggagctgatgcagaggccatggagggatgttctttactgacttgcttcccctggcttgctcagcctgctctcttatagaaccaagactaccagcccagagatggtcccacccacaaggggcctttcccccttgatcactaattgagaaaatgccttacagttggatctcatggaggcatttcctcaactgaagctcctttctctgtgataactccagctgtgtcaagttgacacaaaactagctagtacaccatctgcataggtttgaggctagcttagcatatgtgtcacttaactccaaaagggcagagagaatttaaaagccaccgaccaacatgctgcctctgcatctttttacatattgactcaagagatattaaggcacttcttaattaatatattaagaatgtctataacatatttattcataatatttaataacttaaaatttctaagtatccttaacaggagaatttatcaacaggttggtttgctttcaagcaataggatactgctctagtgtttaacagtaaaaacctgaactgctggtgtgtgtaacagtacacatgccatggattttacatgtatggaatgccaccaccatgtattttaaataggggacagaataaaattaattcagtacatatgatcacctttgcattaacttttgaacacagaaaatgaggagttaaaataatggcctttaggaaaacgaaaggctgaaggaaaggctatccagagactgccccacctggggatccatcccatatacagtcaccaaatgcagacactattgtggatgccataaagtgcctgctgacaggagcctgatataggctctgtcagagcctggcaaatacagatgtggatgctcgcagccaaacattagactgggcacagggttcccagtggaggagttagagaaaggactgaaggagctgaaggggtttgcaaccccatattaagaataacaatatcaaccaaacagacaccccagaggtcccaaggactaaaccactaaccaaggagtacatatggagggtcccatggctccagctgcatatgtagcagaggatggccttttggggtatcaatgggaagagaggccctttgtcctgtgaaggctagatgccccagggtaggggaatgccaggacaaggaaacaggagtgggtagatttgtggggggatagggggaggagaatgggataggggatttagggaggggaaaccaggaaagggggtaacatttgaaatgtaaataaagaaaatatccaataacaaaagtaaaacaaatattgaaaaataatggccttttcatgactttttaaacatttgtttattttatgtatatgactattttgcctgtatgtcgttatatgtataccatgtttatgcttggcatccatggaggtcagaagagagcattggatcccttggaactgtagtgacatacagttgtgagtcacattcttggtgctaggaagcaaattcaggtcccaattgcctttaagtgttgagccatttctccagccccaaatcctggtcatgtataggaaatgtgaactagactggcactgagcaactttctggggtgccatgatcatgaaagaacgtagatgaaactttgggtcagtgggtgtgctcctgtaatacaacagttaacacctgctcaatgctacagtatacattttaactaaagaaagaaaaatggggaatactgaacacaccacacttgcttttctagtgctccactcactgactgaactcatcatcatattgatggcaatgccccaatctttgtaaatcctgccacctaaaatggttccattatgctccaaggtaatttgtaaccattaatttcactaaaatataaaagaaggttgtccttggtattctgaggataccttataatttacgtatagaggagggttgaaacgggtcatcctgtcatgaataaatggcagttctttcatgaaggtccagtataagtggacagctacatggcaaatcaaatagagaccattgctggaacatctgtcagaccatatgctttggcttcaggttctgtgtaaaaccgaaacgctaatgacgccatccatcatcacagagcttggcaggcaggcatcgttgaactgggcatagaaattcatgagtggatttattgaatggagcgcaatacgtgcgttggtttggtggcaccatttgttttggtgagttcaaatgaggctgtgtaatatgttactggtaatcttatgcagactgtagtcagagccatggcaattgggccaatctgtcagtaatctctgcaggcactggcctggtgcctcttcagtggacctgccaaaactagagagtcagccaccgctttgcccttggtgagtgaggcacattgctgctaatgtcctgtgatacagtgagtttctcagccaaaggaaatgtcattccttatggagcaacagataatttaggcaatggcttgagagtagtaattggagagtgaaattagtaaaatgagatgcaaattgctttgcaaaacaactagagagaggctgacctcttcaagtcccagctgttgccagctgtgagtcaataaaagtggtggatttgaaacttctggtcatgtagtatttaaaatggtggctcagttgccacaaatgcctccctctactgcacatgaacatttacatgtaagtgaaaatatgagacctgagctttagaaaattgaggggtaaatatgaaaaatcttcacctgagcaactgcactcctgcccagtccaaatgcctatttgctttcagcggtttcccgaagcattgttgaaggctcctctccaccatcctaggaagtagttggaacttatagcataccccatttctagggattttactgttcatgatagatactatttcatttagagaaaatatcttgaattttagcattaattataatgagaaaagaaaagctttctgaagaaattgatcaacattaccatagcatagtttatattgcaaacttcatccagaaataacttgaagggtacttttcaaagctaacctgattgcatatgttaatacctggtcagttcactctataagacattggaaagggagaaatgcaatacattgaaaagagtctgggaggtcagaagtttcaaacttctgacatttatagataattgatttgtaaactctcgagatgtgcatctgaaacactagaatagcaaagatagcaatgtagttattaagacaggaagtaaatatgaaaaacggatgtcagaatgattacaaggatatctatgctgattctattacctagctatttccaataaagcatcagtgaagatgtatgtgcatgcatctctatagaaggatggagaatcctttgtgtatgtgtccaggagcagcatggctgtatcatatgnnnnnnnnnnnnnnnnnnnntaatggtaattgtaacggtaatggtaatagtaataaatagtaatagtattagtaatagtgctctaccatgggacaggtgtaataataagtgatggacatcctcctaggtcctccacacgatcacttggtagtgcctcagttagcagaatggcttgatatgggctaaagtaacaaaagctacagtggcttccaatactcaaatggaaagaaaaactacttgccacacccctccctgaaaggtctttacctgattcctcatcatagttgtcctttcccgagttcccgtgttcaagtacacctgaagcacacgtttttcctctacgtgtagtttgcaggttgtgctgctcatttcatctcagtggggatgcctgttaggtggattgagaggtgatggagaacataggatgttcagagatattaaactaacccacaacacttcgcaacctcgctcatgagggatttagatagttaggtaattaaagattttgaggttatttgatgtttgaagatagttctgcattctagatatatagaaaattataaaaaatatgcagctcagacttacgtccttgtccacagtgaataaacccactgtccataatgcagtgtgtaggaatacttttggaaatggctgacagtgaacagaatagaagcagagtcaaattatgagcctttctgggagaaagtttttaaaatacgtattttcatatctataaaatatactttaagatattgtaaaggagacataggataacgcctgtcatcctttgtaaagcactttcctctcctttcaggaagcccagtgaactcacatgtactcgaggcttaaatgctaaacagttttggcaaattatcgacattaattttttgtacatgttttttattcccagcactatttaagcttttagttgtatttctaagaaactctcaattttagaaaattagtagttcacaataaaaggcttatgatcaggttacaagaatttagaatgacagtagaattttacatatatactgaaatcatttttgaatatcagcccgaatttgggagacaatacagggaatgtttatgtaggaaactaatatgaggttacatcttttataaattgatgttgttcatgtttcttttttgtgcttttttttaccccaagaaatataaatatcagttaaagtgattgagaagaaagtagataggacttgggtttattcagctcagttgatagagtggttgcctaaagtgtatgaggctctgagtctcaatattcagtaagcaagacaatgattagcaaattcaagtcaatctaggttaccatctgtcttagtcagggtttctattcctgcacaaacatcatgaccaagaagcaagttggggaggaaagggtttatttggcttgcacttccatactgctgtttatcaccaaggaagtcaggactggaactcaagcaggtcaggaagcaggagctgatgcagaggccatggagggatgttccttactggcttgcttcccctggcttgctcagcctgctctcttatagaaccaagactaccagcccagagatggtcccacccacaaggggcctttcccccttgatcactaattgagaaaatgccttacagttggatctcatggaggccttacctcaactgaagctcctttctctgtgataactccagctgtgtcaagttgacacaaaactagctagcacaattgaccccttgtcaacttgacacacaaacacatcactagtaagcctcaacccttacattcttattcatccccaaggtctaaataactttaaatgccccacagtctttacatattctaaaaatttcgatctctttaaaatatccatcttttnnnnnnnnnnnnnnnnnnnnaagtagttggaacttatagcataccccatttctagggattttactgttccatgatagatactatttcatttagagaaaatatcttgaattttagcattaattataatgagaaaagaaaagctttctgaagaaattgatcaacattaccatagcatagtttatattgcaaacttcatccagaaataacttgaagggtacttttcaaagctaacctgattgcatatgttaatacctggtcagttcactctataagacattggaaagggagaaatgcaatacattgaaaagagtctggaggtcagaagtttcaaacttctgacatttatagataattgatttgtaaactctcgagatgtgcatctgaaacactagaatagcaaagatagcaatgtagttattaagacaggaagtaaatatgaaaaacggatgtcagaatgattacaaggatatctatgctgattctattacctagctatttccaataaagcatcagtgaagatgtatgtgcatgcatctctatagaaggatggagaatcctttgtgtatgtgtccaggagcagcatggctgtatcatatggtcacttttagtgcctacagtcgatatggtggctaactgttctctttcccaacattctcatcagtagttgttatcatttgttttcttggtgctacctgttttggaagtttatggaagatgaagtgagatacgtaaactctcagcttttaggggttaatacaagcaccatataatttactctttatataaccccaaaatgtagtaatctggtcttaagttttaaagctctgtgttcaatcatatgaactgatttgaattctgagccctgtaattgtgggctgctgagacctgaacaagctgatgtaaagccgtgtccagagcctagggatccaggcatgttccaggatgttcatgctggagaacagggacctcaatcatttcagagaggaaagtaagcaccaaagactggggcattgggtgagatcattagagaaaccttggctcaagagctggaattcagcaaacacaagatgcacagaaaggaagatctgtaggctgttgctatagggttagaagacacaacacatccgttcggttgagtgaagtggagcagccatataagaaggatctcattgagagatcacggtgagaaaaggtggtaaataagatggatgatcaggtaaggacatgaacggaattggaagtagcaacagctgctgttggcaggactgacatcaggcaataaacgacacagactgggcagtgcagtcaaattggaaagtctgcgggaggcacagattaaagaagatgaatggttttggatccagtgggtaacagttaacagattttggggaaatgtgaatgctgtatagtataatcctctaagcctcaaggttttacttttatacttagcctgtttctcattttctggcttgaactaactggtcattagaaccattgattattttcattccttttctaccttcataatggccttcatacaaatgatcttaaataagaataaaggatgagacattctaatggattttggcttttataccacagtaaggtttgctagtatagttacttaaagcctttgatggtcttcatgttgtctatgagaatgaactttttggaaaacgccagatgcctctcaccttctggatgcttcagaatcactgttctcagaacaggagtaagaatagttctttctttcatagtgtcctaacttcgtgttgcctactgttgacctaagctgatagacggagtctagcctgatatttaattctaattgtctctgtggactttctcattaaacaatagtgattcttctaggcatctctggctttacaccgaattctgttccacccaagaggctttgtgctactactagtagctgccacctaatatagccagttgtttccccttgggtcatttgatttttatagttcacacattgtagcctgccttcatgtctttgttataacgcaccttgtgtgtaacgtttgagataaattcactaaccatgcatcatggctcaagaagtctgtctttgatattttagcatctttagatgtgtgtatgtgctgtgagcattgggaagattcatggtatgtaaattttagggatattactctttttgcatttgataatttcattataaagtttagtaccatagaatttttaaaatagttatataacctaggtgaaatatccaaaattaaccaggtattataacagactaatgtgtgatatgtgttttactcccttatcttcttccaagatttcttctcatcaaagtctataaataattgttactctttgcatgatggtaaaggcagtacccacacaatgggtgtggaggggttccttcggagtgttttcctatcagccatttcacaaatttcccaataagccacagtgttatatatatgtatgtatgtatgtgtatacatatatcagattttgacaaaacgttttcttctttccattgggatattttgatattctcttatttcagttttggttccttgtttgttgttgttattgtttcatttttgttgttgggtctttttgtacttaaaaattgcttatttttaacattagcgttcaaagtaatatatttcattgtgctattttcaaacatctttgttgattctaccaatctgaaaggcagatcaatatgtagatctaatatttatgagatcactttatagtacaataaaacatacatagtgaaagccatcctaattaaatatgactctgattgggggggatagtgagatagatagatagatagatagatagatagatagatagatagatagagaatgcttgtatgtatacttgtgcaaaaatctagagcagacttctattactgagctacatctccagccatcactgtcatgacattgaaatatgtcactgctcactgtaatgtggtattagtgacttaaaacaaacaagccccttaatccttaggtctttcctccctttcttttcctcattgtttacctattaagtactccttagaccttttatagtataatttcttagtctttgttttgccaattacttgacttcaggtcaatatggttccattttctctgtattttccaggaatttgcaggtgggtctgaggtcaaatctgatcctttgatcatagtataagtggtgtctggtgtgatagcaaagtccaaatggtcccatctctccttctcttagcgctgttagtccttaaaatccttaataattcttgtcgaaaatcatggttttaccaaacccagacactgtggcagatgccaacaagagcttgctgacagaagcctgatatagctgtcttctgagaggctctgccagtgcctgggaaatacagaagtggatgctcacagtcatccattgggtggagcacctggtcctcaatgaaggaggtagagaaagtacccaaggagctgaagggatcttgtagccacataggaggaacatcaatatgaactaaccagtacccccagagctccttgggactaaaccaccaatcaaagaaaacacatggtggaatttgtggctctccttatatatgtaataaaggatggcctagtcagtcatcaatgggaggagaggccctaggtcctgtgaaggttctatgctccaatataggggaatgccaggaccaggaatggaagtgggtgggttggggagcagggggaagggagagggaatagaggatttttg

SEQ ID NO: 1296 - DNA, 5896 bp, Mus musculus
actttaactattgctattgctattgcttctaagttgctaagttcttcttgcttaggtcttccgggctggcttccttcccttctgctatccctacccagagctctttaggctctcggcccacactgcaggtggggtcccaggaaacagaagacagaacgaaacacttctgtgtggttagagccccgttctctttgtgcctctgcccatttgtcaactgggacaccaacccagtctgacagactccaactgcaatcaagaacaagccaacgaaagccagcaacagatgttctaccctctgttttagaatcagtatttggacttctaacgttgtaactattatcaacaatacgattataagcagccaggtagaatagcatcagaaattaaaatgcatttacaacatagttcagttctgttgacaaaaccaaagtcaggagctagaggtaagatgaatgtgagttcaagaccagcttgggcttcctatcgaactctgtctccaaaatactagccctggggattgctactccgtcaaaaagcatttgcttggcatgcacgacagaaccttgggcctgtgactacagggaacagtactcaggtgtcttcttcacaactgcataaaatgtgagttgtaacatgaactcactttatgcgcatataggcactgaggtgcaaccttaattttttttttaaaccaaagccagaaatttctgagttccgattcttggcactgtgccaacgctcagatatgcttgtggcgcaagcaacgaaaacatggaagactagagcttaagatagggttccatggaagagtgtgtgtccagggaagagtgtgtgcttagcttgggttcaatctctagcaccattaagaaagagagagcaaactaactctggactaccctgagcagcctctgcctagcatggagagcggcggccgcggctggcggccgacgctggagaccgtttcgcccgcgaggtagttggccgacgttgcgcaaggacgaaagtgctggcgggtggccgcggcgtctccgcgagccccccgacgaggccgggcgggctgctggctggcggatttcaccgcgattcccccggaggctctttgcaaagctgcttgaaacttctcccaaactcgccatggatgtggcggccgctgcgttgcctgcttttgtagctctctggcttctgtacccgtggcctctcctggggtcggcccttggccagttctcagcaggtggctgtacttttgatgatgggccaggggcttgtgactaccaccaggatttatacgatgactttgagtgggtccatgtcagtgcgcaggaacctcattacctgccccccgaaatgcctcaaggttcctatatggttgtggactcctcaaatcatgatcctggagaaaaagccagacttcagctgcctaccatgaaggagaatgacacccactgcattgatttcagttacctgttatatagccagaaggggttgaaccctggcactttgaatatcctagttagggtgaataaaggacctcttgctaatccaatttggaatgtaactggattcactggtcgtgattggcttcgggctgaactagctgtgagcaccttttggcccaatgaataccaggtaatatttgaagctgaagtctcaggagggagaagtggttatattgccattgatgacatccaagtcctgagttatccttgcgataaatctcctcattttctccgccttggtgatgtggaggtcaatgctgggcagaatgctacatttcagtgcattgctacagggagagatgctgtgcataacaagttatggctgcagagacgcaatggagaagacatacccgtagcccagactaagaacataaatcacagaagatttgctgcctctttcagattgcaagaagtgacaaaaactgaccaggatttgtaccgctgcgtaactcagtcagaacgaggttctggggtttccaattttgctcaactcattgtgagagaaccacctagacccattgctcctccccagctgcttggtgttgggcctacttacttgctgatccaactaaatgccaactctattattggcgatggccccatcatcctgaaagaagtagagtatcgaatgacatcaggatcttggacagaaacccatgcagtcaacgcaccaacatataagttgtggcatttagacccagatacagaatacgagatccgcgtcctgcttaccagacctggcgaagggggaactgggctgccaggaccaccactgatcactagaacgaagtgtgcagaacctatgcggacaccaaagactttaaagattgctgaaatccaggcaaggcgcattgcagtggactgggagtccttgggctacaacatcactcgttgccacactttcaacgtcactatctgctaccattacttccgtggccacaatgagagcagggcagactgcttggacatggaccccaaagcccctcagcatgttgtgaaccatctgccaccttacacaaatgtcagcctcaagatgatcctaaccaacccagagggaaggaaggagagcgaagagacaatcatccaaactgatgaagatgtgcccgggcctgtgccagtcaaatccctccaaggaacatcctttgaaaacaagatcttcctgaactggaaagagccactggaaccgaatggaattatcactcagtatgaggtgagctatagcagcataagatcatttgaccctgctgttccagtggctgggcccccacagactgtatcaaatttatggaatagtacacaccatgtatttatgcatcttcaccctggaaccacctaccagttttttataagagccagcactgtcaaaggctttggaccagcaacagccatcaatgtgaccacaaatatctcagctccaagcttacctgactatgaaggagttgatgcctctctgaatgaaactgccaccaccatcacagtactattgaggcctgcacaagccaaaggtgctcctatcagtgcttatcaaattgttgtggagcagctacacccacatcgaacgaagcgtgaagcaggggccatggaatgctaccaggtaccggttacataccagaacgccctaagtgggggcgcgccctattactttgccgcagaacttccccctgggaatcttcccgagcctgctcccttcaccgtgggtgacaaccggacctataaaggcttttggaaccctcccctggccccccgcaaaggatacaacatctatttccaagcgatgagcagtgtggagaaggaaactaaaacccaatgtgtacgaattgctacaaaagcagcagcaacagaagaaccagaagtgatcccagacccggcaaagcagacagacagagtggtgaaaatcgcgggcatcagtgctggcatcctagtgttcatccttctcctgctggttgtcatagtaattgtgaaaaagagcaagcttgctaagaagcgcaaagatgcaatggggaacacacgtcaggagatgacccacatggtgaatgctatggaccgaagttatgctgaccagagcaccctgcatgcagaagaccccctttccctcaccttcatggaccaacataacttcagtccaagattgcccaatgatccacttgtgccgactgccgtgttagatgagaaccacagtgccacagcagagtctagtcgtctcctggatgttcctcgatacctctgcgaagggacagagtccccttatcagacaggacagctgcacccagccatcagggtggccgacttactgcagcacattaacctcatgaagacatcagacagctatgggttcaaagaggaatacgagagcttctttgaaggccagtcagcctcttgggatgtggctaaaaaggatcaaaacagagcaaagaaccgatacggaaacattatcgcatatgatcactccagagtcatcctgcaacctgtggaagatgacccttcttcagattacattaatgccaactacatcgacatttggctgtacagggatggctaccagagaccaagccactacattgcaactcaaggcccagttcatgaaaccgtatatgatttttggaggatggtgtggcaagagcagtctgcctgtattgtgatggtcactaatttagtggaagttggccgggtgaaatgctataaatattggcctgatgatactgaggtttatggtgacttcaaagtcacctgcgtagaaatggagccacttgctgagtatgtcgttaggacattcaccttggaaaggaggggctataatgaaatccgtgaagtcaaacagttccacttcactggctggcctgaccatggtgttccataccacgcaacagggctcctgtcatttatccggagagtcaagctatctaaccctcccagtgctgggcccattgtcgtacactgcagtgctggtgctgggcgcacaggctgttacattgttattgacataatgctggacatggctgaaagagagggtgtggttgacatctacaactgtgtgaaagccttacgatctcggcgcattaatatggtacagacagaggaacagtacatttttattcatgatgccattttagaagcctgcttatgtggagaaactgccatccctgtgtgtgaatttaaagctgcatattttgatatgattcgaatagactctcagactaactcctctcatctcaaagatgaatttcagactctgaattcggtcacccctcgactacaagctgaagactgcagcatagcctgcctgccaaggaaccatgacaagaaccgtttcatggatatgctcccacctgacagatgtctgccttttttaattacaattgatggggagagcagtaactacatcaatgctgctcttatggatagctataggcagccagcagctttcatcgtcacacaatacccactgccaaacactgtgaaagacttctggagattagtatatgattacggatgtacctccatcgtgatgctaaatgaagtggacctgtctcagggctgcccacagtactggccagaagaaggaatgctgcgatatggtcctatccaagtggaatgtatgtcttgttcaatggactgtgatgtgatcaatcgaatttttagaatatgcaacctaacgagaccacaggagggctatctgatggtacaacagttccagtacctaggctgggcttctcatcgagaagtgcctggctccaaacgctcgtttttgaaattgatactgcaggtggaaaaatggcaagaggaatgtgaagaaggggaaggccggacaatcatccactgcttgaatggcggtgggcgcagtggcatgttctgtgccataggcattgttgtggagatggtgaagcggcaaaatgtggtggatgttttccatgcagtaaagacgctgaggaacagcaagccaaacatggtggaagccccggagcagtatcgtttttgctatgatgtggcgttagagtacctggagtcctcatagttcgctgagactatttgcagagcatccaagcagaaatccattcgtctgttgagccagcagctgttgtacctgttactgcaccgagagattttaatgtacggggtgggaggcttttacattggagaggcaaatgtatttttcttataaagttgtgtatcttaataaaaaggacttgatcagtttctgtgactgtatgagagcatccacatttcatgccacctaattttatctttaatcagaggcagatttggatgagaagtggtctgtgtctgtccagtgaccacacagccttttctctcctgctttctgtagagcagctaccacacattgcatgcactttgtaagtggcatttccctctctttttggggtaaaaactgtgggaccccc

SEQ ID NO: 1297 - DNA, 4374 bp, Mus musculus
atggatgtggcggccgctgcgttgcctgcttttgtagctctctggcttctgtacccgtggcctctcctggggtcggcccttggccagttctcagcaggtggctgtacttttgatgatgggccaggggcttgtgactaccaccaggatttatacgatgactttgagtgggtccatgtcagtgcgcaggaacctcattacctgccccccgaaatgcctcaaggttcctatatggttgtggactcctcaaatcatgatcctggagaaaaagccagacttcagctgcctaccatgaaggagaatgacacccactgcattgatttcagttacctgttatatagccagaaggggttgaaccctggcactttgaatatcctagttagggtgaataaaggacctcttgctaatccaatttggaatgtaactggattcactggtcgtgattggcttcgggctgaactagctgtgagcaccttttggcccaatgaataccaggtaatatttgaagctgaagtctcaggagggagaagtggttatattgccattgatgacatccaagtcctgagttatccttgcgataaatctcctcattttctccgccttggtgatgtggaggtcaatgctgggcagaatgctacatttcagtgcattgctacagggagagatgctgtgcataacaagttatggctgcagagacgcaatggagaagacatacccgtagcccagactaagaacataaatcacagaagatttgctgcctctttcagattgcaagaagtgacaaaaactgaccaggatttgtaccgctgcgtaactcagtcagaacgaggttctggggtttccaattttgctcaactcattgtgagagaaccacctagacccattgctcctccccagctgcttggtgttgggcctacttacttgctgatccaactaaatgccaactctattattggcgatggccccatcatcctgaaagaagtagagtatcgaatgacatcaggatcttggacagaaacccatgcagtcaacgcaccaacatataagttgtggcatttagacccagatacagaatacgagatccgcgtcctgcttaccagacctggcgaagggggaactgggctgccaggaccaccactgatcactagaacgaagtgtgcagaacctatgcggacaccaaagactttaaagattgctgaaatccaggcaaggcgcattgcagtggactgggagtccttgggctacaacatcactcgttgccacactttcaacgtcactatctgctaccattacttccgtggccacaatgagagcagggcagactgcttggacatggaccccaaagcccctcagcatgttgtgaaccatctgccaccttacacaaatgtcagcctcaagatgatcctaaccaacccagagggaaggaaggagagcgaagagacaatcatccaaactgatgaagatgtgcccgggcctgtgccagtcaaatccctccaaggaacatcctttgaaaacaagatcttcctgaactggaaagagccactggaaccgaatggaattatcactcagtatgaggtgagctatagcagcataagatcatttgaccctgctgttccagtggctgggcccccacagactgtatcaaatttatggaatagtacacaccatgtatttatgcatcttcaccctggaaccacctaccagttttttataagagccagcactgtcaaaggctttggaccagcaacagccatcaatgtgaccacaaatatctcagctccaagcttacctgactatgaaggagttgatgcctctctgaatgaaactgccaccaccatcacagtactattgaggcctgcacaagccaaaggtgctcctatcagtgcttatcaaattgttgtggagcagctacacccacatcgaacgaagcgtgaagcaggggccatggaatgctaccaggtaccggttacataccagaacgccctaagtgggggcgcgccctattactttgccgcagaacttccccctgggaatcttcccgagcctgctcccttcaccgtgggtgacaaccggacctataaaggcttttggaaccctcccctggccccccgcaaaggatacaacatctatttccaagcgatgagcagtgtggagaaggaaactaaaacccaatgtgtacgaattgctacaaaagcagcagcaacagaagaaccagaagtgatcccagacccggcaaagcagacagacagagtggtgaaaatcgcgggcatcagtgctggcatcctagtgttcatccttctcctgctggttgtcatagtaattgtgaaaaagagcaagcttgctaagaagcgcaaagatgcaatggggaacacacgtcaggagatgacccacatggtgaatgctatggaccgaagttatgctgaccagagcaccctgcatgcagaagaccccctttccctcaccttcatggaccaacataacttcagtccaagattgcccaatgatccacttgtgccgactgccgtgttagatgagaaccacagtgccacagcagagtctagtcgtctcctggatgttcctcgatacctctgcgaagggacagagtccccttatcagacaggacagctgcacccagccatcagggtggccgacttactgcagcacattaacctcatgaagacatcagacagctatgggttcaaagaggaatacgagagcttctttgaaggccagtcagcctcttgggatgtggctaaaaaggatcaaaacagagcaaagaaccgatacggaaacattatcgcatatgatcactccagagtcatcctgcaacctgtggaagatgacccttcttcagattacattaatgccaactacatcgacatttggctgtacagggatggctaccagagaccaagccactacattgcaactcaaggcccagttcatgaaaccgtatatgatttttggaggatggtgtggcaagagcagtctgcctgtattgtgatggtcactaatttagtggaagttggccgggtgaaatgctataaatattggcctgatgatactgaggtttatggtgacttcaaagtcacctgcgtagaaatggagccacttgctgagtatgtcgttaggacattcaccttggaaaggaggggctataatgaaatccgtgaagtcaaacagttccacttcactggctggcctgaccatggtgttccataccacgcaacagggctcctgtcatttatccggagagtcaagctatctaaccctcccagtgctgggcccattgtcgtacactgcagtgctggtgctgggcgcacaggctgttacattgttattgacataatgctggacatggctgaaagagagggtgtggttgacatctacaactgtgtgaaagccttacgatctcggcgcattaatatggtacagacagaggaacagtacatttttattcatgatgccattttagaagcctgcttatgtggagaaactgccatccctgtgtgtgaatttaaagctgcatattttgatatgattcgaatagactctcagactaactcctctcatctcaaagatgaatttcagactctgaattcggtcacccctcgactacaagctgaagactgcagcatagcctgcctgccaaggaaccatgacaagaaccgtttcatggatatgctcccacctgacagatgtctgccttttttaattacaattgatggggagagcagtaactacatcaatgctgctcttatggatagctataggcagccagcagctttcatcgtcacacaatacccactgccaaacactgtgaaagacttctggagattagtatatgattacggatgtacctccatcgtgatgctaaatgaagtggacctgtctcagggctgcccacagtactggccagaagaaggaatgctgcgatatggtcctatccaagtggaatgtatgtcttgttcaatggactgtgatgtgatcaatcgaatttttagaatatgcaacctaacgagaccacaggagggctatctgatggtacaacagttccagtacctaggctgggcttctcatcgagaagtgcctggctccaaacgctcgtttttgaaattgatactgcaggtggaaaaatggcaagaggaatgtgaagaaggggaaggccggacaatcatccactgcttgaatggcggtgggcgcagtggcatgttctgtgccataggcattgttgtggagatggtgaagcggcaaaatgtggtggatgttttccatgcagtaaagacgctgaggaacagcaagccaaacatggtggaagccccggagcagtatcgtttttgctatgatgtggcgttagagtacctggagtcctcatag

SEQ ID NO: 1298 - DNA, 96589 bp, Homo sapiens
  misc_feature (2687)..(2966): "n" at positions 2687 thru 2966  can be any base
  misc_feature (13107)..(13304): "n" at positions 13107 thru 13304  can be any base
  misc_feature (21488)..(23254): "n" at positions 21488 thru 23254  can be any base
  misc_feature (26987)..(27006): "n" at positions 26987 thru 27006  can be any base
  misc_feature (32504)..(32527): "n" at positions 32504 thru 32527  can be any base
  misc_feature (73853)..(73921): "n" at positions 73853 thru 73921  can be any base
caagtcgtttacatattcagttaaaaataaaactaatgtttgttctttgtgtaaaaggaatacatttgacttcgtgagcacgtattagccatccaaataaccaaaaataatcctagatcactggaaatgaagaaatattttttcttaatttaagaaatgtattgacaaaagaatacaaatcataaagggaactcttgagtcttgtctggctaaaaatcatgagaacactataccagagaaaaagagttggctgagggtgtacttgtaatataaacacttatgaaacactggctacttgaaaattcaaagtacgtatatagtgctgttcatgaatcaatgatctgtgagtgaatctgattgctgatccaaagtagaaagagaaaatgcctgcactcaacatcttttcctattgacaagtaatcagggtcattcacatgttcctacctgtgataaaatttactttttaggtgttcacttctgttactggtgcttaaatcagctaccagctacttgcatttatcttttaagagttagatatttgggtgaattcaactttattttacgtaagttgcaaacacagcatatttttattatttttgcatcactgtactatataatgtaacttacattaactctttattcacttaatcaattttttccacaaacattgattgatcatttattatgccagtcactgtgcaaggtattgtaaatcaaagataaaatgaccacaacaaaacacagaatctttgcccaggtttgtcatagaccatcagagatgcctgcagccttgtaaatcatttgctcatagctggtgttcaggaattttgttaactcagtatgttattgatacacgtttttaaatttaaagtcttttactttattacctttatataatttctaaagaccaattagaaacactcatctttgtatttgttggcaagatttttgaccttttctagaattgagccagaggctgagaacttcaaattatacattgttggagattagtgctcagaaaaataaatttaaatcctggaatattacaagaagaagtaatttaataataatataaacaacagattttttttgaagtgaatgttactaccaggaaaataaaatctgctttctaactgatatgctaatcccaccaagtccatctttagtttttgtaatgacttacccagttcacctacaggtgggtgccaggtggtgggaccagactggtctagtcaagtaatctggcttcagatgagccctgcctcctttaccctctgaatcctttgtgctgtctttctttcctctgaccacattcctactttcagtctccctaccagccaactgtagccttatcgtgaggcttatctgatccagtgccttaattttttgaaaatgaagattcaatttaatgtaatcatttttccttaccattgaatttatggtctggtatctcaaatctttgattggattcccatcactcacttcaaatgtacttgaagcaattttactttccactcaattttttctttgtttatgtcagtctgtcaaaatctcttctctgctaatgcttgatgctattctactctgtgacccttccccctgccacccctgtcaccttcccaaataaaccagaactacatattatccaactaaatctgagagcatccaggagttagcttgctggctgtcatagaccctaaatactgggttctgtccttccctaattatagcattactagcctctgccattttgcatttcaccatctattcatcccacctccagtggaaatatgtattctttctgcctggtcttcctaatatcaaacaaactccagttctacagtcctctgtcataccaactagaaaatcttgttatatagagttttcgtgtttagttttattaggaaagctaaaatcgccaatggattctataaatttgttgactcaataacattctatatgtgccaagagctgagctgcatacttgaaatagaaatctacttaaggcaattagtatgtgcacccgtgtgagtggtagactcctaaattaatgactggtaacaatgctgtgtgataagtgcaataataacagctagaaaatgtggtactaaagctgaatttgtgaggagaggtagaaatgagcatggccaaaggtcacaatgatgcatttacgaattgcagatagcctaggtcatggagagtgaagggtctgtgggagaattgacagcagctgaagctggagagacaaaacagggagcaaagggagaggttgtttagtgccagccccacaactgaaggtgggcacaagaaggactgtaagcagaagttaccatgggcagttttacgtttttagaaagatcactctgatagaaacatagagaatggactggggataatccagaaggctggagtagtccctgtgagaagtgctaatgggccatattaagaaagtagcaatggaaatgcaggtaagactgtggctcctacataaggttttagatcagtaggatgtgtaaagcttcatgggaagggagtttgagtggagactttaggtgagagaagatggtagcttttatatttgaagtggtagcagagcaaaaagacatctcagaattcaaggttttgttttttgaggttattaagtgataaatattttcagtattgctaccccaaatcaaaaaagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaccacagtgaaaaatcccattctgcataatgcagcactaagtttcaccaaccacattgtccttctgttacccattactgcttccctatgctaatgtagaacatgtgcgatgcagtgctggcaagtgtggttctttgacgaaattaatttttgattttataatcattctaaaaactgaacattgttgcctgacttaagtagaactttgaatctccttaccaactttttgagatctatccttacaactgtcatcacttgacaatcattactgtgttcaaaatgaatattgtctacatttagaatgcaattccctaggaatacataattccttttcttttctttctaaaaggtttcttcgtaaatgaattaaaactctaacctgggaaaatataattacaaattataatgcatagaacgtcccatttattaaaagattgacccaatatagctgtgttttcaaagaatgaaaataacagcagcatgttgtaaaaacacaaaatagtttctctgtggtgagactgtttattgtaaagttaataaatgaatatatattttatttcagcattttccaaatagaaactctacccattttgcgctgcaggaagctacccattctaaggttactttgttttgtggagaacatctaatttgcatttcataacattaagcaccacctatttagtttgataattaaaatatagtcatgaaataaagtcaaaaccaccatttcttccacagttaaattaggaaaagaaattgtctgatgttctaagttcactgatagcttaacagacaaatgtatgttagggttgcatagctttaaaatctggggctatcctcatccacctgcagaatagtctgtttcattacataaatttaaagatatcaaatagttctaattttcctaaccactatcctgacctagagcttacttgaattccaaataaaaccatcttgaaatttaactagagatggaaataatctttttgccctcttttatgggcataaaggtcatatggtccaattagatcaaatagatgttactttaattttatgtttattctctagaatcatagtaggtagaatcgttataatttttctaatcaaaaataggaggaagtatgcccttcttgttaaatcttctttctggcctctagaatcccagtccacagcttgcttatgaccttgtgagaagccctgagccagacctgtcttagcttagcaactctggaattcctgacccactgaagctgtgagataatgtttgttgctttgagctacagaatttcagggtaatatgttatgcaggaagagattatacatgtacccaagtagtataaatcttctctttcttcagatttctgcccaacggatacttttatcacataaggatttcttgaccaacccatataaaatagcactctgcattcccatcattccctctttcccttagcctgctttatctttctctagagcacttatcccttcttaatatgtgttggttttctgaatttatttttttatttgtgtctccccactagaatgtaaacttcatgagaacagagacttttgctactatcttcattattttaacctcagtacttaaaataattcatgatatgtaacagatactcaataaatatttggtgaacaaatgaactggatctaaaaatataacagccacattctgtagtaagcttatcatctgctaaaggaaagacatatacctaaaaaactatttttaacagtataatatcaaatcatatttgtaatgtaccatgttggtgcatgtaatgtgctacggccacatactgatgtatcatataagcaataaatattagacagcaatgctaggtcttttgttttttccaccctagagtttttgagaataccatttatggttctgataaatggatctttggcattataattgtcagtgggttaggaactagattaaacatgcatccctgtgattgtgacttctacccccatgtcatccttcagtcatcctcatcttaaaaattactccattgcctttagaagacagagtactgaggaatgaagatagttcaagaagccttcatggcagaagtagaaaaactagacaagaaaggcagaaattcttgactgtatgtttagtatatttgggtaacaatggtcataccagcttcgaatggaaaataaatatcaggagataaaacaagaatggagatataaggtaaggaatgtggtaatttatcaaccccagcgtaaaaagtacagagtttgactttgaatttgactgtacttcaaattttaatgttgctattatcctgggctagtgatatgtaatacatgagatattaaacactttattataaaacaggttttgtattagctgattttgccaactataagctaatgtaaatgttctgagcacatttaagttaggctaggctaagctatgctgttcagtgggttagatgtattatattcatttcaatttacaatattttcaacttgtaatgggtttattgggacataaccccatcataagttgagaaacctccatataatgtagtaaaatatgtcattttaattttttaaaaaataaggaagtcacattttgtgtattgaatgattaatgataccaatatattgatttaacctaattacagaaatatttttgaagtttattaaaaggaatggggaatatattaactatgggtagagtgattaaaaatattatgatgactttggaatagttttaattactaaagtactgagctcacctaatatttagatctagctagagtttagttccattaggtaattagacaaccagaagaatgaagaagcacaatcccatttcatgtaattagtcaactcacttctaatgcgatttcttatttcttatttcatcttttaattaatttgtattgataaataagaaaataacaaggacagaaacagatttaaaaattggaaatgtggttagagaacagcctttcagattgaacaatgaaggaaagatagtttcttttaaacatggactagtgtgactttttgttatttttatagctgtttttcactaaatgtaaatacttcttaaagactcaccatgattacaattgatttctgtgtgagttataaaaacgcctcttcaatgggcatgaaaaaaggtagaaatagatgcacaaagtgatgcatccagaaagacactgactaaagactgagcccaactaaggagagtaaaatgccactagagaattttgagggatactggtacaaggaaagatacttttcatattttcagtatcttgaaaaggtagcatgctgcggaggtccagaacagaaagacagcagtacagcagacaggtgtatatcaagattttaaactgaaacgggtatttctgggtgatgttatagaaaagtagtacaatttcagtttcgtttgggtgtaaaagcaaaagggagtatgagagatgactttaaaagactctgaagatctacttctgggtagctgtcccagtcactttaaatgcttaccatggacagtcacaggttcctaagtgaacagagttgaaaagaaagtatacattttagttttgttgtcgttttaaactgtatcaaacttgagaggggcagaaagcattctaaagatggtagaacactagaagtttcagtaaataaaagtgaatataaggtccgtgaaagccaggtgttttttttttaacctctctatcctcagagcctgcatgatacctgttaaatatataattgttgaatgaaaatgagttaatggatacaatgtcacaggaagaaaggtaaatgagaaaattcttactcttcaaataatgctcgggatttttcaggtgaaaaatgtactttcatggagaaagaaaaagagtatcttagatatgtcctaagcaaaaatatcaacagaaaaggcaaaagcaatgtattcatttcataaacacttaaacgtccattatcctatttgaaaccacatattccagtgtggtttcaaataggataatgggcgtttaagtaagtataatatgtgaaaatgtaatggctattgtatcagcttttggagttaaacatatttgggattaaaaatatctagaaactggggtgaatgttatatcatgaagacatttctcctggtatgagtggtggtagagtgggagggttatagagtgcggtgaccaggttatctccaactagctttccatctaatgttactcattgcacaaagaatgttttagaaagtatgcttggaagccagttctcagaagtctttttgtatttatgtgtcttagtttgctcaggctgctattacaaaatactaggtggcttaaacaagaaatatttctcacagttctggagactgggaagtccaagatccaggtgctctcggatttggttcttggtgagggcccctcttctaaacctaattattttccaaaggccccctctccaaatactatcactttgagaattagggttttaacatgaattttgggggagggggcacaaatattcagttggtaacactgtagtataaagtagagaatgaacaaagtgaggttcctggtttaagttttaaggggagctctattcttctgcctcagtttcaatagtaacagaaatgtaatacttcatttctgtaatgaccattcaaagaataaatgaataatattggtagagaaaagatatataagattaaagtgcatggcactgtaatttatatttgtatataaattatgtggaaatcattttcttaattctttatgaaacaagcatgttacttgtattttagaacttataaaattgaaataatttatctttcattttaattgagagtagggccaaatctgaaagttcaacccaaggcattgatttttattttctatgggaccatacttaaggctctttcccaaagagcctattgcaccttttcttcctttactcttctccaacactggcaatttactttgctcctcacagatctagatagacaagctgtcttgcatgaagtatccttaatttgtaatgtagaatctctgtcaatgtaatagaattagttaagattgaatgttcactagattttgtgtttttttttctagaggtatgggataattaatgaagaatctatttttaaggattagattaatgattaacaaggataggtaattattattattctttagggcaagaatataaggttacatttgtttggagagcatgtatgagggagtttatatgcatatgtggatgtatccacaggacatgcaaatgtataatatacaaatatgaattataaatttaaaataaaacatagcatatgtcagctatgatcattctcgtctttctccagggctatgcgtatgtattttctatatcttaaaattgacaaatgcctgctccatggatgcctcagagaccatgcatcttgtcagtagcattcttagaagcttagcaaccaacttggcagaggtatagggaatgatgcagcacatataatttgaaataacatagacttctgccttgcttgctcaaatcacaatttctaacattaatacaagttctgttatctttttagaggaaacaagatggatatgaacctactgatttattagcaatattttaatggaaaatgggagcttaaataactaggaagaaaagaaaatctgtaatttatcaattaaattatgatttaactctttcttttgatgtccttttgtttaatctatgaagatcttttatttgtaggcataagagtttatattaaattagaattttatgccagagtctaaactgttttaattttcatagatgcatgttcagtgtatctctctctctcctctctctctctgtctctctttctccctccccctctcctccccactcccctctacctacccacctctttctttttcatggaagtcttttaaagaatgtattctgttcctcctggagatccattgaatatcaatatgcagccctgcatacaatttatgttcaacttacctaagataccacatatatttttccagaatttttaggaattttaaaacattttaaaatatatttataatgtataaaatatattataataataatgtcaactttcatggtaatattttacctgaaaaaattttaacgtaaagaattttctactaaaaaagaatattgttaatataccagcttcagagttgttaaaaaatattgttagatatccgggggatctttattttaaatttgccttgtttttctttttgtttttttctctcctttgtaaagtaattgcaattatagaaaagttttaagacttaaagatatcagaaggtttaggttagagctttaataggccaaatgccatctgtttctacaatttgtaacattttattattaacaactccagaagaaggaggcggtctatttcggttgtgaggacagatttctgtccatctgtgcccgtattgccgcatgtcacttgtattttagatctacatagctctgagccagtgtagatgccatggcaaggtcaagaggtggagaagcctgtcagtacattctgtctctgaggctgtgacaaccacaaatgggtgcttctagcaccgccctgaggcagtcattctgttagaccttggagctggactttctgtaatatcatttcaagggaaaatgttaactttaaacatttaaaaatatcagacaaagaactgaatctatgatgtgtctttggttaatgtcagaatccttattagggtggctcattcctcaacatttaaaaatgttgaaagtcctacggtgattgttcttctttttatcagtttctttgtaactacagtgatgttagggacagcagcatctatatggatttttcattttattgcgaaatagctgaaaagagtataccaggttaagactaactttaaatactttgaaatgtggtgtgttaatagtcaaccccttaaaaaaaatcttagtatcttaaacctctaaatatgtgtgtatatatatgtgtgttctttttttcttttccccaaagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggtgagcttcctccaggatttgctttttccctgctttgaagaaaagctgaagtcaaattttatgaatactcagtagcatccgtcaagaaaaaaaaaaagaaaaagaaaatttgcatgtagggggttctgttctcaacagtgtgcgcagttttggggctacagtagggctgaggccgcacgccagttccatttcacagggttcctgtttcctagtaactgcttctactcgagccttcctcaggaaagcccacaatagcaattgagagtaaaatgatttgaaaacgtgggtgtgctgctgctgggactccaccctcagtaacgatcaggcattgttctgtcttccttgctcagtggtggcacacttcaagagattaaatttactgcaggataaacagaatgcgtgttccacagcaggctaataaaaccttataaacttttcagggttttcaagccaaatagtaaataacatgtaacaatcctctgattacaaagtaatagggcgcctgtggtatatctgactgaacctaaacaaaaggcagcctggcgatgactggctgctgagccattacagaaggctgctctctgtttccctggttgcccctccttttcccattttggacacagttgtttttgaacactgctgctgatcccaaatgaatattgaagaggaaaacacaacaggacattagaaacgaccggcagttccgtatgtgagaaaacaacctggcctttcatgcctcatgctgttctctttggaagattttctttcctaaaacttatttttatttatttatttatttatttatttatttatttattggcagacagagatagagggaagacaaatgttgaggatagaaattttcacaatttaaaatccaatagaatgatgacattttaatagacttgaagccgtataggaaattgctgggtttatgtaattgagtccctaaggtgagcacctgggagtgatacatgatatacaattacatcagtcatattatatcttagaagagtttaattggaagacataacaatccttttgcatttctgcaggggccgtgagagctttgggtattgattggctgcttttgaatcaaagctttgttgtttgcttgcctgtatgcttggcttgtaggtagcaaagaaaaaggccacagcatcttctaagatgtgctccagagtcagaggctgctcatggttgaagatgctcttctcgtttacctttaaagaactgaggtctttagagagtagtccagtgtccactttctgcctacatatcattccataccactgttacaactgggctactataaaaacagaacactatggaagttattagtccattctgggtataatatagcattgagtaggaagcatagttttgtgtgagggttttgatctttagagaggttccaaattaactttggttatttggtctattataccagaggagtgttaatgaatgtctgttacttataaaggattttctctgcattctttaaagctttttgatatgaattttctcttccaattgttaatatatctgcactgtggtttaatcaaagtacagaatagcaacaatatatttcacagttatcttggcaaagagttttaaagttgatgtgacttctacaagtagagattggtaatgccattagaaagttaaacagcaattgcttttaagaaatgaaaatcctttggggcctttatgggaatgtgaaataatctcttgcaggttaccatgaaggtctcaggccacaagtaatagaagtgcaacattttatttttaattactaattcccccctcactgctttattttaatttaaaaataaaaaaataaaaaatgcttaagtggaaattgtaaactcttttataaattatcaacatatagaactactcaagatagagttataaatgcatcttgcaaacagatcgcctctggtttgttcactggctttgataccttttctcacctcttgtgtattcagggatgtacgctgactcaattaagtcctagaggaggaagagtggggccaaaagtagctggcagggacatgtgtctcctactgccacctgacagcgttaaaaataatcatattttttcttgtcctttcctactgcttctactttgtatacccgctctgtctagcaagaggaggaaaattatgtatgctgagaaacatttaactcctaatagctaaattaaaagaaagaaagaacagataaattacaccataactatgatgtaatgttttgatgatctttctaactgctatcatttagctttttagtcatgctaggatccagatgaaagtatgtaatgttcagctttggtctcagtctacagttctcagatgaaaattaaatttatatttggaactgtttttattagctttgcaagtacatttttctgatagtttacgaagcactatacatgaaaatagaatgctatactacttgtcacaaactaacctgtttcattgcaaggtaaaaacaaatatttacatctctataaaaactaaaatatttttcaaagttcttactttagatttttaagtatccctaggggggcatattttttaaagttttcttaatattaaaattctgttgtttataatccctttttatgaccccagatggatcttcataataattatagtttacgaaacaggaaacattatctgtacattgactcttttttttttcatttttactctatcaggaaactaaaacccagtgcgtacgcattgctacaaaaggtaagaggtttgctttttttgcttgttttaactactctcaccccctttctaaaatggaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgttatagttagttctgtgactcatgtgggtgtctttaacaactaatggggtgctacttcccatcctctagtacttgactgaaggaatcttgttatgataacaggaaagatctagaaaaccttagaagggcttatttctgccatttagtgtctgaaaaatcttgtgctgctgatcaaccaatatcttaggaaagcgtcagcaatagcagatgaaaatagcaagttgcttgtttaaaaacctctattactttccattgtagacaatcaaacataaaaagaaccaagctaattcatgtttacataagattatagggatagagattagtccatatcttcatcagtagtgcagttagcttgaagatcatttactttttttaaaacttattctgagaaaccagatctgtgatggctagctcataaccagggcaattcctgctgacctggcatattatggcttagctgcctagtttctttgacaagagaaaacatttgcatctttgaatgagtatttagagttccaagtgggggaaagtctcctacattctctgtgtttttaattcttcatttaagagttacttgattgtgccaacaaagaataaattgctacttggtgtattctagcaagagaaacatgaaaaagctgtctgcatgcagacgtgggcctcctcaaagggttggttcttggggtggtttgctgccggaattagtagcagacccacatttgtgtccagtagttgattcatttggggtaaaaatgaatggccatattctgtttgtactggcatctttcctttcatcagttttctccatctaatcatcagtctgctcaatcagcatttgtgctttactcctgatttgtaaggcaataaagaaagactttctctttgacgcttgtgaataataaagaagctttatggaagagaaaaaaatatactttttcaattcacttatgaagattccttttggtagtttttatttaaaaaagcaattcttaaagagaaaatatacacagatacatacgatgtataaggattttattttaaaaatttagcttactgatcaggaacgagagttgaaatttttaaaagataatagaagaaagcatttaggtctatatcacctgtgtttttccagatttaaagtagaaccaaaattgtaaaagtgtcccacattgacctctgaagttctttagatatgtcatgctatgtttctgtaactgagaaatggtagctatatattaccctaacataacttttttattcagttatttcattatttgctcttgcctgagatgtttgtgtccttttatcgctctctcgatacaaatttaaaaaaatgacaaatatcacatgatatttaaactataggaggattgagatcctggaaacagtcttaccatgtggcatagaataattgacagaaactttgaagtggtaaaaaatagtccattatttgtctaataatccagctctgctacacttctggatctcaggaatgcagtgtggtgtggtgtagtgagtaagagaaaggactctggccttacactatctgagttcaaatattgactgtgtcccttaggaattttttagtattgagaaacttatgtaaaccctcattccaaaaattaaataatagagtacctacaccttcttattgttgtgaggattaaaataacatatataggccagacacggtggctcctggcactttgcaacgccaaagtgggaggatagcttgaggccaagagtttgatatcagcttgggcaaaatagcaagaccctgtttctactgaaaatttaaaaaaaaaaaaaatgttagccaggcttgatggagctcacctgtggtcccaggtacttgggaggctgaagcgagagcatcgcttaagcccagaagttccagtttacgttgagctatgatcgtgccactgtactcctgggtgacagagtgagaccctgtctctaaaataataaaataaaatatatatgaagtgcttaaatagtgcttaacatattataaacagtacatgtgttaactatcttatcattatgctaataattttgtacttaagagggacataacttatgttagacagttatgaatgaaatatgtataaaaacaaatctaaattttcgtgatcgagattgctaggacaggggagaaactaagggttttttgttcgcttgttttttaatgtttctgccctggtctaatatattttcttctctgaacctttagcattttttccacatatgaaaagctaaccctgtttctacaaaaactaaaaaaaatgagccaggcatggtgacttgtgcctgtagctccagctacttggaagatgggaagattgcttcagcctaggaatttgaggctgcagtgagctatgattgtaccactgcactccagcctgggtgacagagtgagactatgtctcaaaaggaaaaaaaaaagaaaagaaaagaaatgaaaaagaaaaactaccacatttgttaaagtaacatcaacttattgcctgactacattttaaactaacatgcaagtatggtcagctttggtgtgaaatttttcaatatgaaaataaaaagttttctgacagggcgttttgaagaaacatttaatagtcaaaatggcataatcatatgactgggaagaggcatgaaggaaccttctggtgaaggagtggttcagtatttcacaggtgcatatgtaggtaaaaatctgtccaactgtacatttaaaatgtgtgcactttactcttataaatttgtgtgtggatatataggtagataggtaaagtatttcccaatataaaaaaatgaattatacattaaaaattgcatggccagagttagaaacagcactgagaatattatagaggagtctctggagtttgaaaggctcaccttgctagcttcagtgaaggtttccttctatcagacgaggtgcatcttcagtacataagccactttcagtgagaaggacaaccctgcccaggaatccctgggctgaatgaaaagggtctagaaaggacctttcttggtcctggatgactcctatgggcaagtcttgtgtttcagctgccctacagtcagaccctcccctgcctcccaacccccaccccctttccagtgtcagttgtgagtactgaagagctagaaccttgctagaaccttgctttcctaatatcctttgtatttagatcaattttgctgaaaagaacttagttctctggaaaatctggtgtccctccataagacattccagtttgcagtgtgtccttttaccacacaaattttctgttcaggccatatgcaacagtctgttgctttttttctcatttttttgaaaacttaaaacattccaaatgtagtctgggacaaagtaccttgaacaaagtgtgtgtttctctcactcactctctctctggaaattattttcacatcccctttattttagaaaaagttgtattttgtatggagaagccagagttcattgttacatgttagtatcatatttataatagaaaataaaacattttactaaaacaaaaaaaaattatttagccaaatttgaagctctgatttaatagtcttatacatcactatatgccagggacaaatacagagtgagagtcatattagatacaataaatatttgttgagttggtaattgaatttgaacaaaacgtaaggtagatgcttctgctttcacgtttaatcaaacaggttacagtactgtctgcaattatgaaaagtatcagagcaatatgtgagttaagacaaatttattaaataactagagttgtttttatttctttaactgtgcatttatattgtgatatatatttcatattctaatatagaatacttttgccaaagctaagactttattttagtaacaaagcagtcagttaaaaatataatctataaactaatgtgaattaaattaaatttaatcctagtctgtgtctatatcagttttattcaaatgagttttcttcagctgaattctgtgataggaagacagtttagctcaaattgtcttttcattgtaatcactgctattcttatgaccatattctatagcttctttgctttcctggtactcacatttcaatgtgaaggacctattcaaatgaattaaccagaatgaatgagttgatatattagagcacagagtccaaagagaatctagctattattacttcttataataagtcttaaattcgggatacaggacattataatgagagattaaaattctatcaagtgtcttaaggatggacataactaagtagcataagaatgtaccatgttttgctaatgagaaactctgacttcattggtggatgtctttaaattttacagtcaaagtagaaataatagctctgaatatttttatagttctcaagcataagatcagaactagaaattaaaaaggagtaacacatacaattttcaacattcatcttttcccagcattttgaattattcttaaagttggcgacagttcaccattactactgtatatctggaataccctgtgtctaactgatttcatcttaattcacttcacattggaccccggaacctctctctctgctctcattgctagtataagtagactcttctccaccatgttcctagagaaatagccaagtcaccgaaacagaaaagatatgagttgaggaccttcaagggtgcatgatcactgttttcatcccaaccccaagttagatggaagttaaatatttctttgctttaaaagtaacaaactattattgtttgcatatggagtattactagtctaataatttttgacagaatgataactgggatgctaggatatagagagaaatggaaaaaaatagaacggacctgaagatgattcaagcattttgcttttatggaaattaaactgttttatgagaagatttctgacctattaccctctctttcctgaggagcctgttgcaggtaccttacatttatggccacgtctacgggagagaagtgatgacattcattcataaactgatcaaactgtcagtgttaactgtggaaaggatagagtttctaacctaatttgtaatgctgtaatcacatacttagaagagactggaaaaacataaattggtacaacctaagggaactaacttataatccatttcagcaaaaaattcaaaaggtaggtggttatatcatcaatattcaaaaatcaatagtgtagcagcaacaaaacagtattttaagatgttgtcatttataatgtatctctaaaaattagtgtaggaatatatctggtgaaagatagattacatctctacactgaacactacaaaatcttattgagagaaattaaacaatacctaaattaatgggatggcacaccatgttcatggattagaagattcaatattggtgaaatgtcagtgctcctacattaatgtgtagatttaaagcaatcaaaatcccaattttgttaaaaaaattaacaatctgattctaaagacaaaatggaaatgcaaaagaataagaatatgcaaggctactcttaaaatacagttcctggatgttatcaaggccaatataaagttagagtaattaagacagtgtggtaatagcacaagaataaaaattatgaccagtgaaagagaaactccagtaatagatgcacacacacgttcaccattttttatgacaaaggtaaaactgtagggaagaggggaaaaggtacccttttcaataaatgacagtttttccatatctatatggaagacattatatcttgacccctaactcacactatataaaaaaatacagctacatataagagttataacagtatagtttttagaagaatatagaacatattttatgatgttacaatagtcaaagattgactccaccatcctccaccagaaaaaaaaaatttaaacaattttttaaaaaaataataggcaaggattttttagacaggagatagaaatatgctaaacaaaaaggaataaatgataaattctacttaagacctctttcctgtcaaaagatgccattatgagagtaaaatagaatttacagaggagaaaagatacttgtaataaatatatctgaaataaggcatatcaaaaacatatttaaaaactattaaaactagtgaggagacaagagacaatccattagaaaatggagaaaacacttgagcacttaagagagaaggaaatacaaaatgatcaattaacctatgaaatggtgctcaacaggaaaatacaaattgaaaccacaatgtgattccactacacctataccaaaattagtaaaatgaaaaagtgtagaaaataccaagtcttaagaaggatgtaaaataactggaaatctcctaccatcctgctggtgggggtataaatttgcacaaccactttggaaaactgtctagcaacatggactgaaagtaaacccatgtcccaacaattccattcctgggatactcaccaaagaaatatgtatgttaatacacccaaaaacatgtagtacaaaatttatagcagcactgtttataaaagcaacaaactggaaataacccagcaacaaccagtagtagattggataagtaagttgggcatattcacataatgccatgctctaaagcaaagaatgcaaactatgactacacaaaataatatacataagtataaccaacattatttgagtaaaagccagacaacaaagaatatacactttattgtttaatttgtaaaaaagagataaaataactaataaaagttaaaaggtatgcagtacctatatagatgtattatgatttaaatattatattatctagatatgtatctgtctcaggggttcccgagactaccctcagattcggtgattcacaaggaggactcagtcatcctgtgagttgtcctgttctcatggctacgacttattacagtgaaaggatacaaagcagaataaggacagggagaagtcacatggacaaagttcagaggaagccaggtgcaagcttccaagagcctcttcctatggaatcacacaggacatgcttaatttctccaggatggaattgggacagcacatgtgaaatgctgtctatcaagaaagcttattagagactcagttcctaaggtttttagtgggaactggtcacatggaccccttcttgctatcatctgccaagattcccttctcccagaaggaaactagacttttagcataaagcacattatttgcacagtttaggcacaatgaaccactcttctcagggaatgatgggaaccctcccaaatccgagttcccggacatcagtccaaggtcaactttgcaagccgccctttccaagaatttcagtcttagtcctgctacgttaactcttttctgtacaatatctatatcaagtgtctcaagggctagttaaaagaatatttgaagaaattagagaaaattccaaaaattatacatacaattaaggaagtagaaaattggatgtagaaaaataattagaaaattaatcattattgacactaagagagaaatctgagggataatttaaggacttcctttagataatgagttatgacataagataaagtcacccatagcctgtatctcccccaaatccttccctaagtagagaatatgggcctactttatttgaaacacttctgaaaagtatttcttgaaaacactctttagaaccttctaagaaatgacagctcatttagtcatttgccattcagattgtataccagcttatataataccttgattcattaattatttgctgaacaatcctaaaaattatgtttatccattacccattcatacttttactatctttctacacccaatatgtatgcagttcaggttttcaaactcttacttgagtaaaaagggagaacaggtatttaaaagcatatttctagccaggcgccgtggctcacacctgtaatcccagcactttgggaggccgaggcaggtgtatcacaaggtcaggacttcgagaccagcctggccaacatagtgaaaccccatctctactaaaaatacaaaaaattagctgggtgtggtggcgggcacctgtaatcccagctacttgggaggctgagacaggagaagagcttgaacccgggaggcggaggttgcagtgggccaagatcacaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaagtttatgttggtattggacagcatcttgaattcaaactgcattgtaaaggcaacagcaaatcactgaaagtttttgaagtgaaagcaagttaatcccagctatatgtaacattttgggttaaaaaaaatctcaatagcatatatgttagattgatgcagttaaatagtagaggtgaagaaacaagctgaaagcctggtgtagctcttttttctcagccttttctcttttcttccctttttttccttaaaaattcatctcacaaccattggggtggggcagagcatggtaggacccacaccagtgagagatgaaagcagcagcagtggtcccacagaccttgtcagagcctgagtcggatggaggaggcagtctcacagagtatcagcctcgtgtggcatttcagaagtcagttagattcagaagcttgtcttcatggggacggtgggtggcacaaccccatgtgggaagtcagagcttgagcagggagtagagtgtccacatgtggaggtgaactgttggggttttggagcccaactagggtgagtagaacatcaacacagtaggcaatccaccttgggaaatcagagcccaagtgtggtgaaaaggggacttgtcagggacgcatagcatggtgtgaggtatcagaatccaaacaagatgaagagcttgggggtggggagtcagactctgagggaggttaagagggtgtccacgcaagagggtggcccatacagcatgtcagagccttatcagtctaggtgtgtgaacttccaggcagaggttgatcatgtgccggttgcctgagtctgcatggagtgaggagcacagccgcacagggaaggaggtgacagcagagatggcagagattacgtgtgtggcagggtgtgggggtgcagggagaaagttaaaaaacacaggtgaaactgtgtgtataggggtgtgtgtgtgtgtgtgtgtgtgtgtgtgtgttccatacacatagtccactgagacagcctgggagcaacaacatactgatggaaaatatgcctaatatccagatgttggtgtctaaataccattatccaataaaagtacctggggctctttggataaatggctcattccagggctggaacaaggaaagtacaacatgaaactagattattattattatttgccagaaagcgctaaaaaaataatgagggcatagcaagaggacacaattgccaacctcaagggggcccctcattggctgaactagaggcctattacttgagaatcaaaataaagatggtgattgattataacactgaataaaataggaaagcacaagtccttactgatataaatagagaaagatggatgagaaaccaggtatttacatagtttcaaagtagctcccaaaaacttaataattataaaagggtacagattaacctcacattggaagagcctagcagatgctttgaccaaatgatgaaggtgaacagtatccatgttgggaaagacattatggtttcccactaggatgcaagaaaagcacagcatcacttttgtgatattccaaccaaagatgtatatccttaatctaaacatttaaaatatcagacaaatccaaattgaggatattctacaacataactgagctataattttcaaaaacgtaaggccttgaaagtgaagggaaggctggactgcgcaggctgaaggggaccaaagagatatagcaactaaatataactaattagatcatttagatacaaagaacatcattaggacaattgggaattttgaatgggatctgaagtttagacagtagttaattttcttaagtttgaacgtcattttgtgatctataggaaaatgtccttgtttatgggaaatactaaagtattctggataatggaggcatcagggcagtcacttactcttcatgcttagtaaagtgaaaacaagggagtagtgtatttgcaaattttctgtaactttgtgtgtttttccaacatataagtgaattttaaagctgttatactaaaatatggggagcagatgagtgattacattaaagaataagaaataaggatatggaggatatgatggtggagtacaagttaacatgtcttggtgtgtatctgctgtgaacaaggaagctgaagacttaaatatgatgctgaacttctgtcctgagccaaccacactaggaagatgtgatgtcagtcacagagacagaaaacactagaaacaaaggctgagattaaaaaaaaaatgatttattccattttggaaaagccaagtgtagggtaccaaaaaatagctaacataaatgtaattggaaaaactagaaataaaagtgtggagaatgtctggaactagagaacttagaacttgggagtggtaaaaacatatgaacaagataatatagaaagatgaggagagctccttgcaggatacccatcttgagacagtaggaggaagaaagtgaggtaggagagaagctagaatagaagcaaccggatcgaaagatgcataaccagtggagtgccttgtcacaacactgacgaaaggaagatataccaagaaggggccttataaacgatagttaatattttaagcagcatggaaagctcaaataaaataggatgagaagaggcaactgggtttgcaaactgggatgtctatggttgagtttagaaaagggagcattcaattagagtgactgggcaaaaagatagcgaatagaagcaagactttagcatgaactggagctgagaaaataaagtggttggggagactttcttttccagaaatacattactgataaaaaggagattgctaggactttaatttaggaaagaattattaagcatggtagagactggagcatattttatttatcagaggaaacctaccaatggagcaaaaaatattgaatatatataagaaagaatacatttctagaggaagtaggcagtgatataattgaacaaatgcagaaacatatcttttaaaacaatagggaataattgaacctgtgagggcaaatggacaagtgacaccaacagaaaaaattgagaagtgtattagattatccatttaaacaaattaaatgaagtcctgtgcagagagtacaagtatcagatgtggaacaagagaccaggaaatttttaaaagtttgaaaattcttgaagaacaatgtgaaagaatttaaatctaagaacaattagcatacatactgaaataacatcattttgaaaatttttcagcgtgtaaaaatcattctaaaaaattcctagtatcggctgtatgccatgactcgtgcctgtaatcccaacactttgggaggcagaggaaggaggattgcttgagcccaggagttcaagatcagcctgggcaatataacaagacctatttctataaaaacttaaactaaaaattaaaaatgcttagtgtaatagtttgtttcctgccttgtatctctggtggcagccagcacataaagagaataaagaccttggcttgactattaaacatatgaattaaataatcagcatcataatgtttaaaataaatagtcatgtggttacatattatgatgcaagagaagagatatcctgggagttatgttcattgcagttgagacaaataaagtcactgagaagatatgcttcaagaatggagtggaagagtttatctcaattgtactagaaatcaagaaaggctttccatttataaaatagcctattnnnnnnnnnnnnnnnnnnnnttataaaatagcctattcaaaaccagaattgttctaaaatatgaaacggaatttggttagctgtatatttgaaagcaaaaaggagaatacgtctcaaggaaggtgtctgtgatacattaagaacatggagcaacactagagagtcacttgtacaatgagacaggatcattgtgcaacttgcatgctcactgtctttaggttcagttctctctactgaaaaaatactgtttgagattgtttgatattgatttgctctatctatttttttttttcttgaggcggaatttcactgttgttgcccaggctggagttcaatggcgtgatctccgctcaccacaacctccacctcctgggttcaagcaattctcctgcctcggcctctgaagtagctgggattacaggcatgcgccaccatgccctgctaattttgtatttttagtagagatggcgtttctccaggttggtcaggctggtcttgaactcccgacctcaggtgctccacccgctttggcctcccaaagtgctgggattacaggcgtgagccaccgcacctggcctatctttgtatatgtaatttataaagtgccctaattcattataccctcatgcacgcacacaagtatttgtaaattagcagctaagaattttgtgccatgatgccatcaagaatttatactgcgattatttgtttcttaaggaaactatcgtaacaagtaacatttttatggttagatttaaatgtgctgaatcatgcaaatatataaattatattaaaatttacttaaagaatctttaaaagtatttcactagaaatatgctttatccatattaaactaacaaaagaggcatttcaattgaatttttattttatattatttaataatatttagcatattatgtcatttaaaattttctcaatatgtaaatagttatttgtggaaccatgtacttgtttacataaaattattcttaaagtaaagcaagcgggcattgataagaaatcaagatgctgaataatccttagactaaaactaagaaacaaaaccaatggtatgggaaattgcaagtattgtaatctgtttatgtaagtagtttatattttgaaactactttggttgtatctaattttcccatcctgtgaacttctggattttttagaacaaaccttgttacttagcatttagttttggcagaagtttgtatgttagtcaaatctatttcttaaaaaacctgacatttccatagataaaagctatgaaatctgatagaatggaaaaatttctaatataggtaaatttatttgaacatagtatttatggtgaaagaggttttttttaatttaataatgtttcttgtctattcatgagccattttttgatttctgatttcatttggatatcaatatttctatagcaaatatttattttatgtccatagtataccagacagtgttgtaggccctggggatagaaaagtgaatagagtaaagcctttgcttttatggaacttaaattctagttgaaggaaatagaccaaacacaaacaaataagtacagtcattccttagtatccaaggaggactggtcccgggaccccgaggataccaaaatcagttatgctcaagtccctgatatgaaaaggcatagtgtttgcctgtaacctatgtacatccttctgtatacttaatctctagattacttataataccaaatacagtgtaagtctgtggttgtttgactcttcggatgcagaacccatgaatgcagagggctgactgtatgtggcatggcaaatggtgataaatcctttgaagaaaaataaagggtctggggataggaaatactggaagaatgtgtctagggcattactactttatatacagttatcagagaaagtctcgctggtgaggtaatgtttcagcagaaacctgaagggaatgagggcatcacccatgtagggcaggagcattagaggcaaagggaacatatgcggaaccttgaggagaatttttccttatctgctcagagaaggtgggtcaaatccaggggatgagctagaatgttctaaatcagctcttctcaaagttaagcttaagtcagaatcacttgggggcttgttaagcagattgctgggcctcaactccacagtttctaaatcactgggcctggaaagaggcccaagaatttgcatttctaatgagtttacccctgacactgctggtcaggtcaacaactggtctaagcaagtcccattcaccctctgccagtgattggtttagcgtcgtagatgtaatcctatcttggcatgagagatctaaggctacatcttcttagaacgtaggacttcaaagaaatgttttccttcctgatttataaacagagaggtgggaaggacaacccccaactcatcccttttacctaggggcattgttttatcaggatatggtgttcagaaagttgagccatattgtctaaacaaattagccaactcagagccctaacaaccatgaggttctcagatatccattgctggacttccttaattttagatatctgtatttgaaaaaaaaaaagtcattatggaaatcactactagtaggtaatctgttatttgcagcatatagtgtttgaactgatattaagtttttattttcccttaggaattttagtaaaaatagtggctagtttccaatatgtagtgtaaaggttcaggtatttcacaaatgattgcaagaaagcacttaaagttcatgtaacctaatcattaccatgatatttttaaaatagtgaatctctttcttggtgtcagtctaaaataccagaaaacactttgactgccttgccataggtactttggtggaacttatcttcactggcaccagatatagctggaaatcagtaacagacagtatccctagaagccatggaaagaaaaaaattccaaaagctaaggtatacatgtgggcattcatttttcatttgtttgataaacctaaagttgatgtataattactaaagattcatatagtctggagtttacctcttcattttgtatgtttatatcctgggaatgtctaagtcagattattatttactcagaatattacttatggtaagcaatgatgatataagtccttcctcactccctctaaaaatctttgacttcagtgctagcttgcactttaaacatgtattccaatattaagaaacaatcacttgttacaaaagagtagaagtacatgcaagattttatccaaaatccaaatacataagacataccagcactgatcatgttttgtctaatttctccattcttctttcttttgtggtctattcactaattacttgatgaagaatttgtttttttaaaagcattttcttcataatcttaattttgtctgatgctgcctttgtcaaatctttcattggtgcccttttctctgtgcagatggatgaaatgcttttgtaagtgacagacattcaaaaataacaaacatgagaagaaaaagaacagtttatctgtcaagaagttacagtaaaactgtggaagctccatttggttgtactccatgcgtttagaaactttttgactgaattcatttccattagagtcaccactggtgaacttgaacaactccacaatctccactcttaaattgcactcttgtgtttcatccctcacagaatttacaaaagtggagggtggtttaaaagcaagggtttaaaaaaatctatatttaaatgggcttcagggcctgaaatcctagtcttaatttcttaaattgtactaagatgttttatttttagtctgctgcacgttgaaggaaataggaaaacattagcaataaattttcagatacttttttaccacttttttttaaagggatggaagttaggatcaactgtggtagattcgcctagccattcagaaactttgggcagggatgtggcttttcttggtccctagggtggaattagcctggggaaagctgctagcccttctgaaaacttgtaatcagtgagcagaattttgtagtttttcctctgagtgcctgagcactcttgctgataatcacactcttttctcctgcaagggagcaagtgtgtatcattcttcctgcctgttggatctatgcacaagttgtcaaaaattaatctgatttaaggtttttcttttcctgaactcagaagggaggaaattacagaaaagtatattagtaatagagtaatagactatagcctgagggaaatgaaagcatatctaagcgaagccaagccaggaacaagtacaattttaatgaaaaatcaatgtttcatgacttagaactgacttttgttaggcactaatatttcctgcttttctgtcaacatccttatcattataaattcttttttgtttcaatataaaggtactaaaaaattaacagctaatagattattttcaacctgtttgcaaggctaaagtctctctttgcctttgaaaaactggagtagaataaaaatgttatattaccacaatggatttaaaggctaacgagtggtcaaattgttaattattcagaaatttcttattgaaatgaagaactgtctggatggactggactgtaaagttcatgagggtatgggtatcaacctccttataattgtgtgtgcctgatatttaaaagatatgtattaatctctttggaatggctgaattaattaatattgttattcagaatattatttagtacaataattcataattattcttttcaatgccctgaagatgtatcagtgttttttcctgctatattttaattttattgacataatttagaaacaatgtggagtggtcatttttcttttaatctaatacagaaaaagataaaatgtttatgaatagaagttctgcctttgcttttgctcctgtccccacataccctcttagaatggacaaaatacaggaagaaaacttttacctgagttcttaattttatttacatcttacattaattttcacctttttgtgagaaaaataggtttaaaaagtagttgattttttaaccttgcctccacctactagatggagagtattgtcattactgtaaatagaggaaagaaatgatatagaagcccatgacttcaagaagtttatggtccaactcatgacacataaacagatctgaaaaaagtaaagtctaggtaaaatacctcaaaaatgtgtgtgtgtaatataagtatgtatactatacgtaagtattctactaaagagataggaagttttcaagaacagcgatgatgacttgtggaaaatttctgagaagtcattaattctcatctacatcttaagaagtcagctgaactttcaactgggactgggtgtaagcagaggcagaaaagttgtaacagacaggctatatgaggattttccccaacaaatttattcatttattcaacaaaaaattttaaacactccctgtgtaccaggcatgattctagatgacagcattaaaatgnnnnnnnnnnnnnnnnnnnnnnnnctatatgtatactatatatatatacacacacacatatatacaaattaagtaatcaagatagttttgaagttttgatacataattcagtgaagaaaaaaagagcagtataatgtgattttgagtgagtttcctgagtaaaactaattttgaaaggatttcggataaatcctcactgagttgatgtttcagctgagacttaaatggaaaaaaaaaattagcctgtcttataagttgccagaagagcttaccaaggagaaggaacagcagatgcaaaggccttgatgttggaacaaactttagatattcaaggaatagaaaggatcatgaaggcctggtaaaccatggtagagaatttgtgttttaagtgtgaaggagagccactggagcatataaacagggaatcatgatttgatctgtgcttttaaggatcactctggatactccatggagaagagattgtaagctcctcagagtgtgtttagagcacatactgctgcaatggtggctaagactaagggagtggaagtggcatgagagagaaatgggtgtatttaatacttttagatacagatacatagtacttgttgatagattaaatgtaatgtaggaaggaaaataaaatgaagaatgataggtttttggcatgtgcgactaagtggatgagtttgctatttcatttggttttgtgacattgtgcaaaaaataagctctttgaaatctaagtaagttgaaatctatgacttctttcccagataggatgaggattgaaaatgttggatttgatatagtagaaaaatctattgttattagaaaatagaattatcaaattttccagtttgagttacttagcattatatattccaaatattttcctagtttcttttgtaggcattttagggatttcaaaagcatttgccctacttttgtaataaactatttttaaaattaaaaaacagtgcttaaatacacaaatctgtcatatacagaatactaaaaaatatggtcccttaaattttgccataaagtttctttattcctgaacagatgtaaaaaaaaaagttttcttctaattcttttatatgtataacttgaaattgcaatgttagttactgagatgatagtgtgtaataacattcagattctatatattgataacatgcaaacaaatagtacattaaatagtttctataatatcacatctatctttctcttttttttttgccccttcaagcaacaaaatgcattatttttaaccctatgcaaccatctttcttaacctttggtttcaaatttagaacacttcttttcactgattggctttatagtatgatattggtcataagtgaatttaaacttataaagttattaataaaatagttatactccatttcatatttctttttcaaaatgatttcatactaaaaagtttggaatccttgacctaagtcaatgccctcttcctatggatgagaagactgatgtttattgatgatttgattttctgaggcagtacagacagttgaaagtgtgggaacagaaatcaattccctctacttttttcaatgcaccacatttatttcacactgtccatgtagaatcatcagttaaaatgataatatatgttcaatccctattttcatatcaacaagaataatatgagtatataattaccagaggtctatcgtaataatttctctaatgtgtttaaagaacaagccagagatttttatttgatagagtatactgatagcatcaaactgaggatgccatttgtttattagggagaattttataatttagagtttttttcaaataatatcaacagtaaagtctaaattacttattgcctttaattctaggaatgtcgcattaagtgactaatgaaacggaaataactactgcccatgtaacttcataaatgcccttcatagacatttatgtcagagcaaagatggcaaaatacttgataatgacattatctccccctcacaacctttattttaatgctgtcaatcaaaactgagccagttaacatttctagagaataatattttatcaaatagataagttatttgtaatcatgataattcttggttggggcctctgtgataggctgaataatgtccccccacaaagatgtctacatctaatccccagatgctgtaaagatgttaatttccttggaaaaagagaatttgcagttgtgattaagttaaggatcttgagatggaaaagttattctgcattttccaggtagatcgagtgtaatcacaagagtgctgatacatgtgaggtagcagaatcaaaggcagagaagggatgtgatgacagaagcaaaagtgggaatggcctgctttgaagaagactggggccatgagccaaggaattcaggcagcctctagaaactggaaaaatcaagaaaacagattctctcccttgagtctgtagaaaaagaaagccctgccaacaccttgattttagtcccataagactcatttatgacttctgatctctcaaatatataaaatataaatttgtgttgttttaacccacaaatttgctataacttgttatagcacttatacctaatgaatacaaattctggcacctgcaagtgtggtcttactgtaattgatatctaaaaacatgaaaatgactttggaatcggacagtgggcagaagcttggaagaattttgaggcatatgatacacggcctaggttgccttcaacagactattagaaatacgaatgttaaagtgtgtgtggcaaaggtgcagaagaaaataaaggacatattggaaactggaggagaggggtttcttcttaggtggcagaaatttagctgaattgtgcagttctggggaaagccaaatttataagttatgaatttggatatgaggtaaggtgatttccaagcaatgttgaaggtgtagcctttccagacacacacacaaatgtatattatatatacacacttttataaaactatatatatagctatatatacacagacattaacacacaaatgtgtattacatatgtatacacttttataaaactatagatatataaaactgtatatctacacatacacagtcacacatatacacacatatatatacatatataatatataatttgttggtattatcatctatatgtagtggcagttcaaccttcactttgattatgaagtagcaaatgctacagaaaagtcttaagtatttttatacttagcaattaaaaacagacctttatattgaaactctacatgaaaaggattacattagttttattgcagtattatggtaatatgatttctgcctcttttttctatatttatccaattgcagggaaaaagtattaaaatccagtttggcctcattgaagcacatttgcagagtgttatagagcattggtttatgactattgccctattatagacaaacaaagtattctttatcctttatcagtgtagtgactgaaattatgaattccattcagtttttaatgaaatgtggattacttcaaagattatctatctgatttaataaatgcattagagtagaaagttaattggatctttcttgaatgaatggtgaccactatgtgtgattcataggagggaaagatagaatatgatattctttgagtttgttttatgtgtttaaaacttttaggttagaaaatcaatttttgtgtgatcggttttctcaaataaattatgtaacccctattgatcttacaaaaatcatggagaaattttaattcattttaaaataaaaatatcttaaattttgtaaaaatgggttattaaaaaatgccatatactgaaacacatgtgtagtttattgtgtttttagtttacaggcagagaaaatgaattttaccccaaacatctgcatagttctagatttgccacctcctgtttttgacacagatctcaactgagcttctaattttggaatcttgttccagttcttatatttcctattctgtattcaagagctcattctgtattaactggtaaagaggttatcatttctgcttggtttatgtagacactctatattcttcattgtttaacaaaatatagaaattcaggtgcttgcaaatatgatggtagaggtgacaaagtgatactcatcacattttgtatatcgttagtagtggcaggaagagccttacagtatgagtattactaacccttacgtacaaatacagattatcttttcgttaacaatgttactctttctgagagatgttcatgtgagagatgttccatattttcaattcaaacaatcttgtaattgctggctgctgctgttgttcacagcacttggctttgcatctgtgcctcttacaattccagtcttgccctttgtttgaggaaacttcctggttcttgtatacctcctgctttcttgatctatttgctgctgtttcccaggtgaaaacccaactgggctatgcatctgaggtagggatggtttcactgtcctagcacatctttcctctattcaccctgatcaccatcatcttggttttgactcttatttaaaaaaaataaaataaataaaactgctttgtattatgcagctattatttttctgacaagttcagccactgtggagacagtttgaagtaaatgtggctcattgttggtggtctaagaatgtctaaagactagagcaaataagaaaatgttaatagagagaaggaaaacagaggataaaaattgaagttcctaagaagtatgtagctaaaatttcgccttatctaattcaggcattttctcttggctttcccagcacagtacttcttagcgatgataacaacagcaaccactttattaatttgctttttttaaatttagaattcacatcatcatggtaacaacaaccatcccttgaatatgtctttgttagttgcttaatttgctacacctaactcttccaccaggcgctaaatattgggactattggccatccattcagaaagtattatgtgcttcctgtctgtaatgcactaaatcagacattgtgctccaaagaagagggttgtaggagggaaggcatcacacctgtatgcagttactatgcagagcaggcttgggataaaaatagacattggccacatctgtgttaaatcatgagctgtgacccttctcatgacagttccccagctctgctaagacacgttctttggaagaagttgcttcacttttcatttgggtagaatatttacagtccaagtaatagatttcctataatttagaatttactaatacttcctttaaacaagtatatgattatccaaaatgtatataggcttttttgattccagttttataaaacaaatcactaatccaatgttgtgttttaaatagaaactttgctgtatgtaatttcagttggcattcgttatatatttacttaatgtgggcatttcttttcagacttatttatgaacatagaccctatctgtatttctacgtctacctgagtatagaaaaatacactgttttttaaattgttatcctaaaatagtggtctgaagcttgcatttttgaacttaaaatagtgtcttggacttattttcaagtaagaaaatataagtattccatagcatgagtatatgtttaatccttcctatactgatgaccatttagtttattcagatttcttgggattacatgcaatgatgcaattaacatccttggttaagatctttacattctctgttataggataaattcctagaagcaatattgtcaggtcatataatatgtatacattttaaataattacagccaaatcaccctcagaataattatacaaatttacattccaaacaatatgttagaatacctatttctccatatccttatcactactaattagtgccagtctttaaaagtttcgcttatgtgatgggcagatatggttaacattttgtgatgtttcatcataacatgattcagttaatgataacactgcttgttgtaaaattgttgcatgaagaatgaagagacagttgtaaaattgttgcatgaagaatgaagagacaaacgcagttaactgttcaacttgtgtggtgcattttgttgcactttgaaaaatgaaaaaaatcaaacatttaaagtttttttattgatggctgctccttaagaaaagcctggaaatactttagtttgctttggaatgtctttaagtgcatagtggtcctgtcgcatttcctgagctgcagtagattctaaatcatcttgatttaagataggcttttttgtaatcactgacagtctctgatttcagaattctgcagacattgtcattgagtggagcagtatctctagaagttataagaactgtactttttgctcttaataaaaagtaaagtgtgtcaaaataatcaaagtggaagaaagcatatgtaacagccatacaaataaattgagattcattagataagctagttggtagaggcaaatgtgaagaatatttttaaattcactactaagataatttttttaaaaaatgttaacttaaagttgctatttttaaaatttgcataatgctttgaagaatgacagtaagacaaatgtcatcacaatcataaaaaatgtgtataaagtacattagtattttaaatttctcctagaaaaaaaaattgctgcatctcttccaagatatataaccaagttagaaaaaaaagttagataaatatgcgtattaccagttaagttcagtttgacttctgcttaccagatgttttgatagaagtctttttcagtgttcactatgatgcctgtttctcacattgctgtgaaacatctaagctatatatactgttttttgataaataacatatggttttgaaaatcagtgttaaaaccacatgaaaatttttaaagtgaaaaattcagttttactctcaatataataattgttttaaaaatctttaaaaaataatgttaaatttcaccatgatatgtacagctgtctaaggagtctattacagggacaaatagaagaatgttatacattgctcaactcaggattacttccttttttttagttttagaagaattcagttttagatttaaccaaataaccagtaatgtatacatctccctgatctgttgtcatgagcacaaaatttatttactgacatgatgctaagaggttttctgcagatactccaaatctgactgggttttgctccatttttctttcactaatcaagacttcagtgaaataaatacatagtaaaattctaataatgctagacttatttcccaaatgtcttgatgttaagtgaataataaactccagatctgattttgtaaatattattttaagatatgcattcttaaatcttgataggcagatgttctaggaggctccaagagagctcaattgggtaactctctcagaggactgacttgctccatatttgcatcatacttttgtgtggtttcattcacaggcacagttgcccatcgtgcaggatatcattaaatgacctaaattaacttttctgcaggaagtggaggaatctcaggataggagaatccagttttaaatacccctgagacttaaattgattcagtcttaatctgggatgactcaaatgacttagtatataatgtctcttgtttctctaaaagagagtctctcaatgacagaggcctaagtctggagatcaagtatgtagtcctgttgactgagaacaggcagaaaaatctgattaatccaaaggaaaaaggcgagggaggtggcagcacagtgaacagatttgcacccaagcacaactaaaagaatgagttagggagggcggggagcggcggcttgtggctgtaatcccagtactttgggaggccaaggcaggcaaatcacctgaggtcaggagttcaagagcattctggccaacgtggtgaaaccctatctgtactaaagatacaaaaattagctgggcatggtggtgcatgccagtaatcccagctactccagagactgaggcaggaaaatcaattcaacccgggaggcagaggttgcagccgagatcgcaccattgcactccagcctgggtgacaagagcgaagctccatcttaaaaaaaaaaaaaggagggaggagacggaaagaaatcagttcgtttattttcaaaatgatcaaggatgaatggtaggttcctttacaatttttgatgtatctatttttttaccaactctttattttctttatttatttcagtattttagtttattaagtacttgcagtgttattaaacatagactgaagaatggaaatatgagtaagatatgtgtattaattttaggacactcacatcgtagtacttgtccatgttcctttttttgcctttttccattgatgaaggttatcttctctcttgctcatggctaataattatcactttttctcttaacaaattattttattgttgttatcatttcttacctacaaagttactattctctgtacaactctgttgctagcaaccatcttacaatttggttatccataagaccaaattttgtctctaaaacatctcctgggtgtagctgctcccatgaagacaatatagctacaatggagtatgaatccatataaaactcagtagtcttattgggctcattctctcacagccctgggagaagccttggttgcctgtgtctctttctcatattttgaggcatgcttatggaacagaggtttcccaaccctattcagaccccaaatataacaactgtttgtaagaccctctgtactatgaaaaagaaaaatccattccattccatttaccaacatacgtaatttcaaaagataaccaaagttacctaactttaatattaaaaagagctaaaggaactaaaacatatgcttattgcctaaactgttgaacacaaccacattagaagacagaaagaatactctgatgtttgccactattctgagaatcaccaaatgcaactactaattatgcagactgtcctgtagatctcaggatgtctatcagccctgccctttcccactaaatattatagagtcttaatctaactgggagacccaagtgtccctacacatttcctagatgcctccagaaggcactatctgctatactgagaaccattgctatagaactttaccttcaatatcacttcttatttgtaatgtctgtccctggtggctctgtagaagattttgctctcaatcttccatgagcaaatagaaacttggaatttttttttctgtttcctaaaatagaatacagatatgtccacacttggaaatatgatatatttttatgagtatatcttcaagtggcagatcataaggtgaaatcccaacttgccttatattgtatcattaccatgttgtcgttttgtgtccagatgacattggcagtaagcagcgaaggattcagtaatgttttgataaaaagagcattaatgtaattatttatttatttatttattttgagacagagtttcactcttgtcacccaggctggagtgcagtggcacaatctcagctcactgcaacctctgcctcccagtttcaagcgattctcccacctcagcctcccaagtagctgagattacaggcacttgctacaacgcctggataattttgtattttttgtagagccgggatttcaacatgttggccaggctggtcttgaactcctgacctcaagtgatctgcctgcctcggcctctcaaagggctgccaggcttgagccaccgtgcccagccaatgtaattgtttttaatctgcatcatcttttgaataaaaagacattttaaatatcagaaaatgaccactgtctaaattttctttaaccagcataaatggatgtaaactaagtagtttgcaaattttcatgtctgtttcacttttatctttctccttggtaatatgttttctgacattgctgtgaaacatttcatattacttaaaatgtgtatctttaacagatttttcacttttcagtttaaacatttcacacaatccacacgtatttattaaggacttatatacttgacataacaccaattgatgtttcagtcatcaaatcttgaacacctacttctgattgtctaacccttctttttcaaattaacaacaaaacaaaccaaaacaactgtctcatacaactactccattctccaaagagaagttgtaaattataaaactttaacagtcttattttttctttgatggcctacttaataaatctaaagggactataggtttacaaccttggagtgttgcttttgatttttttccccctgtatcagtccctaaaccaaaacatttacagtactgtgtatatttaataattttgtactgactgcatgaagatataaatgtgtgaatgaatacagcttgttaaacatgcaagtatatttcttcaaagaagagtttacggattctttttccttagcaaagggaagttgtattaaacattgtggtggttgaaatgctgctaatcaaaaattggtcatcgatttgaatacatcttatagcttttctatcatgttgttggtttatttctgaaaacacaagggagaagttgattgggctgccttagctgcctttttctatggtgacaggtgtttagactttaatccctctaactgtgcacatagatgtttctggtgaaaagaatgtactgccctttgtataaaaaacataataatgataataatgtaagtttgagaacggtttagtctacacagttattgacaagaggtacagcttgtactggaggaccagtctggattcaagaagatggtcctaagtgtaccgaagtatatcttttcgtatgaagatataaagaatagaaatatgagtggtatttgaggtgtccgcatcctctttggcactcagaggactctaatcaaacccaatgttgtgtactgaactattcctgacttgtgaaattcatcttttatcccctactttaactttttttttttgagacaaggtctcattctgttacccaggctagagtgttatagctaactacagcttccacctgggcccaagaaatactcccccctcagtctctcaggtagctggaaccacagacacaagccatcacactcagctaattaaacaattttattttttgtagaaactagatctctctacgtagcccaggctgatctcaaactcctgggctcaagcaatcctctcaccctggcctctcaaagtgctgggatcacaggcatgcaccactgtgctcagctaccccaattttaccttttaaacacaaaagctttcattaaatgtaaagccaccatttcctttgactttcaaatccatgtatcagtaaaataaaacaaaaatttatttgaatgcaataatagcagacatatgctgttctaaaatcctcagaaatctggcagtggaaactgtgaagatagttatgatctcatgaagtttgaatatagtcctaaactctttggaatgagagatttgtcagctggattttcatgctctaaatctgacttcaataactttcactttctgccaagatgtatccattatacctcagtatctcctgatattctccaataaaatccactgtcaaattaaaagcttagttctgtcgtttgtgccaggccccaagtgctacccttatattccaaaatcagtagcgctttttccaagttattactcagggagtataaccaactagaaaaaaatttagaaatactagaagcatgttctcctagatttcctacatctatccctaccaacttcccaaagagccctgtagtatcttcacctaccttcctatcagctattcagacataaaaacagctgctttcttcctgggaagatcacgtaatttagaactggcttggggtgtacctctgggttaccaaaaatgattttttaaaaatatctgtcattcaagaaaataagatctggggtcaggtccaggcaatattgtcctgagggtgcttttcttcttctcgtggctgatattcccgcagtgacatatgatataatatgcactaagctgatactgcttcagtaaccatgtctgtgtctgtgacaggtgctactgactcctttcttcatgttattgatctaaaatattttttaaaatgtagaatctacaaaaccctggaggcctttcatccttggaagctggaattattgcatcttttcatccttcttaaagaggggaatgttttcacccttacagttaagttgacagttcatatgcgatgtttacttgactttttatatctggttacaataaatgtataggctgttaacacataataaataatgactcatatatttgatttaaaatttcctggattatctataatcagaatttagaatttctctcctagaagtgtggcgagctgaagctattagagctgtggcctttacaatcctttaacggaataacccatctcctgttgctgatctgaaccgcataactggctaaactagtgcaggcagcatgattcttcacacacaaccagatgccagaaagaagaaaaccacaaaggggctgaaaaacacagcatagagcccagaagcaagagggtaaggtggggcagaaaccaaccagcagtgattggaagggaagattaagtcaggaggcagggctcaaagggcatctgaaggtgagaggcagcagcccgaggatgcctcaggagtctgcgttgtacaagaagctggacattagagataggtcgcaggtcaaaatcagatagaattttgcgatcagagcagacacagcaaaccagaagcacttgaactgttcaaatagcaccttctttccacagcaagtccttgctgttgtgactgcgaatacactggtccactgaagcctgtgacacttgcaatttgggagcttatcacagccggaggaccctgacacagggtgagggtgcaggaaagacaggacatgagattgaggatgctgactcagacaggtcactggaccgttccagtgtttttcttacagggaaagagtgtaggaggcagtgcatctctttgtctttgtcacttaacttttggtgttctttaaactgttctaaattagttcaagatctacaaattgaaggctaaagaagggaggataaataaagcccagcccaagcagttttgattgtagaaacatttggaagtatttgggttgttaggggaaaggagcatagctgattttttttaaattgatttggagtttggttatttgtcatttactcattagttactttcctccccaacaataacaacaaaagataattaccatagtctgttcttacatgaaacactgagaaattttatgtagacattgaaattacttcatcagtttcttctgtgaatgattcatttcacatttcccagtcttatgtaaattactctgcagcatttatatagcattagtgtcatgcaatttgtatcattattgaacatttattttcttttcaaacaaagtgcaaagtgccagaggatgggaagtatatctttagctgcagtttgaaagaaaatgtaccaagcttggtgtcggatgacctgggttctacaaagcagtcgtgtacgtttagccaaatcacctgttcaaatctaggttgcccaaactataaatgcacttgaatgagtgatttttcaagaatgtggggcaaaatgaagtcagagcattcaaggctgtggtatcttatttctgtttcagctactgtgtctgtgctctcagtgtttcatatattgggtccctacgtatgattttattttttaaatttctactgctaataaaagtttcacagatgtgatagtgtccagtatttctttcaaatttgaagtttcatttgatttaatcattttatctatcatgtcatttagtgtaatttttgaacctagtaagtgtctaataaatatttgctggggaaaaaaatgaatgctatggttcaatcatgcaatactcagatgttcgtaaccatttccatgtgaaaagtttagtataggctgtagagaatgacattttagacttttgaggggaattatttttatgtcagcttgaaattcttcttgaacttgatttctgacttgggggaaaaaaagcaagcctgatgtgcacaagctttatacagagaatcaactgtttttaaaagaataatccagctgctatctgatcagccaggtaggagttgttctgtggaaatgaagaagccctccattttcagtcagagtcacgcatataaaggctttgataagattaaaataatccaagaatgcaatttcaagatgcacagctagaaacagcaactaagaaatatccatatcttacaggacacagctaagggaagagtcaggttttaaggaccgtctacagataatgtcaggatgtacagataaatatgagcaactgctgattgagctagaaacactgctggttaagttataaatcttatgatttttacccttcaaaatgcctctttccttgctgctttatatttttttaaagagcggagtatgttgtcacttggaggttgtgctgctttcctgtgactttagtcacctttggtgccctggccagatcccttttaccaagcctgtaaaatgcccagtttccgtcagtgttagctgctattggctcacagcccccacttctcttcagaatcacttgtagctgaaaaacatttactttgccaaaccttatgtgcccatctcccagcactatcagctcatatctgatgactaactgacatggggaatacaaaaagccagtgccctcacttcattaggtcaactctggggcaattcatgctctagtgctccccgtgacatcaggctgaagttagacttatgctaatgccacattctcacttagctgctttccctttcctaccctactttcctctctccttttcatctgacaacactcccttaataaatcatgtgcatccaaatccttgtcttaggctctgcttctagggaacctaagcagtgatatttttgagagtatagattctttcttcttttatctttcatcctcaatctccagcacatctggatcatgatgctttacaagtattttgaagagtaagcaaagtaagaaatttggccttcatttggtgtgttagttagtccttgcattgctataaagtaatatgtgaggctggattattattattattattattattattattattattattattattattattttgagatggaatctcactctgtcacccaggctggagtgcattggcactacaacctctgcttcttaggttcaagtgatttttctgcctcgcctccccagtagctcggattacaggtgcccgccaccctgtccagctaatttttgtatttttagtagtgatcgggtttcaccatgttagccaagctggtcttgaactcaaatgatccacctgcctcagcctcccagagtgctgggattacaggtgtgagccactgcatgcagtcagagactgggtagtttataaagagaagaggtttaaatggttcatggttctgcaggctgtagaggaagcgtagtgctggcatctgcttctggtgagggcctcagggagcttacaatcatggcagaaggtgaaggggaaccatgtatcacttggcaagagagggagacaggagagggaaggtccacactctttaaacaaccagatctcacaagaacactcattactgtgaggatggcaccaaggcattcgtgagagagccaacccccaaaaccaaaaacctcccaccaagtcccatctccagcattggggaatacatctcagcatgagatttggagggcacaaacacccaaactgtatcagttgatcaagaactgaccatggaagatggatagttgaagtcacaagcagtccagcacaattctaaccttaccatgaatctgaattcttagctcactaaagatttaggaacagaattggggagtagaattatggtcatgtaaaaatagagtccgtttaacatcctaaccttaaatcagaaaccatcaaagcatcatatcaacaaaaaaattgttttcacttatgaaaaatatgaatattaacacaattttgttgcacacttactctctgccatatgtcttacactaggcattgagaaaatactaaaaatacataggatatgttccatgctctcaagaagttgtgaattgtgaaagaacctgatagttgaagtaataatttcatgcagtgtgcctaaacatgaaatagaattccatacaaagtgacatttaaataggtagaaaaaccagagaccatatccacactggtaacagcatgggcagaggtttgcagttagacatgaaagttaatgcagtgttcaagaatatactgaggagttagtaagaaattaggctaaaatgtatgttgatacagatatgagaaagggctgtaagactcaagattcactttatcttgagggcagggtggcagctatcaacagtgctaaagcactttctcttccactttaaaaattaaaacagtgtggtaaccttaaaaggtgttctgaaacaatattctaagcaactgttatcacttttgctttttccttttttttatcaggtgcttacttaaacatttctcataattgcaaagattgtgacttgtaattatttgtagttactattttaccatgagctttacccacatttttatgtgttttaattttaagtggctaaatattattataaatagtgtgtgcagtataatttatattcgtcattttcattttccctgaaatctttgtaggctattaagaagaacaatgataggatcatatttaagttttagaaaaatgacaccttaaaagctgcaggtagattaggatgagtaggacttggagtcagaaacttcaataagggagtggctgcaatatagactaggaaagaggtgataccaacctgtcagtgtcctcatcggtaaaagaagatacagctgggcacagtggcttatgcctgtaatcccagcactctgggaggccaaggtgggcggatcacttgaggccaggagtacgcaccaacttggccaacagagtgaaaccccgtctctactaaaaacaaaaattagtcaggcacagtggcacacgcctgtagtcccagctactcgggtggctgaggtaggagaattgcttgaacccaggagaaggttgcagtaacctgagatggctccactgcactccagactcggtgacagagcaagactctgtctcaaaggaaaaaaaaaacatacaacaagcctcataagtgcttgtgaaagctaattgaaataatatattaaaagagtttggcatttagaaagctctgaaacgatcattcatttaacagaggaagctatgaacattttttttttaaaggtcagtttgacttttaggcacctgatttcctgaaggactctttgaactctttgaatgtgggtactgttttatgcattttcatgtgataactaaacagcctgatttacattcttgcccaatatacgtatttcttcaaataatgaactaatgaattcccgggcaataaataccttttggttaaatggacaaacagttctgttcagtgggaaacatgctagtagagtctgcttttaaaggaattgctgtatgcagtattctaagaaataatgaggaagtatttttacttcaaaatactttgatcataatatgatgataggtattttcttctcttgcctgtgaaagtgtgtgttaggtatgtacattatggggccaaactagtgattgttgctaattaggatatatgtggcgcattctatcaagaatcccagttttctgggcactgtgagctgtaagtcaagtcataaaaaggagtgaattgtctttttcatatatagcactgaaattgactggagttaattatttaatgcctacctcccctactagactacaggctgtgtcacacacctccctcagcatctagcacagcaaatggatttagtaatatttattgaatagattaagaaatacagagtgaataaaataggacactggttggagtgttgggtcaaccacaattttggtgtgatatattctacatatcacagtgagaaggaaaatgatataaaatgaataatatcctccttaaagtactatacaaaaagaatacttcttatattttttcaagatgatgtaatcttgtcaaatatataatatgttgcatgccagtgctttcttaatccttaatagtaataccagtaattgtatattaagttcctgctatgtgtcaaatacttctaggtactttaaatgtatattcagtaatcttcagaacaagcctagagagcagaatttagttatttcattgtaaagatgagaaaagtgggtctcaaaaaaagcagataacttgtcccagatcacacagtagtttttcttggtacctggagtgattttcatccctctttcaaatacaaccctttggctattgggaagtagctattacaactgtattttttctttaacttgatgtaagggaaagaccactttacacatatacaaataggagaaagttttgccagaccttctgcagctagtatttacatgagtgagtagagaattgtaagaggttctggtagcagtaaaaacaaattacaaacaacggaacatgaagagaagatgttgtctaccaacatctgtcaaatatggcagatgatcttctttgtcttattttgttcaataccactcaatatcatcacttaggcctctctctcttactgtttagatctcttgggattctcttaattttttaaagcctataccttgaaaaattctgtttaaaaatacattggaaagcatatagattttagtaggctgaataatggctactggaagataccaggtcctaatcccaataagctgtaaatgttatcttttagggaaaagcggtctttgcaaatgtgattaagtaaaggatcttgacaaggtagattatactggattaacagtgtgggccctaaatccagttacatgtattcttataagagcaaagcagaggaagatttgacagaggagaagtcaatgtgaccacagaggtagagactggagtcatgtaaccccaagtcaaggaatgccagcagcactggtagctggaaaaggcaaggaatgagttctcttctagagcctcagcagcgagggtaaccctactgacaccttgattttggcccagtgatactgctttggggccctctagttcccagaactgtaagagaataaatatgtgtggtttttagccatcaagtgtgtggcagttttctgcagtggccttgagaaactaatacagacatagaaaattattttatgactttttcttttagatgcagttgttaagtcagcatttgatcttatttgagctagatagaaccagggttttctaatctacaaactattgattttcatcttgatttaaatgtgtttacttattcttcctctataaggtaggacaattttgcaaaagatgtataagaatgtgtgtctcctttcaggttcagctgaaataatcttcatataacaaaagttagagaaaacaatctgtctgagccagagacttcgttatatgaattcatacaaactaatgaaggaatacaaaacttggcctcacagggagagagtggagtgtcttatgcaaatctttgttgtcagccacattcctacatgcagaatgcaaaaaccatgtttcagtttgttgaggatttggaaatagcttgagataatcttaatttaaaaggactggcaaattctttcagctttgtagaatttattccacatatgtcaaagacaaacttgttgtactgcaaaataaactagtactgtgtgatcttagttgaaaaggtaaatattacaatttacattctattctctcatattcattcttttggtacatgttaataaattgcaaaactatattgctgaaaaatctaatgatcctgaaaaatctaatgataaattctagcaattatcagtgattacaatataggcctggtttgttgttgttgttgtttttgtttttgaaaaggaatcttgctctgttactcaggctggagtgcagtgccacgatctcggctcactgcaacctctgcctcccaggaggttgcaattctcctgtctcagcctcccaggtagctgggattataggtgcctgccaccatgcccagctaattttttgtatttttagtagagatggggtttcaccatgttggccaggctggtcttgaactcctgacctcaagtgatctgcctgcctcagcctctcaaagtgctgggattacaggcgtgagccaccatgcctggccataggtctcattttgtacactaagaaaatgtcaaattactaattttcatacttagtgctaaatttacatttatcataaatgtaaacatgtaatagagaaccagtaattttttattttccttaaaaatgatcctggtaaataagagaattgattcataagatcatggtttgttgatgccatagcaacataatcttatattgagaacatcatctgttacaatgcaagtagttgtggccatgtgcctagaatagacttagttattaaagtacattgtgatatgatagaataagatttgtccagatgtttacagagctcttacaaggaattattttagtctgtttctaaattattttagtgtgttcatctgggttgaaatgttatgtgcttaaaggattgagttactgtgatgacttggaatatttaagtagctttgaattgtgcgggtatgttaaatgcctgtttgggaaagaaaaataatatgagtgaacagagattaaaatttgtgaattatctgattgccctagagatgtctctatttgagtttaaaataagagattggcctggtgtggtggctcatgcctgtaatcccagcactttgggaggccaaggcaggcagattgcttgaacccaggagttcaagacaaacctggacaacatggaggcacctcacctctaccaaaaaaaaaaaaaagaaagaaagaaaacattagccaggcatagtggcatgtccctatagtcccagctactccagaggctaagctgggaggatcgcttgagcccaggtgggtgaggctgcactgagccaagatagctccattgcactctagccctggagacagagtgagaccctgtctcaaaaaaataaaataaaataagagatcgaatagttctgttttaaaatagtctaggtgagaaatgatagtttggttttttttgttttaatcatattgtttaaaagaatacttcccagcagagttttattgggaaaccacaccaaaataaggaacatgctgggggcaaattcagtggtgaacataaatctgaatgttaagaagacaaaggaggcaacaccagctccagggcagaaggagagttgagaaagttaggaggggctgacactaccaatctagcatccagagaggtttgatgaagaaaatttgactttagggagttgtgaatttaagatcagaagtgatttatgcgtagaaaatgatttctgtcatttcacctgattcttgtaacttcagcttgaagtttctaatttcaagaaaattagaaatcactcgtcagctaagatttggggaaaactgttaatagtcacatgtgatgttattaacaatttattggatagctttatcgatcctgtttctcaaattatacttggttttacagattttagcctttggtttgactcttcttttgccccatttttcttggctgctccagctccactgctgagttcactacaggtcagagaactgttcagtatttttaaagcagaaaatgcggtgaggatgggattttgtaatgtaagtttttaatctccgtatctgagcattttggttcgtgcagtgatcccaagtagctgagatgaggcaggctccagtatcttaacctactaagtatgtgtaaacttgatagagaacacaattttcctttaaatatcttagctctctagtctctcaaattgtgaaaacatattgggggcagattgtgaaagaaatatgttcataaaatataaattcagtgatatccatggaaagagcaaactcagagtgaggcagatggaagaggaataacttggatcatccaggtgggttaggtgttccaggaaatactgaggacccccagccagctgtttgatctggcaatactggaggacggtgcctcagcgatcccttcaaaatcaatgaagatttttcctttactccgtaagctgggggtcattgacagtagttggactcatttggagtgaggtgcatagaaactggcttttaggaattcaaaactctcatggaatatgtgaaccacttggattcagtggatttgaaaataatcgaaaaagtaaatatactaaaggtcaaggaaaaatgaagtcacttgcttaaaggctgctgagtattagattttaagagaagaaacgtaagggaccaaaagttttcatggcaaaaagacaaaacaagcacccctctgtcccccgaccttccagccccgctaccaacacacgcagtgttttatgaagtggtcgcaggagaatctgaagcagccataaagaagaaaggagtatgagagatccaactgtgccactaacaggcacttaatttcttctgagaactaatttataccaactactctagcttttcaaatagcaagcaaaagccaatttgcatttacattgtaaaactctgttttccaaacagtggcgtacagagtgttggtggtcaaatctctaatgtaagcgagggatttggggatcaaatatttcctgaattgttactctttgctagagagtcaagataggcgctggtatgtaccctccaagaagaaataaatggaaaacacacacaggaaacaaacctttataagctttcttcaacattatctcatataattcttagaatatatataaaagaatattactactacattttatagacaaagaaactgagattcaagttatgtaacttccccaactctatacattggtgaatggtcacttcagaaagccttgctccttctaaaactccagcctacctctattaggctgtgatttaaagttcaaatgagaaacacagccaacaagtgcagagaaattccgaagtcccttgggggattgagggctggaaaaggctttgtggaagagatgaaactttctttctttttttttgagacggagtctcgctctgatacccaggctggagtgcagtggcacaatctccgctcactgcaagctccgcctcccgggttcacaccattctcctgcctcagcctccctcccgagtagctgggactacaggcgcccaccaccacgcccggctaattttttgtatttttagtagagacagggtttcaccgtgttagccaggatggtctccatctcctgacctcgtgatccaccagcctcggcctcccagagtgctgggattacaggcgtgagccactgcgcccggctgaagagatgaaactttcttatcaaaagggtccaatttagacaagggaagatgttgagtataaaaaggttgattatctagaattggacaatctatagcccactgaagtattttgggtgtgtttgttagatactttgagaattagaaattgtgaaatgtagttattagaaaattttagacagccaagaaccatttaaaaataaggctcccatcttttcattcattcactcaaggccaaaaaatattttaggattaaaaaccaatctcaaactctaaaatatttattaataatttagactttatactaaattatcttggaaaagctagagctcaactaaaatcattttttaaatctggttcatctgtttaatattaaggcagtctctaatttagtaaataaacacctctaaaaattgtagtgcaacctctattaacgtgatttaaaccatgttgtgtattctcctgagatatgccagattaaggaattatcgaagccttggtggaaaatgacctactcaaaatgaaaatggaattcataactaaaagcatcccaaaaaacagctagtcttaacccttcatttcgtaaataagcagagtgggaataggtttaaaatgtcgaccatctttactattttagatcacatcacgttcttataatttgagcactagtaaaggttttatttgttttctatttctttctctaatattcaaatgtgattttgttcctgtttgtgctttgaatggcatgtttggatgactgtcccagatctggcattctgagattgtaccactaaaaatgtcaagtgcatttgccttttaattacatacagtacctggattttaatattttagatttttccctgaagaagagacttttctggtcctgtagtttgtgggagggaaaaaaatatcactgacattatcatgaagctttttcccccaacgtctccatatatccacatttatcatttcagaacaatttcattttgggtcaggtttagttgttctgtagcttactttgctataaacactatgtttaaatatataattccgcactgtttgtttgtacttctttctcttatttcccattaatgttcagctcagcttgttttactcttaataggccattactacttggatgtcacatatgtaataatcagtatgtggaaggtatagtttcttgtgatttacactcctttccttcctttacctttggcataaatgtgaaccagctcattactttccagggtatttctttttttacttccccaaattaaattttaatttcatcctattgttattctctgatttttattatttcaggtgggcaaaaaagtcttatttgtcaatgaaacaactccataaccactgaactcccttttgcacctactacatagacaaggtacttaaagcatttttgcttttgagatgatacagttcctcaacttaaaaaaacccacaccatctacctccgtgtcttcttcagaaaggtcttctctcagctccaaatctaacacagtcaccaaggcactccaccttgtccttctattttaattctcagtatggaagtcctcactatcaggtgatccttgtttacttgtctattgtttactagacaacacagggatgtaaactgcacgagagtggagatattctctgttttgttcagtgatgattcttcaaaccctagaagtgtgccaggtacatgccagggacaacaaataattcatttaattaatgaaaggaaggaaacaaaaaagtaaatgttttctttgtgtgtttaagatggggcatggaacatgtatttttttttttctttttgcttctaaggcttcctctcagaaccctcccagattccattcatttgtctatccatttaagtctgcttttatttgtccccaaaagaatgtgactgactgccaatttatgtgtatttatatctccccagcttttcctttctttttgttaggtagtagttgaggttgacacctctattgtatcccccacctcacccccatgttttgaaaaggcagtgttaaacattactcctaatataggcagcttaatcacatttctcccaagtgaaagtgccagatgggagtcagaaagcataggctatatttttaattatgtcagaagttaatactagaactattaaaaagccactttcctctcctgagattgtctttctttatttgaaaactggagttggactttttttgttgaatgattctaagaaatgttttagattgtcaagaaatcagatacaaattcatccccctgtggaggagccctatctgtgcctcttctgtaataccagtagccatggtatgtattgcagtatgatgctaataagtacagtcatttgagtacttaccatattcttcttctagtttatacgctctctaaaggaagaacacttgttcatctttctggttttttagcctagtacaatgttttgtacccatcagataattcaacaaatacgtactaaatgataaacaataacagattcttatctctgttttttttagaaagtagacttccctccatctaatgctgcttctgtgatgctataatatttatggtgcagaaatctagatttagaaagagaactttattcgaatctgtttatacattccctaatacttactgaggctctatgaagtaccagatattgtccttagcactttacatgtttcaatacatttaatctttgagtcaatctagaaggtagactcaatctccattttaccaataagaagtgaggagcagtggttaacttacctaaggtcaacttgtggcaaagctggaattcaaactctgattaatggttttgttttatcaaaaaaaaaaaaaattaaggccacctgacaagaatgttcactattagtgtttttccagagatgttgaagctctttaccaactgatgctatgaaaagcagaatttttctcttaaagaatgttttagattttataaattagttcagttaaccctagcattaatgtatttgtttcaaaaaaagtttaaaactttaagcagtatattatagttgataaatgctcttatataagtagcataccttgacaaattatgagcatttttaatatgttacctattcattgggcaaatatatattaaaagtttataatgtattggtaactatgtaaaaatcattagccataaagacatgaatgagattatatctttgcccttgattcgctccagacctagtgtgagttgtagacttgctgagaaatatttgcaatacaatttttatttgggttatgggaaaatgattaactggtatttagaggtgagagggtagttaagggaaaggtgttaggaacactaaagaacataaaagcccatgatcccacttcccattttggaagcctggcaaattaggttctcagaggacctctgcagaacagtcctaccctggataggacacatctgtggatacattgctggacttacagtggctggtggagatatctcaggactcactattctgccaaatatatatatatatatatatatatatatatacacatatatatttatttatatatgtataaatatttatatatgtatatatatttatttatatattatatatatagagagagagagagagaaggagagagagagagagtgagagcgagctgaaaacagtgagcaacaggcagaaagagaggttggtaatacctgaagggggatgctaaaactatattgcccttgagacttttatcttcagactggtaataagagtgttgcctagcctgggactcccatatggagctggcagaggtggtctgaggtctgagacacctcatagctactggtaggagatgtaaattatctttgagatgaaagcatgatcaatttaggcctgcagggttcccacaggctaacataaagcaattaactcacaatcaaaggtcaccaagcattcttgaaagtaactcactttcaagagtgagagttagcagaaacaacagatgtaaatcctcaaaaaaactgcaggtattgggattgtcaaatacaaatagccttgtacaaaatctctaaagaaataaagtgcaaatcataaagattaacaagatgctatcaggaataactaaacaaagatccgtttacgaagaaccaaatggaacttgtaggaagggaaagcataattgttcaaatttaaaaataactctttggatggacttagtagcagatttggcaaaatgaagagataatttattagctagaatttaaatctgaagaagttacccagaacaaaacataaaaaagagctaagatgctcaagaagaaaagaactaggcctgggaatatctccataatatatacaatatgttacagaactatagtagttgaaatcatttactgtcagcacagaataatatgtttcctctaagaataaaatggaaaatccagaaagtgactcatgtacttaacgtaattttgatataggacagaagtggctgtgtagatcattggatcaattcaaaagttatgcacaggtaactggatatgtatgtggggacggaggaggacctgaaacaactttctactatacatcttggactcttttaaaactttcaaataaaaaagaggatttttgaaaaactcagctttgaaggagcttcttaaacaataggccctaaccataaaaaaaaagattgatatatttgacttcattaaaattaataactgttattcataccataagtaaagtaagaagaaaagcaactgatggctttcagggcacattaccccaaaatatggcaccttggcatactgaatattttaacctgaaaaaagttggagaaagtgacaaaaacaggaagatctctctgaccttcccttgaagcagatcataagaccctcatatgagaagtgtcctccttatagctaggggggaaaataaaaagcacctttctttccgaagataagggacacatagaagaatctgaacaaacaggccttgctaagttttctgcagtttactatacttagctcatactcttcgccctatcatagtcctttataacgtcacccttcatcaaacctgctataaaaacactcgggtttaactgttgcattagttcttcatttccttatgaagtctaccatgacttgtaaaacttatattaataaatttgtatttttctcttcttaatctgtcttttgtaataggggtcctagccatgaacttttaacatcttgaaaggatggttttcatcccttatacagtctgataggagaagatatttgtaatacaaatttcagtcaaagctatatactgagcatttcagagaaaaaaacaggtagagatatttcaggtatctcaaaaggtcattttagtagtaatcaaatatgtattacatttcattttctactactgaagtgacaaaaatcaagaaggctgataatacaaagtggtaagatataatttaaatggggttggcatacgctgctggtgggtatgtaaattggtaatagtttggtattatcttgtaaagctgaatatttacaatctttgttttatcaaaatgggatggataaaactcagggaccacagtttgccaactcctaaaataaagagtatttgagaaatggtgaaaggattttaatgataagagtatatgaatgaaagtgtctcagaagatgaggttgaaaatgttgattggcacctgcttgtgaaaggccgtatgtgtcataacttttgccttttcctcttgaatgtaaagcagtgaagtcatttcttcgcatttaccttttagaaaactcatccaactagcaatatgtaggataaatctgaggtagccaacatgggaagcaggaggactagtgaaaaaacaagattgggtcttgaaggcagtcgaaggtggggtggagaattcagaaccaatttcagagagaactaagcagatagaatcaactgtgtttaagaagtaagacagtgcactaacgctctattttacctaattgaatgaatttagtgggaagcttgatgaaaaattaatatgcacattaaaacatttcttcttcattactatgaaacaaaataatattttactttttttaccattatatacattcctaaaatatacttattttattgctttcttaaaaagtatttctgtcacttcagaattttgtacagcattttgaactgtgtttttaaaaccaaaacaaatttagagactctaagactagaaggagatgccttaagcagtgtaaaattaattttcaatatctgcagtattaatctgtaattttatttcttagttgtttaaagtcttcatagacttttgcactattttccacatcagaaatctttggatcacgtccatatcattattaaaggagaataaattattttccaactactgttaaagcacgtggcatttagctgctctcttttctcaccagtaaaatctctggtagaccctgttttagtcagtgatctaatactgggcaagtttcataagatcacatgcaatgaggaagccaaattacttcaaaagatcattgagttaaataatacatacttcaagacacccataaggtttaggtgtccagtgtggcagcctgtgtaataaataacatgtgctttacaaaacctgtcattgtatatttatataataggcagctaagattttttaaaagctgtttttcagtaatttcatttttcctattcatagtttttcatttctatgtaatggacccaaagaactgacatctagattatctctacctagagcagcagcgtctactactatttctactatcccatgtgttttagtttacaaaaacctttcacaccattatgttacttggtattcctaaaagctacacaagatgggtaatgttattaatttttttttatagatgaaggcattcactctaaaagattctcacttgctcattgtcacacaacagataagagaacaaactaagaatcaaaacagggtcttgctgatccaatcccttgtgctttcagtgacactggacttttcttgcacattggtttggtgataggtggtgacagatggtggaaatggttagctctataaaggaatgtaacaaaggggcttgaaatttccagagacaactcagaaatgtttgttatcaagttcatcttatgttaatgtccacaacagtaagagatatgtctgatcagagacatccttgtgttttttaaggagataactgattttctatatgccagtgcaacctagcttaggcaggcttagtggtggtctttcatttattcaactaatattttctgttctgttgctcctttttaggtcctactagaaattcaatggtgagcaaaataaatatggtttttgctttcatgggctttaccttaacagcaatgggaagctattggagggctctaatcagtgaagtgatatgatacagttgaaatcctagaaaataccgtgtgctacaatgtgggttttgaggtggaacaggcagacagtatattcagagatttaacataggtggctgctgtgtgatctgcctgagaggatactgatctgaatgaaggtagtagcagtggggatgggaaaagtgatgacaaagaatatttaggaagtagtaattttgtaactaattgtgtgagaaagtgactgtgcattccagtttgcccaagataattccagtttttgttttccttcaaaagcatcccaatttggatgataaatgttaatcctagagataaggaaagtggaggattcaagaatgatgcataggtttctggcttgaagaactgtatggatagttttgccatttactgaaaggggatacactagaaaaagaactggcatgagataagattatgagttcgggttggacatggtgtgcttaaggtgactgtcatacattgacgtgaagacatattaatcacatgactccatgggtcaggaattcgggttgcaacttttggtcagagatatatcgattagagagtgatcagttatcaggatggtaactaaagagatgaaaatggataagatcaccaagccagaaagtatggaacacagtgtcaagaggcataggtccctgaggaactcaaaggggcacctatttttaagggatgagcaaacaaaaatctggaaaggagagaccagagtcctcagaaaactaggaggtacccaagttcatggaagtcccaggaaaagggtgttccaagaaagagggagtagacaggaatgtcacatgctattaagaggtcacataaaataagactagaaaagtacacattgaattcagaaacttgcaagtcattagaaacattggttatggtggtttggtgtggatgggggacataagcctgccggtaggattttaaagaatgattgggaagtgagtgggaacagtttctcagatctataactgaaaaagaaagaaagcactaatgaaatgccgggaggatttgcagaatttgagtgacaataatgtctctgaagacaccataagattacttaatacattgtacttacaggcttctatctctaatgtccattatgaaagtagaagaattagtttgcctaatcacagctattaagatagttttaattttttaggtaaatttgtgtgactttaaagctatttcatttttaagtagtgggagcaaggacacaattgatcaagtcactttagctatttttaccccccaaaatgcatcctagaaatttgctcaataaaaataaaattgtgccttagttttttttctcgttgtacaaagaattatgcttctcttggcttctgaacactggggattccttatatgctctttggcagataaaaaaaatggtaaagatttatggccaaggaaagcatttctgaaaaaggtgctccacattgtctttgtgtatgtgcagaaattataaacagaactcaggggcaccaccactataatagctttttgctctctttgaagaaaatggaaaatgctgacttaggggctactgcttgtatttcctttaatgaatcttctaagcttgaatgattttaaataggatatttatgttcctcggttatagcaagccaagtacttaaaaaaatacatgtgattaaaatatccaaactaataaatatatacagacatatttagtaaaaactactgttcatagtagtaatagtaatgatagtaataaatgccacagctaaagactttgaggagaattcacagtcaaggaaaacaaccaccaaatcacatgtatttggagaatttgattagacttctatacttaagtttaataattatgttgaagattagtgaacaactcttggcacaagaattgtcttgacagacaggcagccttacccaactcaaataaataacttaatgggcttttttttctttattaaccacttggtaaatgtgaattgaagtctagtttttaacaaagacatatagattatgactttattatctctgatttgcataatagattatgaaagtctcaatgctttgtactcttggtatacctgcaagcgttttagtttctatctatgttaaaaaaattactttcagatttggctttttatttctggaaatatgtttacatgaattcattaacctatctatattacttgtaagatcttaaaaatgtcttcatcccctgagtttgaaattgttttacccatcaccctcatgtcagttctgttattttattactaaacctaggtaatagtattaaagctgctgttcttacttcatgatgatagtttatatttgcacctacatacattatatatattatatttgtacccatatacattatctgcttctggtagggattagcagctctgaagatttttgtaaaatgtagcatatgcgactcataataaaatatatttagaaaattataccataatagcatgtattttatttaattaaactgttatgaaaaatactgacctcattaagcaagaactgctcttccagagaattttcagaaacatttaattctataactcagatatgtcagaaaatcactaagggatcattatcattagcccctgaaagccaagtgtctcatagaacctgaagaaagtagtctttgattagtgaataatgatgatttgttgcatggactaaagctttttttctagagatttctacatcaaacttctgtttctcttcctatttgaagtagtatctgtggcaaaccaatgtaatttgagttacaagcaatgactatgttccttttaggttttttcattcaactttgtaatatattccacctgttttcaatatctacatatatagagatatagatatatgtatatatttctaacgtcgccctggaaaggaaaagatctctaacatatttactacatgttttggtaaattcaaccataaaataatttgaaagccttaaggtatctctgttcataattatgaggttagaaattccctacagccggaatatatggaaagtgtcaagtcagaaagggaatctcccttagtttcccaaaatacaccagccaaagccttgctttttctgcttgagaataatagttagtgaatctagtctatggagaagtttttatgcaattgaaataagataaattaagacagttatagtgaattgttttacaaagttaactgttctgacgcttttatttgagctatgtctttctcaccagtttagctttaaattaccattttatataatgatatttacattagatatatttattctttcagatttcttactttgagaaattaatagttaacctcaacagtctccttttggcagaatctgtggctgttgggaaaagtggagcagatacttggatgtatagaactatgggttgcggggagggggatagagaagccaagaggagaaggtaaagaagaaaggatcagaatgtagacaaatggttgatttttaagagctgattaacagattgtccactggaaaggcatgaggttaggtttagagatttctttgcgtatctgttcatgtggacaccatctcttgactccaagtgcaaggtgctgtgttgggtgcttcaaggcaatttcccaaatgtgtctaatcctgagaatcacctggactcttgttacaccaatttttagcagtaggagccatggatctggagacattgagaaattttgtgttaaaagacagaagatatagtagattttttctttgctcttgagcaatttataaactatccttatctttgtaagcctcagttcctttatcgataaagtgtagataataatactttccttgtcaattttcaaggtaaatgaggtaaaaggaaaatgtcctcagagagttactggggcttgtaaaagggttaaagttggtaattttaattgattgtgtgtatgatgagtagtcagatggttttgagaaagaaaggaagttagggcatacaaagaagtttttaaaaataatcatcttctcaaagttgtttcccaactttattatctgggttttatttaataaaagaatttgaaatattccttggtgtgtctgtttttctttgcctattcttctcttgtgccaactcaactattcatctcaaattatatatattaaatcataaacacatgcttctaacagttatattaggcatttatttaacctaaccccttctgtcccagacaagtaccattaatactgccttaaagcaccaagcataccacctggcatttgagtcaagaagcatttgctgaattgactgataaacctctaaatctgaccccatctctttccaatgtactagttgctagacaaccttatgttcggactttcaaggacacttggggaaaactagttcatcattctctttgatatttattgtggaggtttgttttattttttgtgttaacaaaacctcttgtcagaaagatttccttacctcaaccctaaatctcgtattgtattttagcatgcttctgtatttacattgtgggattatttttattaatatacaataaacaagttgtgtttcttggaggtaattactgggaataatttttttctgtgattattagcttctttcagtaactgatttttttttttatccatttagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggtaaggcctaatattgtcctgtcccgctcacttaccatttatgtcactggttttaaaaacctgtttttctcaagatcctttaaattagaacaaacaacaggaagaaaattttaattttaacaatgttgtcagcacctgagtctattggacatgctttctaataaattcttatttggttatttgcagtttaattttggatataaacatatgctttttgttaagttgacctagaaattaatatccgaatttaaatgtctcaaatgcaaaggtacttgagatcatttatcttatatttgaagtgttattattaacaatggcaaaatatggatttattgtgatacttgggctgtggtctaggaattattttgtgctctttttctgtatttttctacttcttggctacaaataagatatgagaagaatataaacattatttagtaaaattgtacattaaatattcattgactaaaaattttagccttttaaaatagagagtaaattgttttaattgaacattaactttttatactatatcaactaatatcaccatcttctgacgttacttgaagatactgagacctactggaatttaaactgagctttgctctggagaccaaagtatattcctgatgaaaagcatttcaaagtacacagtttttataatatgagctattgtacattatataaaatgccataaatctgtaaggcattgtcttggaaactaatatagcactctaatccttcccatcatgtatttgggttaatgctacaatttggaaggacttttaaaaaaaatatttataagcaaaagtacagtcctaaaatagtttggtgtatagaagtggttgtgatcagtgaattctattgaaaaatataataagtgatgttgcttatattacattaaattatctagtttactattatagttattttatacttgaaataaagcattaacattatagataagactcatactacatgttttaatgattccatcagagtttattttaatatattgcctctttacgattatcccctggagatatatatgttggagaagacacatctgcattagaaacattaggtatgcattatagtgttttgtgttaaattagctacatacgtgctttccccaaatagtgctttctcttgctgttgtctccctctgtggttggaaaatacatcatatgtgaggcaaaagttttaagtattttagcaataaaaatttgccagtaaagatcaataaaaatcaccaaatgtaaccttcagaccttatgtctctgtttagtttaaatttgtatttggagacttaagtaaacaatttagagagtaaagttaactaaacattgcttcacaatgttctggtcacttcagattggatgtaaacatgaaagtggcttctgattatatcctcattcagctagaattgggctaaactattcagttttatttgttatttatttgaaaacattcatttgtcttgataactctccctatccaggcctctgatttagcaataatgaaaaaattgaaaaattaacctcctaaagtatgctaaaaccatcactaagcaagattttgggggaaggtaaaatgctctgacagctctctaaaattgtgtaatatgacaacttgattttctggttcatatattaaatggttaagttaatgagcctctctattaaaatatttaacatttgagctttcataattatgctttgattgtcttttgatagaaagtatgctagggcttttgcttctgttcctcaccatcacctttatacccaggaaaagctgcacttttaaagatagaccaggtttcattatttagatatgttaccttctaatatatagtatttatatctacattacttgaatttcttacttaccaaagcaattttgtaatgacttttactcatatgtagcgtgtcacacatgtaccatgtatgctttaatcacaagtatgtttatcatacatataaaaaagtatagatatagcagcattgcattggatattatcatcaagtatagcttaaaactattaatataaaatgtttcccttttaatatataaatttataataaaaataatggaaaaggaaattactttagcctcttatctacattttagtgggaaattgttaagtttgattttatccctcactgggatgaatacatgtagatatatttcttatgcggaaaacagttccatgtctttttggttgttttgcaaaagaatggtgtataattcaattgagtaaagttttacagctaaggatatgtataaagtaagtttttaggctaagaaaagggatattgcatctttcaaaacgcaatgtcattttttaatttaatcgctattcaattatttccaaatgtatgccattttttcattggttgtgtattatattttacatgcacagcatgaacacattaataactcaaacataaatttgaaattatgtttcaatacagtaaatgtttgtgtatgatatcatgttcacatgcatctactgtagaagtatctgtgtatatatagtatatggtatatatgtatattcacataacatatgtatatacctatgtaccattaagatataataacttgtttgtagaaatttaggtgttattctgtatatatgatatattaacataatagatctttatgttttgtatctaaagaaaaataatctatatagtacacaagttctatgcacagctgttccatctgtcatatttagataatggatgatattatgcttaactgcatgttgaaaatacacaatccatttaatttttcaatattttggcaataagaaataccagcatgttattttttccaaattatgtattttaaattttatttttatattgcatatctgtctgtttaattgcatggcaaaaaaaactaacaatgcatgagcaaattgaaatgcaaagcaaaaaaaacatgaattttattttattttattttattttttaacgcacatttttctgctttattgaatgtgacagagtcacgcttttcattcaccattgcttctctttttccactgtctgtgatttgcttgccaggaggagctactattcttactcctactacctgtaagtagaaaatgggtgatgtacaactttacgtgtgttaaggatgcagtatcccttttcaaaaacaaaacagaatgcttgcaattttggtgacatttcaaaaaaaaagttttttcagactctaaaactataaactttatctatcacctattttgccaatctttttaaaaagggatattgtatttctgtatgtccagctacttttaatttagttataatttccataagtagctttagtctagagccaaaaacataatttatttactaaagttaaacctgtaccttatcttagcaatatggcacttcactcatctggtaaagaagagatagtggttgtaactcacaaatcactatctttatgtagcattgtcatgtctgacaaaatgagccaagtggtgtatttatggaacactcaaaatgcctttacaggatgcaaattagttcaggtctgcatgtgataacatctttctccgtatttctaggaatccaagatgggttatagcttcagaacatctttggtccggccattaaggcaatcattgtgcttttgttaaagaaaaaaaagtagaaaaaccatggtgttgcagcaacaaagaaataaaaattctttttagaggaaaaaaatgagtttattgtaacttaagtaggacaaatgttttctaaaactacagccaaaaaaacctttgtcaactaggaacagatataggcatcacattgctccttttctcttccagagtctgtaactcttccgaaactcaagcatgatatgttcatttggataaggatggagaagatggtccattctatttcctgagtcatttttcagcttatcaccttatatgccagagtagtttttcatccaaatcaaaggaacattacagcaaagcattcttggactttgcttgaccagtatttgatccgccagctttcaaggtttaaagattgaaattaagaatgtttggggcacatatcccacagcatttaaatcactagataaattcaagctagctttacagcaaaacctttataagagtctccattctccatgactataacacaattctgccaacattttaaatattataaacattttgcttcctaaaatctgctaaaccaagtagctgtacactaacagtgctcctaacttattgtgatgaatcataatatccttgttaaattatgtttgatgaagccagagataatcaactgtgccatttcatacaatgatggagcactttccccctttatggcccacccatacatccacctgcagaagtttgtgctgttggctgctttgataatgaaagtcatttgcacatctgtcaaactcaaagtagttgcaaaacgaatttcttaactgttctgaagtgcacattatgtatgctagttactcaggaggagacaaagcatcaaacatactggaatcactaagtatttaattatgagactgtcaataagcttaacattaaccattgatgtagctctgatgttaaaatgagattcccttttttggtggatagacaacatttctgtgttccagacaacgtaacaggttatactaatattattatagtacatggggctactggtaattttaatcataactacagatattatcacagagatatgcttttaaaggctgcttaaccatacctagtgatgcttatctggattagaggggtttttaaagataaaaatagatataaattagagaagagcttaaaagaaaaccagatgtgatctttgagctaatattcattgacattgtcatagttactatctgtttttgatcaaaacacttaacactgatgtcaatttttctttgttttagaagaacttgaatgaaagcctacctcacagggttgttgtgaggattgaggtataaaaaccaaggtgataattcatggctggcagatatttacaaaggtcatatttccccataatttgtcaactaatctaggtttgtgaatctgaaaagttaaagtccttcattgcatgaaaattttaacctgtcatgcatttgacaaattcattacttattgtttttctccaatcatgaactacatataaattatacatattttaaagtaaagcctcagggtttaaatttttcttttctattggctttgaactgctcatcttcaaaattttaacattgttctgaatccaaatttcagtttgtgctatttttattcaattcagtctctcatattttttgagaaatgaatttattcttcttatcccagaaacaaagattgaaagttatttcctaaagcaatttttgctgttttaaaatttacaaatggcaaaatatttattctatatattttgctgaaatttgtaacgactagtgttcaactgctagagtaaatactggtgtatattaactagtgttcaactgctagagtaagtagtgccactttgaaatgtgtcaatttaaaaagtgtaagcaaccagatacagcgtaagagcttagcctttagnnnnnnnnnnnnnnnnnnnnnnnnnnnnnnnnnnnnnnnnnnnnnnnnnnnnnnnnnnnnnnnnnnnnnattgagttaacaaatgaaaagtgccaagtatataacaggcctaattcatctattcaacaagtatttattgaagcctgctatgtgccagacactgcgtcaagtgccaaggctatgcagatcatccttctctttgtggagcacatagtggggaaaacaattgaaagatatttgcacctatcaatcaataacactcattacaggggaagaatgtggtagtatagaaaatacctagcctaatttgagaaaggttgctttggagtcaggcatataaaccctccctgacgaagtatctattacactgagacagaacagacagattttagccagatattacaggcaaaaaaatgttgcaggttgaagaacaaacatcttgtatgatggcctagtgggaagtttggaaagtgaaagtccataggctaaatgtgaccttatgatgtttcatgtggcccatacactgtttcaaaaaataaaatcacttgaagaaaatcaagaaaattaacatcaatcagattcatggcttgtctttaaaaaaaaaaaattaagccagagagaagttcaacagtgggatcaaatgcccctaggcaagttgcccctaaactgctttccagttcttcacagccattacccttccttatggtatcttgccactgacagcagcactcatttatattacctgtctgaacctacatattcataaaggattttgaccctcaagtctagaaaaagattaatagctctttgaatgtatagcacaaatgttgctaataaatgatggtggtgatggtgtagtggtagttatgttggtggtggtaatagttcttgttacactttgtcattgttttcttattactaatactgtgattctgtgattatcattatttattatttctaaaatagccatctgcatcctcgaatcttagcttatgactatcttaaacaacatagtgtcagatctgctgtgtacatgtgtcgtgtgtgttgtgtatgtaccgccctgaggccaagtactgtaattctcagagaaaatatatcctacactggagcagtcctccaattgctagattaaggttgtaaaggaaaagcctttatacataaactcaatcttttaaatgagcctttgtagtatttgtagtacatttactctggtttggatattaatgaggatcagaaaagaatggcttagcttataatctagtgaaggtaatggtgttcttaaaacaactaaagatttccaaggcaatatgaattgcagccataaacttagtaacataatttgcctattacaagcttttagagtgcctttatttatacataaattttcttgttagtgtgatttaaatattttatgtgcctttaatagccctttttcttggatgttacatgtgtaacattcacaagaactaaaatatattttacatccatgatatgtaagataaacatgccaatatttgagtagttcataattctaatgctgttaatagccaatcccttaaatcatatgcctttctgcatttataaagcattgctgtagttagttgatagtatgccatgtggttctaattagaaaacacatttttaatatttgaccatgtgaatattccaagatgataattttcatgtctttccataccatattttaaaactttcctcactacttttcttacacagtatatgatttaatcccatatattcatgtgtacttgaaattttctagcagtggcttattctaaaagtcttcagattagcttctgattaatgttataaatatattgctaaatatgttaatgctacacattgcatttttacttaataatagcacagagaatgaagaatgggacatgtctttgtctgttttaatttggtggctacagtaaaacagacttgaaaagttagtcatgttatttctaaaaggaactaaaagttgatcaaaagaattaattacccaggagtatcaaaacttggctttagcttgaatatttattgaattactctagtaaggaggtatttattttgcttttaataaatataattatattttatgatatttaagagaacaggaaatgatgagagatttggattgacagcttgaatattgaaatatgcatctgacaaaatacttttatagcaaggagcaaatataattgtttgaatgtcaaacttaattcctgaaattgtgaccagtgcttggggtttctaaaccatgtttgtaacattatcctcgggctcacctggactatttattgctggtgttaactctcctgcaagcctcaaacactaaggatgcccttttgtatttgccttggcagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatgtaagtttttcattaaaattttaataaatgatgttacaactcatttcactttgaattctacacgataccttttgagtaatgagagagagtaggaaagtgaggggagaagcagctagaaagaagagaaagagatggagaatattatggaatttacaagaaggattctcatcaagattgatactggatttagtttaacttcaaactctatgaattttattactgtatcacaagggatattccaaacatataccactcagtccatagcacgtgtcattgctttaagtggaaatacacgattgcctacaaaaagttagttcatgtcagaatttataattctttttccatttgcatcttcctttgtgtaagatgaaagtctcttttgcgataagaggaaacagtaattctttttgggaattattgacataggtaaaatcattgcattaaagtagtatattgtagactcctggaaaattgcaatactaaaaagttaactcagggaaacattagtctacatgctcttaagtatctggtgtgaagtccaaaagtatacttgaattgggggttttgcaaggcatagtgaaattcatccatccatctgtcttgaaaattcctaatgttggtctatgaaggcaaggcttttaaaatatttccactgaagtaccatttaaaagcagatgattttaataattaccccagaatcaatattactgtttattttcaaatttcatatgaatgttatattctgttctatagtgcatctgtttaagttaattaaatttaagtgaaattgcctaactttgtttcttcaaatcctcaagtaaaactgatgcttgaggcaggcaaatcaggtatatctcttgagtatactggccttgtataacttgggccttatggcatttggctcagatcgcagagatatgctcaccccggtttggaaaacatgggtataagcaaagaaacaatataagtattatctcctgtacaaactatgaacatatgtaatagtaagattgaaaacaaagtatttgtaggttgtatgcttgtatgtaaagagggaagtttttttctgaattgttcagcttggagaaatttttcagtaactattggatctaaaatgaagcccatcattttctatgtatatatgtataccaaattagtagttaaggatgctatacatgagtcattttggaatttagttataatcatgacagggcctttcagatctattttatttttatttcactatagataaatgatagagaaaaatgtaaaatactattactgttgaaagtaagttttgcggaaaataaagatgtatcatctctttaactacttaatttaatatttaatcaattaaggttttgaaagcattcatgcctcccaaacttgtctatctattgcctaccttagggccttatttgaaagtttgaattcagcagtgtaactataaatatccacttatgaacttagagaaaggattaaatctatttcccacagataactgaaaaaaattatttggaatgaatatgagataattatttctttaaataccttacacttgatagatctaaaatacatgggtttttttttctttaattttttaatgtcaagtttaatcttctggctttttaaattaaacagagttctgaaccataattatagatacacctctcttgatgtttagatataacccaagctgagagagaaaattttacatttgcagaatacagtaatctgagaaagtttaataattatatttcttaagaaagcataaatctattttaaagaaaaaagattttaaaaaacaattttagagcaatatattccttcatgagctttgttttcctgcagtgcccaatgatccacttgtaccgactgctgtgttaggtgaggccctaaatctttatcatcttttcattgcatggatcacacctccttgcatgggtttgcccacatagagattatttacagtgcaggaggcagcttggttttgaaaatagacagccatggtattatcaaagagagcaactgtgttcaacccaatatcagatctagtggatttcaaattagcaaggcatgctatttaatgtattcttcaattcttggttgttagatttggagcaaaagtacatggcccttaatgtctgactaatattaatgtgtcaaaattagtagaatgaagccaaatgcatacatctgagggtgcaatgttgcctgaataactagtttatatgtaaaagtctacctaatggaaagggatgtttctaaatcctcccaatttataaccacgaaagaacaaatttacaagtaaatattaggattatgtgcatttgctctagcttttgtctttattaagaatgttttaatgtaggtaaagttgctaaaatcttgatgtggggtttgacattctacatgaaccttacctgataagtaatgttatctttcaagaaatttagaacaagctacttgggttaccactgtataacatctaagacaatgctattactaatgacaattaacgcttttacagatgtaaaattatattaatttttaaacctacctatatatttaagaatggaatgggtttcatttttcatttcactttgtaccctgttccttgactaattatacaccaatgattagtaatcagcttgcctgtatgtttacaggttccatatcaattttaccagcgtttctagttaagctttaaccaaagaaatatggaaactatcaaataaatatatcttgtaaattcccaaatgtcatgtttgttatttatatttaacatttcttgtgaacaaaaaactttaacttatattttatgcttgtatttttgttatacatacaatcaatgttcaattgcatttttaaaatattttggaacaacacaactaactcagttatgtaaaatatacctcttatttactaaaataaatatttaaaattataattttataattactataaaggatatatattctaaaataatctgaaaagtcaatgttcttcatctctacttgcactctccctttgatgtccaccaataatggttaggaagtgaactggggatttgccccagggagtggtcttatcacacagggaggagccataaatcatgatcactggggatcattaaggatacatcagatgcctctgaaaatgtcatcttctgctaagcactgtggaatgctgtcagtataaagttaataaataaatttcaattaaaatattgagaactaattggaaaaaaattagttgcctaaatgttaaaagtttccttacaataattttctacacatatgtaaagtccaagtctcggtcctcctgtggatttacaatatgaactcataaaaataccttacatctttgttttcccatctataaaacagtataataattcctaccatacctttttcatggggttttattataaagagaaaattagatgatgtgtatgagttttataaactgtaataattatcatagtaattttccctgtgaaaaaggatattcatgtttaaggaaagctagatttaacacaatagagtcataaagtctagttatataaacattcattacacattttatttaattttgaaagtcaagctggttttaaaaatatattggcattctttaaaagctaaatatctcattaatcatattagatgtagaaatgatttgttgtatttttcatcattcttaggattgtggtctttagagttttgcatccaatcatttttgtatttataatgcagtttctgaaatcacttcaaatattgcttaatgctaatacttactgatttaaaagggcttagaaacttttcatactgattcgtatttttggtttttgtgttttactgcttcattgggtttaagttcctataacaggtaagtgtattgcaaagaactctagaaaacctttcaatcaaggatatatttcaagttattattcttaaatgtataataaggataatgattagtacgtgtaccctcactactagtcacattattaggtggtttaatgaggtggaaatgtattgagattaataatgcatatgtgattattttaaagaccttactgctcattgtactactgtattaaagcttaatgcaaaacaaaaggcactgtctattttatattgggacacaatcatctgtaagatttggaatatgggtgaattctgtgtttctcactgagcctttttcaattgtaaatattctgctactccagcaggtaaaagtgagctctggggctgctccactgagccctggctaccttcttccagcttgagtgattgcattttgcctctctgacgttatctgttctctttacttctcatccttaactgtatattctgtggcagtgcccaaatcaattgcttctgaatttaatttttctggggagatgtatttattctttatgtcggtctgttgattgtaatattttaatagaagtagatccattgactttggtcgcatagtgagaacaggaaactctcatgaatcatgtttgttagccaatgtttttgtgtagaggggtgggcaaaatctgagtaaaagacatgaattcacttgagtggttaggtcacaacagaatctatcagggattttttgattcagtgtatttttaggaatgaatgctacaaaaagagcattcagcttaataagagggagtaaagataaatgcaatcaagctaaattacagaggcacacaaatctgattgtagggttcttttttttttcccttctccaggaagaaaaaatgtttatcatggggacaacaattcattttttgctatatcctatttgtagagttggtgatagaacaggcaaatgtactagcacttgaaatatgtttatctgttaattaaatatcattctctacagtatgcattatcattaaaaaaaaaagttcccctaagagtgtattttctcttctgttaatgagtatgacggtataatgcttttcaaagtaacaccccttaaaacatttgtttttttttttaagtggtaagtttaaatgtgataaatatgagcatgcttctcgttgtaatgtttagtacttcggtcattaaagtactgtttattcttcataggcaaaaatgttcttgttcttttcttccttcttatgacagaaaaagaatttaaagtttcttttctttttaagctaataacacaattgggaagggacttacgcttaattgtgagtggtcagggattcagttgactttttaattcattcattggaatatttattgagttactgttatgcatcaggcactaggaatagaaagaaaaatattctgtctctgtactgtgtgttcagaatttagtgaggaaaatagccaagtagataaatcattaaaatatagagcaagtgaaatgacatgtaaaaatgaataagaggtcatgggaacataaagaaggagctttgtaactcaacctggaggggccagaaaagacttccaggggaggaacccacattttgctccagaagcgcgccctgatttctctcgcagcgtggccaagagactcaaaatacatttgcaataaaaacaataacagtaataagtcaaggcggcagaggttgaatataaatgcacgtgtagtctggctagcagacagagtggcatcagggggtgatcatgtggaatgcccatgtttcccagtgcagagtgtgttgtggtaaaaagccccagagaatagggccacgagaacaagaagagcagccctttggggatgggtcacctagatcgggtatctctgagggaggttgggatatggttgggaaggagtttggtcgacttaatagaccatgaaaacacctccacttgacagctgggtcctctggtcccactctatactgctatgactacagatgcaagaaaaacaactcagcaaaatttcccgcttaagcttttaaaaggtctatcagatgtctccctgcatctcacagtgtctgttgtcttgctgatatacacataatatactctcacctgaaaccttgagttttgtctttggggatactgtctaggcctatactgtatgatatttctttcccagaattcctcttgttatcagaaagatcttaaggtcttaaaatcttcattgcatagatacatatattaaacaagataactttgtctcttttttaatcttctgaaatctgaaaaatgccagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgaggtgaataagttttgatactgtattgaatttgatttttaactatgatactcagtggaatttagcatttttttccctctctttaacacaacaaggaggggattgttctataggctctctaatctagtgtttatgagtgtacaaccaagtgtgtgtacctgggaatgggaagggaatggggaaaaaagcacttcccagagatatatgagtctaaatttattacaagaatctttaatgttggattccgtaatttattttactatggtattaaaaaaaaacactttgcgtatctccccatgcaaaaatcaagtagcaatacactttgggtcccattgttccattgcagattctatcatttgaatgaatcaagtagcaggtacttctctgcccctttttttgttgaccttatggttgagaaatcagatgaagctttgtgctctaaatatactacttgccactctcagtttaattttatggattattggttgagggtggctgagaaaaaaaatagagcactgcaaatctagtaaacaacactgagaagccaaaagaaggcagtgggaaattcttcttccaaccttatttccccttcctactcaaaccaaaataccaggacttatctcacaaaggcaatgatttaaaaccaaacattccaacaaacataatatagcaaaaggaaaatagttcctttgccacccttcacttactgagaaataccaatctggggcatggaaggaagccagtccactacccatgaacacatcacagtatgcacacatttaaagtgaaagaatccaagtaatattttgctttgaaaaggccatccaaaatacatccaatttcatgaagaatcttttaaactccatattttatctatggattacctgtataccttaaattaggagtgttaattatctctgaattttgaaagttgattttagatatatgccagaaacactgccgtggtaacaaaataagtacaaggaattagactattctgccagagctggttctttttgttcatttcatgtgtactcctgtgtaccttgcttcaaagaccactgggctctttgaagaccccgtttcctgtgttgagcaaagtttaagttcttttgcaaaatgaaatttacacccgttttaaattgctgcatatagtaattaaactagtcaacaaattcttctgttcccagattcttgaagaaggggactctattttaatttttatatggtcccttgttgtgaagactcactctttttcatgatcttcaaagaaactcagatgcgatgtattgcacacaatttaatgaataattatggagggaagcaggttttctttctactgttataaatgctaaatgatgcacacttgaaagatactcattaaaagcttttttgcagttttgatgcattatcattcaatacgttttgaaaagaatgatactttgctacttctacttctcattatagtgatcttaattttaaaatactttcaaggtccattttttttctctaaagttatttttttgtctttaatttgacctgaatccaatttaagatgaacaagtatgaatccaacaaagcggctttgaggtctgagaatgaaacttgtttactactgtaggactgctttcctctctgagaaagtggtttttactatttggggcttcagaacagataaacctgatttttaaaaaggaattaaattcagtctgcttattcgttttgttttcccagagcttttttgaaggacagtcagcatcttgggatgtagctaaaaaagatcaaaatagagcaaaaaaccgatatggaaacattatagcatgtaagttcccattcaattcttggtgaatgtaaatattatatgcttatatggttttaaactttaagaaaaatcccagagagtggtgtgtctgtttatgaagtaatctatttaatattaaaacagcatttacaatcaggcttgagggctcatgcctgtaatcccagcactttgggaggccaaggcaggtggatcacctgaggtcaggaggttgagaccagcctggccaacatggcaaaactctatttctactaaaaatacaaaaatcagctggcttggtggcacgcacctgtaatcctggctaatcaggatgctaaggaaagagaattgcttgaacccaggaggttgaggttgcagtgagcagagactgcattactgcactccagcctgggcgacaaagcgagactctgtctcaaaaaacaacaacaacaaacaaaaacaacattggctattagcagtgattctgaaattgtcatcatcctcattaattaaattgactcagccacttcaccctgtggagataacttgctgtttgatttcatgtttgtacataaatgcatggggtattactgaacagctgagactatcaggataatgaaaaagtaagatcttttcagttataaattgttttaacacttccatcaaacatattcaagattggggtgttattctttccacgtgcctttaattcttacttggagccactgtctaaactccagttgttcgatattatttatcgttagggacttcctcctgagtaagtcctcaagatatacacgggataataaagtcattatcagacaaaaccacaggatcagtaaagaaagtagcagatagtttaacttgtaactagctgctgatttacctagaccactctgctctgaatttaaattattttaaagtatcttatgaatagctcaaaatctaaccttgattctcagggagtaagaaactgagagcgggaattcaaaattcactttttaattctgtggctcatttgctgtaaagtgcagaagaaaaggatccaacccgtttaaagtcatgactaaaaagcaaaattagaagttaagtctagttcagttatgtagacaattctatgactcaaatgattacttaccagacaatttcatgtctcctaaacactaactatgaaggttcaagtcagtgaagcttaagtcacacaatattataagtgtaatagcaaggttcactaacattcttatatttcttcaaaggactgatttggtagtagtatactatggatagactatgggcaaccactgaattctttagtctctaccaatgacattgtctcagaacagggggaaaatttaacagcttatatttattattttaaaattttagatgatcactccagagtgattttgcaacccgtagaggatgatccttcctcagattatattaatgccaactatattgatgtaagtatttttatagttaagtatgtctactttattggcttatatatatgaacctttttgcttattacctataaagtgattgctagctttttaaaatataaaagtacaaactgtacacttttccttgttctgcgtcctagtacttactgacattgttgtgctttctttcacacctgactttggtttgggctgtagatttggctgtacagggatgtaagtaccactatatgtaaataacagcaccctattataaatacaaacattcttaattacagttattactaacgctctgttactactagttatttctgcatgcttcacctaattagcttcatacaatatatctctgttcgtttttttgtaattctttcacatgcgtaaagatctattttaccaccttcccttttcttgtgtagaaaaacaggaccatttttagctttgacagtttattatgtactcgagttttatttgttgatgatttctgtttctggcttttattcttacccttccctaaacatatgtgagaagctggatagtatgatgtgtattagtgttactgaaattttactttttacatttgacttctgacgttaaaatgagtagggagactattttgtgatgtgttgtattggcttttaaagtaataaaattactcaggcaaaataattactaaatttcaattgtaaaatacacatatcacacatatatatcgaatcacagaaatgaaaaaggttgctttgatcatatatttcactgttaaattttgattacatacatatctacatggaaattctttatttaaaggaagtaattatcaaacaaaatatagaatattcttaaagggcaatatattacattacctataaggaagacctggttcataatcaccctggagatcttgggaatgttacttctctctctgtacctcagtttccttatctttgcagtggggataataataacagtactaacctcatcactttgttgtgagaattcaatgaagtaatgcatgttgagcattttgcccaatgcctagcatatatttagcactctttaaacttcaactattttttttacaattaaaatctaggtgtgctataattaaattgattcacaatatgtataattataagacaaaaggtggaggtattaagaatggtagcatatgtatacttctatagacctaaaaggtatgaaacctaggacccaacattttataatttccataaataggaaataattttcattacatttattaggttcacattttagagttatgaattgtcattatgtatttagttgaactaatatattttataaagcatagtatatgagtatatgagttcaatttctgatcataatcttactcttattcattatataaatttatcaaacatcattatgtaaaactaagctaatggtctaatttttagaataaaaaaatcaacagttctatgacaaatttgtaattgttcttacctatttagtttaacctgggttttctgccaggacttgtacactggagccttgttataaaattatttcatggttcatatggtaggactgtattttaaataagacttgttatctagtctttctgttaagaccccagtgtattttggtctatttctatacaatttcataattttccctctcccattagttcattatatgtaaacgatatgagtatatacttctgcaattggtattttttttaagaagtggaaatgaaatacttataaagcttggaaaaatttttccataaaacattgtgctattttccataaaacattgtggtatattaaaaatttgaaatcttccaaatttgcaataacgtaatactcatgctattaaattttaggttggagatctcagttcacatgtatttatatgtgtattgagttgcccacaccagtatgtggacaaattgtaccacagacttttactaaggctcattggtaaatatgcaacaaattcagaacttaggatcatatcatcaacatttttacaacttatgctttgttgttattcaaaccaattgaaagcaactaaaaatctattcctcctcaacagaacttttagcacactgaaaaaaaaaatactaaatttttgctcaagataagatgcatttttaaaaattcttctttccctatatatatgtgtgtatctataattatgtgtgtgtaaattaacattgtgagcacgcacaaaatagtttttgcatatccctgaatgtgttgtagaacaggaatattctctaaaaatctcagcaggactttgattggatgcacacatgcattgtccagctctaacattggaatgttctgttatttttttatggttctaatatgtcctcgtccatttgtaatgcagtgtgttgtacttttggatgataaaatgagaattaatatttttaaacactattttaccaggaatgaatgactaaacatttacatgaaggcataaacattttagtgaaaccaaacaaaatctatgaggttattccatggcaaacaaaaatcaattatacaatatatattctaatcagagcctttaaaatatttaatttttgttttatgtttacctttcagataacataggtttgagaagtgaactatgtgttcactactcatttctggactttttattataacttaatcttaacaggtggttgtcttcatctttttatgccttcattcatttatttctgatattgatgtaaaatgataactaatttgttctcttattttagggctaccagagaccaagtcattacattgcaacccaaggtaaaactttgccttgttaaatgttatagaaaaaacaaacttgcttattcatctatgtggtggtttttattattttttaaattttatcttagtaacaaaaaaatcagcccttctgattaacactgctccttactcatttgtatagtacaaatttattgtgtgtgtaaagcttatataaatttaagcttgatttacttttaattaaaagtgaaagaaaagctggtagtggttattatgatttgatccttgttacacagataggtcagagcactagtcaatagtgccagtcagaggaattactcatttttgaggaaaggaaaaagaagtctcatataagaggcctgtcttcttgcagcaagtttgttagtagtacccaagaccaatattgttataatgagctgttatactgagcaattttttgacgagtcaagactgagacaaaacaaagagatggaatttagtcaagttaattcttcatggaatataataagacagtagagagatcttgttatagtggtacactggggagtaaaagtatccaaataacaacaacaaaaaaagcatctgtagttatctctctaaattgactactggccctcagaagagaaacctgtacatcttttttatataaaaggaaagtaaaacaaaagctaggtttactcttttaacaggggtcatttttctgtgttttcacatatctttggagtaattgagttcagttgtgtactctttaaagttagaaagatcgaccatagtggtgaacaatattcagttttatggtattcggtagagaacagcccagcacatgcttttgcagtttggagatattatgataagattaggatatgtccttacgtgtaaggatatgtttttattgatccctaaacatgcactatttataaatagtgggcacttatttaattggtaatatatgctgtctggttgatggtggtataagagttctattttttacacatatttgaagatgcattaaagtgacttagtgacaaatataaatacccaagaaactagtgatagtttcttctaaattgggaagtgtagagggcaaattgaaaaaaaaaaaaaaaaaacttgtatatgcctgtgtttttgcctattgtgggaatttagatatgaactgaatttaagtattttcagtgacattttgtgttagaccttttttggaattacttagtttactctgcttcttatcttagctaaacttcttactaactacaaaattcctttgataacataatattcaaattaatttctttgtaggtcccgttcatgaaacagtgtatgatttctggaggatgatttggcaagaacaatctgcttgcattgtgatggttacaaatttagttgaggttggccgggtaagaggaagaaaaagaatttttttgtcataaaaatgaacatagttgagaagcaacatgtaagacactcaaaatagaatatcatccaattgtttaaaaaaaattataggcacaacattttagttgagtacttctaagtagaccttgactggctgaaaaattatttgatttctcattgagtaataaaataagctttaattttgtactagaatctaactgcattatcaggcttgtatattttttgtgagactatataaactctgtttattgtataatagatttttttctcatttatagatttttaaactgagttttaattgtgacctaaggagttattgctggaattaaatcaccttggctaattagtattatatattcaggtctgtctatatattctttttgtcacttaggttaaatgctataaatattggcctgatgatactgaagtttatggtgacttcaaagtaacgtgtgtagaaatggaaccacttgctgaatatgtagttaggacattcaccctggaaagggtaagtactctaaaattctattttaaaaagtgatatcaaaactgctttttctcttaaaatctttgccaagttctgttttgatgatgctataaaatccattcattcatgtattcattccacaaatgtttatttgagagtttactatgtgccagacatgtttctaaaccttgggacacatgttaaaatcgcctcgtgtggatcttagagccgattgaattaagacagcaataaaaataaataaatcaactaatatatcatacatcatgacaagtgatatagagaaaaataatgttggggaaggaagtagggaatattatttaggcagggtaagaaatggtttacaattctgaaaggatgatcaaagaaaaactcattgttgagaaagtaatatgagtagagacctgaaataagtgagggagtgacgggttatgtccagggcaataatgtttctgacagaggggagagtcatttcagaagcctagaggcatgtgtaaagctgttagaatgccagacagtcaccaggccaagatgtgcagatatccataagtgaaggggaaagaaatacaaaatgaaggcagagaaatcacaaaattggataagtggtgccttgtaggccatgatgattttagttcatactaaaattgagttaggctgccattgtagggtttgtgagctcagggataacatggtctgaattttatttctaaaaggatcactccaagtgttacattgcaaagaataacgtaaggtggctggtgtagtagactaaagtgaaatatagtaacagtgaaatacattttgtggtaaagcttggtagatttgaccacacaaaattgtgaaattacctgtggcacaaaaaaatatcaaaggtacatacagacagaagaaccttgcgattgtttattaatgtccttaatttataatgttaataccagtagaagaaaaaaaaaaaaactagaatctctgaagaaacacaattgttaacaagcctattaaaaatgtttaacctagtgtacttatataccattttgtccttccaaatcagcaagaactttaaaaaagaataatcctcattgattgttagagtatgttgaaacatatttttatacattactgatcatagttaaatcgctacaaaccttctttaaatcaataaaacagtatatctccagagctttaaaatgtttatgtcctttgagaagttaactttcatgaatctctcctaaggaatttatttaaaatacaatgacttcatttatagtattaaaaacttatagataaccataaatgcccaacaatagagaaataattgcatagtattttataaaaatacttgtgagttatcctaccaacatgaaaaaattaggcaaaatattaagttgaaaatagcattatacagaacaacataatcatgattattgtaactgtaaaatatgtatgaaaatttcttagacaaatcaagtagaataaaataagcaattgatatgggagatttcagaaagaaccattaagcttgatttaatgaataactagctcatattattaaaaaagaaatgtggaatatgcagtctcttaagttcatacaagtcttgtaaaaatcaatgatgaacttagtaataaggaaaacctgaatacataacaaaaagttgagatattgccaaaatccaatagaaagcaatgatgacaaactgctgaccagtgaccccagaaattagcctattagaagtcaccaaatcctcttctgaataatccttgaatgatttcctcaaaactaaaattatattatatagatcaatagttttacatcaaaatttacctcattattctgtaagaaaaatttatactcataagtgatttctgttttgaaatgtgctctgaaatcatgtgaaaaattataacattggaaaatcagaaaaagtagaatagaacaaaggaaaaattaaatataaaaaagaaacaaatgagaaaaaagaaaaagcttgtttattgaaaagatcaataaagtaattaaaccactattaattctaaatgaggtacaatgaaaatatacaatattagaaaacacagagggacatagccattatacttgctattagaaaagctatggaaaatattatgtataaacttaaaaatataacttttagtccaggacacggattttctgacaaatgctgattctcaaaaattaggtcacaaagatttagaagcatgaatagatggtagaagaaaataggatgattgttattatcattaaaattgcactatggttttaaagttaaagttcctttatactttaaggaatagctaatatctatgttttaaaagttagcataatgtacttggaaggctgaggcaagagaatcatccgagttgggaaagcagaggttgcagtgagccaagatggcgccactgcactccagcctgggcgacagagggagacactgtctcaaaaaaaaaaaaaaaaaaaaaggttagcataatgatgataacagaatcagataaagatagcattctctggagctctcattccctctttcattatgtctttcttctctctcttcctctcttccccctcttcctctcttccccatgcacacacatattgcagaccaatttcattcaagaacatgaaaaaattcaaaataagatattgaaaatttggatctagtagtgaattaagaaaatatcactacatgacctattattttttccctaagaatgcaagaatatttcaactgtagtgggaaatcttaacaggatatttcattatgtgcagtacattaaagtaccaaaactgtatgactttaatagattaatgcatttaattttattttcaaaatatttatagtaatactctaattagggaaattaagaggcatcctaaacatgataaaggtgattcaacaatacctagtagcagccatgttaaggaatgaagaactaacgactattcatttatcataaaaaactagtataaagattatattactgcttctacaatcatgaatgttacgtggataatcagtgtcactaatattaaacatttttggaagttttagcaaatgaaataaggcagcaagaggaataaactgtgtaactactagaaaagacaaattattttaagatgaaaggatttataccaagaaaagtatggataatatttttaaatgggatgtataaacatttatttaaatgaccaaatctgcataaatattcatgagttatagcttgtctttatattagtgataaacagaagtaagaaaatattactaaataatctttaaaaatacaaagtgccaaaatatctcagaatatatttaataagaacgatatagttcctgatttaataaaaacacaaaagtgtacttacggatacgcataatatgtgaatgagtggagacatgcaccatgttccagaatatgggagtacttgatattaatatcactgtatggatttaatacaatcctatttggaaaatcattggattttttttttcttgttatttagaacaagaaaatggggggggttgtttttttaaccacatatttgaaaatcattcagaaaaattaaaaaaaaaatcagggaataggtgctgacatatgaaaatgtactaaaaagagcaaaccctatacatgtaatagaaagataaagggagcaaggcctattaagcaactccaataaaagaattaatatagaaggagtaaagtattacctaaaatcaggccatgaaacaatttttgaccttcctcactagagttgaaaagtagcaaaaggtgattttccattggggtgattccatggtgatgcttatcattgtgattgttacagttatttattgatgatccctgctttgtgtagggtattgtgctaggaattggaattaagaaaacctttaagaaatgatcactaacttccaaggttttggtggtattggtttgtataagattgaatctaaagataaactgtttttctcagttttgtttatttcatgtaatgtgtctaccttttctgattgaacaagtgagattgatagttcacagatagttcacagtagaatttgaattatatagattatagtgggattttttttccttttgctacaaatgtgagttcttaaaaataaattcggcaatatttcatctataccttccaagctgtgctacctcagtctacagacttcttctaaaaaaaggaaggaaaaagctttgaaatgtgcatttacagggttctcttaaattaacccaataggagagcagcacaacagcagatgcttcacttctttcattttgtatttttgttactataaataatactgcgctgaattatttcacagagctaagaaaaatagtttgcccaaagaacagtttagctgcctgtatattttcacaagccaatctagagcagcactgtcctggaaaatccctacatgctatgcttcaaaaccattttcaacatggataagcaaggcattaaaatctctttgtgaggtgagaagctggaaagttgcttttatacaccacttgagaactcaatgcattgggtcaatggggcagcattttagctttcccatttccttcttttcccctaataatttaatgtgttgtcactcccagcaagaaacaagctgtcaaagtaaataaaatttacccagacttttagaactgagcaagacttataattttctttctttggcagttgtctgacaataaaggtaagctcctagtccatgttaggccttcattttattatatttttttttttaagaaaaggcatagtctttcgtaaaggttttattgttatcattgtcagttgggtctgtacccataattgtgtttaatggctttattttggccattaaaatggcttttgaaaacatttctttccatctttgcacagagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcaggtaagtggtggtccaaatggtattgactgtatgcaatcagctttttttagagtatcaagacaaggcttttgagcacaaaaactaatgtgtgcttacgaagttccagcttgcttgtattatagataaagtaaaacagcaataaaataaaagttggctgtaagtagtctataaaacaggaacttaagaaatacatacattcatcctaatgcgtgtagtgttatccacaatttaaagtatagaaactctgccttttaatggcaacatctgtgttttttgtttttatcacttttgcaaatcccatattgtatagaatgctaggttgaaatagacatttcttgccaatctagaaaattcccaatagaattccagctttaaaactaaatttcagacatacagagttactaaatggcctaaattgcaaggatttgtgctgcaaaacagctatttaaaaattttttttaaagaattcacattagaggaccttgaaaactgcatcagtgagattcagcaaatatatgccaaaaaacacgagcattatatccagactttcttctgattagaaacttctcttaaaacaagcatttagagatactaaaagcaaattacatggcctcattttgaggtgtgaccagaaaaataagtactgaatctgaaaagcgtttcctaaatgatgctgcacaccattctcatacgctcttccctccaagctacataataggttgtacctaagcattttttgctttctgaaaatccaacctattcaggatttaaataaccatgtataaaagaggggaaaaaaagcagagaatgaagtaaaggtaaaacgtccca

SEQ ID NO: 1299 - DNA, 5775 bp, Homo sapiens
acgagcaaactcggcatggatacgactgcggcggcggccgtgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcactggtagagattggcttcgggctgagctagcagtgagcaccttttggcccaatgaatatcaggtaatatttgaagctgaagtctcaggggggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttccccaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccactcttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgcctgcagaactccccccggaaacctacctgagcctgccccgttcactgtgggtgacaatcggacctaccaaggcttttggaaccctcctttggctccgcgcaaaggatacaacatctatttccaggcgatgacgagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcaaggagggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatctttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatacattgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattat

SEQ ID NO: 1300 - DNA, 4323 bp, Homo sapiens
atggatacgactgcggcggcggccgtgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcactggtagagattggcttcgggctgagctagcagtgagcaccttttggcccaatgaatatcaggtaatatttgaagctgaagtctcaggggggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttccccaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccactcttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgcctgcagaactccccccggaaacctacctgagcctgccccgttcactgtgggtgacaatcggacctaccaaggcttttggaaccctcctttggctccgcgcaaaggatacaacatctatttccaggcgatgacgagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcaaggagggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 1301 - DNA, 38101 bp, Mus musculus
  misc_feature (4575)..(4634): "n" at positions 4575 thru 4634  can be any base
ctgttaccctgggacagtatggcacagggagtgggtgatggacgctgggcagggcatgttctgtgaaacttgattacttgaatgggcccaccttttgcccaaggctctcccaacggaggccggaccccacaaccctgttattagtggtactgtttctggtgggctgaaatgtggtcagtcctgatagaattagctacctctttggatcaggggactttggtttgatgtggcatagaagaatgaacagcttgggggagttcgtgaactcctatctttgaaggtatttgagcagtggctagtggtttgtgctgtagcagatcctggccttggactggaactgtagcagacatgacaccgagtgtcctgtgctctgtgtgactttaaagtcatccaccccgggctgtgtgagtctgaccttgtctttttctccttcagatactgcccctgcagagacaccccgagggaaaccccagatcagcactagctcatcccagacaccgctcctccagtgggtcctcactctcagcttcctgttggcaacagtggcagtgggaatttatgccatgtaaatgcaatactggcccccaggggctgtgaactctgtccaatgtggccttctctctgtaagggagaatcttgcctggctctcttctcttgggcctctaagaaagcttttggggtccctagcccactccctgtgtttcctttctctctggaatggagggagatacctgacacagttccctcaccaaaagcacatccagccagtggcctgaactttgaaaccagcagccccaaatcctgcagcagagccccaaaactggcctgtaaaagcagctgttctgagcccagtgcccatggttgtaagcatccatgttgactgaccacgactgctgtcccccagtgccatggccactttgatatccgtttccagacatttctgtctcgtatttctgtcttgttttttattatttccccagttctaccagagtaatggtattttgttgttttgttttgtcttgtttttcctaacaaagtggggctatcttttgaggggtgggtgggaaagaattatttaatagttgtaaccttggtctctaacttctgtgtgaaataataaatggcattatctaacagtcactagaagtgcattcatgtctatgctgtctatgagcagggccctgctcatcttgtctcttcagtgtctggcaggaagagggcaggtgaaggtagcattggtagctgccatggttggctgtgcctgagatttggaagtgagctttaagcagttgggcaaagcagttgggcagattttccagactgtgtttgtgtgtacacagatgtgtgtgtgtgtgtgtgtgtgtgtgtgtgtgcatgtgaaggccagagatcaacctcaggtgtgtttatgaactgtaggatctcactatgcaactctgttggaggaactccctatgtagaccagctggccttgagctacaggtatcacaggcctgcctctgccttcatgccaagattacatatgaaagctaccacacctggccaatccaccttgttttttggggggagataggatggtacctgtacataagacagggtctctcttacgtagtcctggctggccttaagtctagctttgaactcattgagttcttcctacctctgccttccaagagctgggtttaaagatatgtactaccacacctggtgagtccactttgtttttcgagtgctaggattacagacacacaccaccatgtctgttttacatgggctccaactcaggtctttactgattgacctatctcttcagccccaacacttccatatttaattaggatgaaatgggcagagctgggataaagctgatacgctctgagtaacgatacttggagactggaggcaaatgcctggcttcgtgttttctcttctagcttcacttactgtgagtacacttattggtatgcaagaccacagggctcagtgtggggagacagctccctccttccatttttgtaaggtttttacttctggaggttgagctcaggctcgggcagtaagcactttacctgctgaaccatctgctactccactttggagttggtcacttaaccccacagtgactcagattcaccgcctgtgacaatacaatgatgctgctgacctcacctgtgtgtcttgagaagcaagttaaattccaaggccttccatcactcctagctcgcttatgcacagaaagccagtgtcttctgatcattgtacctcccgctctgggaatgggaaaacatcactggaggcagaacagggatgaggtacctactatgtcctaccagtaccagagggctgagagttaggagatctttgtcccccatactgactctattaccaggtcttgggcacaatgcttcaaatctcattttgctcactggaaaaatgagcgatacttctgtctttaactgctgaagagggaatatagtgatgtcaaaatactagtctgcacagaaactccagaactccatggaggcacatagctacagagatcagaggtggtatctcagagtcacgatacaagaaaggcattctgggagtcttatatacatgcagccaggtccagaagtcattcttttcttttctttttttttttttttaatgtattgtgataaagtaagaaaagttgggggagggttgctaaagagctggctcagtgcttaaaagcactgcctgctcttccagaagaccctggtttgattcccagcacccacatggtggcttataacagtttatatgtctagttccaggggatctaatggctttttctgtcctctttagcaccaggcacacatgcagtacactgacttatgtgcaggcaaaacatctatacatataaaattaaatgaacacaaaggctagggatatagctaagtggtagaatgcttgcttagcatataggatgccctgggttcagacaccagtacctaaagggtgagcaaacaaagggaagaaaagggaaaaaagagaaaaacctgggcaatggtggcctttaatcccagcacttgggaggcagaggcaggcagatttctggccatttcaaggccagcctggcctacagagcgagttccaggacagtcagggctacacagagaaaccctgttttgagaaaaaaagaaagaaaagaaagaaagaaaaagaaaaagaaagaaaaacaattttgaattctataaaagaatagactttctgtcaattgtcaagagatgagcaaaactagttaaaactggacagacttagaaagaggactaactatatcaataggaaacagcgtccagcgtgaacggactcgcggccccgtctttctttccagcgctgggaatcagatccagggctttgttctcattaggcgaggctctgccactgagctacaccatctactggtgcattggtggatgagcattttacttcccagcacaagtggtgctgtagattaaatctaggacccttacccaagccaattctgtgctcttcttctaagccacagttgcggccggccctgggccttttagagaatcttagagattagccaacaggtcctgtcctcagggttggctggagcaaactgactgagattttgtcacctttagttttctctggctagggataaggccttgagcctttccaaatattcgtggttattcaagtgtttactgatagaggcaaagcggggataggcaggaagagagcccagccaccctcacctgtctccatctggctcatgtttctagcttactggtcaagagtttcaacacaggggctggagagattatggctcacttcctgagcctagttcctagtattcacatggtgacttacaagtatccattttaggggctctcacaccttctgatgcacaaacaatcatgcataggtgcacatttgtggggtggtacaccaaatctatacaggctaccagcaaagttgggtgtcttcctcagtcactctccactttgttttttaattaatttatttttggtagtgagacgtgaactcagggcctcacacatgctgggaaggcactctactgtggggctgagggatgtaggggaaggggggtggggagagagcccatggctggccagagttcctgtgctctgggcaggcagacataggaggactgctggaccctttccactcggccctgggtgggcatctggctgtgtgaaaccactgaccccactcggtgggggtgggggggtggacaaggggcagtctgcaataccaggggccccgggggcaacattctcagccccggagatacaggagagagggcagagggagagaacttcccacgcaggctggctggagcacaggaaggccttcagataggagattaggcgcggctcattaggaaaagcctatcccatcatccaagcacagcaggccttgatgaacagagacagtttatggttttagagctttattgtagaaaggcagagggaaagagagagaagatggaaagacagagagagagagagaccggccatggccaagaggagggaagggggaaagagggaaagaggaaannnnnnnnnnnnnnnnnnnnnnnnnnnnnnnnnnnnnnnnnnnnnnnnnnnnnnnnnnnnagagagagagagagagagagagagagagagagaaagagagagaagagaaagtaagagaggttagacagtaagaaaggttagagattgaggaggggccaagcagcccctcttatggtgggcttgttatcttgttgttgctaggtaactggggaggagtctagcctgaaggtcagaagcttgggacattgtgtatgtgactaaaagccacgcttctcctgtgggggctggaggggcggtaacttctacaggagtcaggggtccaggagacatgagggaacacctacgtcccatgtaggtgaattatcaccaccaggttctactggagttcagacctcagctcgactggagaccagactgtctgtgtatagcccaatgccccacactctaccactgagctagattcccagccctgtgctaatttttggaacaaggtctcttatgaatttaaaacttatcaactgattagactggctgaccagcaagccttggagatttgccgtctccacttttctagactgggattacaggcaaatgctgtatccatcttttctaagtgggtacagaggaaccaaaaccaggtcttcatgttcgcacagcaaacactttactgaatgagtcacctccctgactccttaacttctccatgtgatctatgtacggcaaaatgattttgatttaaaaaaatggacctgcatggtgcctttactcccagcactccagaggtagagggcagggggatctctgagttcatggctgacctggtctacagagtgagttccaggataaccagggttacacagagaagagtttgtaaatagatccatgtatatatatattttaaactttctattgattctttgtgaatttcatattgtgtaccccaatcccacgcatctccccatcccttcctatccaacctgtgcccttgaagaaaaagtaaaaaagaaaaacccaaaaacatctcaccatggaaactgcagtatgtcactgagtgtcccacagtatagccttttgtccacatttctttacttgcaaatgctcattgtaatgagtctggtttgaggcctctggcttctgctgtaccatcaatactggatcttcactaggacttctcttggatatactgtttgttgctctgtgtcatggagatcctgcagctttgattctgcaggacagacccattcaggagctccagcagttcatagatggactggatgttggtataggctaactcaaaagccctggatttgggtttgggctggtagctgagttgctcagcccaccagttctcctgcacccctggcccaggcaaggagtgggaccagttatgctgtgcccaaggcatttgggccaacattctcacaaccacaccacggggactagctctccagcactgctctggctagctcactcaagtgccacaggatataggcatacattttttgcaacctacttttttttttccttcaagatagggtttctcagtatagctctggctgtcctagaacttactttataggccaggttggccttgaactcagaaatccacctgcctctgtctcccaagtgttgggattaaaggcatgcgccactactatccagcgcaacctacttttaataagggttcaacctctcttctagcccaccactcagcaaaggtagaaagagaaaagttattaggatatgggagaggtggacctgttcagcaatagttctttggggtgagctttgatcttcttgggcagcagttcagtcctgaagcaaacaccaaatatgacccagcagctgtagacccgtcctctaggcaggcagacaccaggcacacattaggaatgaaccggcaactagtcaagtcctttcagcaagcagacatcaagtaggaagcagcaactatagctcaatcctgaagaaattgccaggctcaccaactagcctgaggcaaggccacagccgtgacaagctgctgcaggaacctcacgagcaggttcttggataactttctttcaatggcagtgttaccacaagttgagctcaacttgtgtaaggtgaatgaatacatgtgtgtctttagtgaagaatagcaaggtggagcaaatcaaaccaaggctcagtgctcgtctcccactgtctgtggagtcctatttatactccttcatcaactgtccttttacatgactgctatatccaaacatcctttcacctgtgtctgcgtcaggaaaacagtctttcacgtgtttgctttggcaagacattctttcacctttgtgtcccagcaaaacatcgtttgatataaccaactatccaaagacctagaagtttccacttcaacagctggcaaggagttgggccggctctcatgcccttggagccaactctacccgtgcttctcaggcaagtggcagggcaaggtctgcccctgacaataacatggtcccaagaggcagtccagatcagggatacctacatggcctttggtgttaacatggaccatggacactaacacagacccctatttgccgtatggtcatggacccaggcatggcccttagcagcaggatagactgggacttcaccctggcctcagaaggcagtgcaggctcctcacatctggcggttcctcagcgcttttgcacgtccggttccgtctctcttcacagtgcttaactcatcctgcttctctttctctcccatctttctaccacacacttgcacattgtagtggtgcccatgctatgccatatggcaggtgggcctctgggtttctatttaaaaaaaaaaaatctttccagccaggcttgatgtcaaatgcctttaatcctagaggcagagacagatggttctctaccgattcagggctatcctgatctgcatagaaagttccagaccagccaaagccactgtgaagaccctactttaaaaacaacaacaacaacaacaacaacaacaacaacaaaactttctgaatctgtactttctatcccttttctctttgtgtgtgtggcagccaggtatctgtactctctgagttacttcacctacctccttgaaccaaatttttgtcttcctcgtaattcaccttataatctcatttataaaatcccttcaccagtctaataaatccccttttgcaatgttaagaaaaccttttgttaaggaaacaacacattcctctcccttcccaccaggttagtttagggtcattcaactccaaagtccccaagttgcctgtttaatggatctgaaagacttatgccttcattcctctctccttaagtctatctatccatttcttttttcttttaagagttgttatttttaagtccttcctttctttctttctccccaaacagggtttctttgtattcctgctttcctggaattgctcaatctcagcctctcctctgtagagctctgtaaagcctctgcctcctgagtgctgggatgaaaggcgtgtgccacatctggcagttgatttatatgtaaagatatatgtatgtgttctgcctatttattgcatgcatacctggtgcctgtagaagtcaaaagagggcatcaggctccctggatggttgtgagccaccgtagagaactgattgtctacaagagcagtcccagcagctcggcatttaattgccaagccatgtcgccaggactctgtctttttttttttttttttggtttttccagacagggtttctctgtgtagccctggatgtcctggaactcactttgtagaccaggctggcctcgaactcagaaattcgcctgcctctgcctcccaagtgctgggattaaaggcgtgcaccaccatgcccaggcataggactctgtcttttgaccagtgaatttgctgactctgcttcactctgacttttgctaaaattctgttcagtgcctaagtccagcattccatctgtacctgaggggaagccccagccaacaatgcggaattacatccctgctattggtgacaactgttaagaacagcctcgattttggtcaagaagcaaataaagcaatctaaaataaaatgtgttaaacctgtcttggcacacagggattaccatgaaatgctgagaaaaccaagtcttagattcacctggtatttttttttaattgcaaaaatgctcaaactttattctctgtaaatatatgtttgaatggttgctgcagcaataggtttccacttgttcgtgtggatgggaggaactcaaaggaaaatctacactaaggttgctatgctaaatctgcctccccccccccccaagatttccatttggaatttggccatgaattttgcatggtttaagcattgccaaggaattaaaaaagttctacagtcatcataattattcgtctgaatctgaatgaaagaaaacatccctggcttcctgggctttggtactatctgagtaggggaaggtgagccacctggtcccaaagctgcggagacagcactctggcacctcctgccgggctggagcaagagtacacctcaggcatactgctttctcacagcagctctgaaaggggtggttttctcatatacttattttaaaggcagggtttcttcagcctccctagtgctagcagatatgggggagggctgataagtctactttttatttatgtgtctgtatccaattgctcagtcattgctccagtccgtttccttttacttaaaaaaaaagtgtacttatgtacagatacatatatctttctctctctacatctaacatgtacgtggcccatagaggccaggagaggacattgggttctctggagcaggagtcacaggcagttctgagcccctgactagggtactgagaacagagactgggtcttctaaaagtacagcaaacgctattgaccaccgatccatctctcaagtcccacctttttacttgggaaaggggctccctaagtcacccaggctggccttgaacttgcgatcctcctgcttagactttacgaggagcggggctgacagacctgcgccactgggctaggttttctccgaagacctaaggtttaaacgctcacaaagctcccgagcctctccgccatctttgctcggttagctgctagcgccaagaactttcgcgccaaaacgtccagcctcacaaaatggagaccggaaagagttgactcgtgacgtcaccaagacgccacagccaatcatcttgggaaccaggccttggaggcgggactcaaccggcgcagagcagtccaatagctatccgcggcgctgaacgaaccaataggagcgcagagaccgcggtggacaaacgcggaggctggtttttcccgcgaaagtcggcttcctctaggagggctgaggttcgtgtggcgcgccgctgtgaggtgagggaattgcgggaccccgtctggggaagctcccgccgccccggggtgctcagctctctgtctcccttgacccaggtacagtcatgtcgggcttcgacgacccgggcattttctacagcgacagcttcggtggcgaccccggtgcggaagagggccaggcccgcaagtcgcaactgcagaggcgattcaaggagttcctgagacagtaccgagtgggcaccgatcgcacgggcttcaccttcaagtacaggtgcgacagtgtccgtgaaccattcttacgggggacgccttttcttgacagtccctcttcaggcctaaatttaggatagagtggtctacaattaggtgtcttttgagagaggtgggggcattggtgcctgtgaggaccggggtgcacaggcactgctgctgacggtccctcaatgcacccttcctgtccctctgcccctttgttgaccactaaagagatgaactcaagcggcattacaacctgggtgaatactggatcgaggtggagatggaggacctggccagttttgacgaggaactggctgaccacttgcataaacagccggccgagcacttacagctggtgagtagcacccatttcagagcctcctaaacccgggccctgccccatcatcaccagcagcttatgcctttcctcttcttcagcttgaggaagctgccaaggaggtggcagatgaggtgacccggccccggccagctggagatgagctgctccaagacatccaggtcatgctcaagtcagatgccagcccgtcgagcattcggattctgaaggtaggagtttattgaatggctagtcagggtggcatggccgctgtgtggtgcagaaggcgtctgagacaggtagcttggagcaccagatgtgtgaccctgaccaagacatttgacttaacttagtctttatcctgtgtaaaattacctcaatggggttgatgtcttaaagggaaggcagagttgagtcttgcagaacaacagtgagttcctatccatcagggagactaaaaaaatagtaaatgccatccataactgggaggcagaagtagaagcctggtgtacatgagaccctgtctcgaaaagaaaagaacgtggggacaatgtggctattgctgagagggtagagagttgaggaagaatactttagaggaagtgttgttggagctgaaattgattgatgtgtagccagtcgggtcaaaaccttgaagagtgttccaccagactcagtctaatgaaggattgcaacagggaaaccaatggaaatcatctcgtaggtgtcctctggtacaagtcattccttgatttaagcctgaatcataattaaggcttaagccctttagttttgtttcgttgttttgtttttttccgagacagggtttctctgtatagccctggctgtcctggaactcactctgtagaccaggccggcattgaattcagaaatccgcctgcctctgcctcccgagtgctgggattaattgtcctacattcttatcactggcatgcttgtggccctttcatagtttaagagtcttgtgcatgtgtgtgttctctaatctagcccaagatgccccgagttggagaaatggtagggagattgtctcacctgtagactggtgaggctggcacagaaagcaatggaatgtgtgagaatgtttcactgtgtatagtgaagataacagagactaaaaagaagaggacttgtcatctagcttaatgattagtagtaacaggccagccattttgactttactgactcctaacagtatatgtccctgaaaggtgaggattttattttgaagcagggtttcattacatagcagctctggctgtccggaacttactatatagactggtctggctttgaactcagatccacctgtctctgtctctaaagtgatggtatcaaaggtgtgcaccaccacgtctggcacaaggaatcatttttacagcatgactattaatgaatggtctaatgaatacattctaaagagacactttagctatcagaccactaaacaattgtgccccctcccccccgaatttgggatttcctcaggaatctcattcatacctgggaaagaaaagcctgaaccactagtggaaactcttatctctagaaatgggttttacagtagagaaacagtgatgggttaatggtgggtgggaccacacagcttgatcaagccgacttgatagacatacccctgactctgtttaaactttgatctaactttaggatgcctgaggatgggctcaggggatgtggataaagagtctacccaatctctttgctcttcttcccagggtgaccctcttgaacacgtctcccccttctgctttttactgtgaatattttaattggctacttgaggatgagtggctaatctggcttcttggtatataggtgtgaccctttgtttggtaacatgatcatagtaacatcacaattaacagttagtgttagtatctagtgagatggagtcgttaagatggcgaacctgaggctgacagaatgtccatagcagttggtgacaaaattgagctagcaccagggcctctgtcttgtgtcaattctctggaacagcacaggaagctactgtcagggctggagtttgggtcttctgggttttgtcgtaaaatatgtttcatgtttcccttgtctcccagtcccttgccatgctctgcaaggcccttgaaaagtgagtgcttgtgtatgaggctcctgaacctggtgcccaggttacctcacattaggtgggtgctctggaaagtctgagctaaactatgagccatggatttgtcaccctccagatcttgcccgtgtcattcctcagcccttcacataactcctcgttctccttaatcatcaagtcttcttgtggctttgttacagtcagacatgatgtcacacctggtgaagatccctggcatcatcatttcagcctctgcagtccgtgccaaggctactcgtatctccattcagtgccgcagctgccacaataccctcaccaatatcgccatgcgcccaggcctagagggctatgcccttcccaggaagtgcaatatgtgagtgtgtagccaaagggactctggggaatgacctgaagtatcaaaaaagctggcaaccctggcaagtgctgcctgtactgcttgttagagaccttaaggcaaagactgggaagcactctatccttgagttaggcaggatcaatatacccagcccagtgtcccttcaggcagttgaaattttgccccacctggataataatccacatggcctgtgtgtggaatccaaggttggggaggaaacagtccaggggattgagtctatatggaaactgtttctctgtctctctaagcccctggctatcctggagctcactcgtatagaccaggctggctttgaactcaaaaatttgtctgcctctgcctctcgagtgttgggtggcatgtgccatcaccagctggcttacagaatcttctaaagcaaactggattgctgggctagaccagtacagtgtgcccactgtactgcctaagaacatgactatactacttgatatttagcatattgttaaactatagtggtagaatgtgtggacttccagttagtaggactttaaaaatttactgtatagttcttaacagaaaacatttgccaacttggacctaacaaactctacttgcatcttggctgcttttggctttctcttctagtttcttatcagcttccacattgcctgaggcatactggcattgtcctagactgttgcctaccctcacctgctgccacagagtagctcattcctatccccttgtccaccttcactgctcttcagtctattccctatacagaagctcttccatagcctgccttggtctagtgcacttgcattctcttctccctaagtggtcttcactcagactgccacagtgtccctgcatgtccttgtcatctaagatgccttccttatcctatgtttgcatttggtacatacatgtctgcacactctcatctgcctatttttactgcatgcctttatattatgcagatggtcttcaatcctgatgggaatttagcttcacagaccagggactttaggtttactgctatgtgtccttacctatatttgctgaagagacttactgtataggcctcagagtctgtaccctcagaatggtctagaagtggtaaaataaaatctcactagaaaagatactaggctaagaatacagtttagtaagggattggatgatatagctccttcacctatgaggacaagaggcctcatgagggaacgatgtgtgcctgccacctcagtgtgacgtggagaagccaagatccctgaagatctgactttgaatctagcaccctgccctaggtctttcccagctgtgttccagctctgccttataatgctgttgcctctcagggctgacttgttgaatgggtgtgcgtgcctcacctttgggttctcagggtagttctagtgaccacttcttcccctgcccagggatcaggctgggcgcccaaagtgcccactggatccatacttcatcatgcctgacaagtgcaagtgtgtggacttccagactctgaaactgcaggagctgcctgatgcagtccctcatggtgagatgcccaggcacatgcagctttattgtgacaggtaagtgtaagtatgtaggggctgtgggttggtgtccatgccactctggtacagcatagagatcgtctcgtgcccagtgtgtaagctagagctcttgctttgtctggtgcttctcattgacattggcattttttgtctcccatagtctgcaaagcatgaccactcctattttacatgagtactgtaaactgggggagggggtcaggtgactttgtgagtagaactaaggcctgtgtatcttcagagactagccctctcagcacagagctggataactagcagcagtgctagctcctatctagctgacataccaaccttcctgttaagacctcctggtttggttgaatagttacaaaatgacctagaagaaggcttacaggtccctgagttctttttgtttgtttgtttgtttttcgagacagggtttctctgtagccctagctgtcctggaactcactttgtagaccaggctggcctcgaactcagaaatccgcctgcttctgcctcccgagtggagtgctgggattaaaggcgtgcgccaccacgcccggcagtccctgagttcttaccctgggctcatatacctgatgatgagtacagatgtaaaactttctggggagtaaatccacagttgtcagctttatcattggcaagaatgtgccactcgggatcttgggaaagctatattctaagtccttttttttttcaatcagtaaaatggcctgaactatttcaaagtgcctgaaaaggcatatcaagagtttaacacaattccttagcacaactgagcgtattgtattagagtattctctgagtatccaaagagcttgagaattacattgtggaatgagtaggaagttaataggacagtgtaggtggcagaaacggttctcggtgaaactgatttgatagtatatagaacacctttgagtttgttaccttgcttgattcccaacagctgagacaagtcaaagtcatctctccaagctcagagaggcactgtgatttctctgaagtcacacagctactttatggtccttgaagtaacactgattccagggaaacatggaggctttggtcggttaacatcttattgttaaaagggtgactaaaaacctagaggcaaattgacttggctgagctcagggagtgtggcagaggcagaaatggagagtggcactggcactagcaagtaatccttaagggtttgaggagaaagttttcccaaaggagcttggtcacagctcaaatgacctaggacttctgaaggctgggcaagggcaccgcgcctcacctctaccagtacagcttctgacctcttgaattcagtgagagtcaggccagtattataacactgtactaactatccagactgatgtgtaggtagcaagagtagagaaaggttctcttactctagaccatgcaaggactgagctgacttcatagtgatacttagggtagaaatactaagctgaccacactgtgatttgcttttctttatcttccctccctgtactttactcaggtacctgtgtgacaaggttgttcctgggaacagggtcaccatcatgggcatttattccatcaagaagtttggcttgaaccccagcaagggccgggacagggtaggtgtgggcatccggagctcgtacatccgagtgctgggcatccaggtggacacagatggctctggtgagttgctttgaatttctacacttctcttaacaagctgctcatgtgataacctggcattcttgaattgctcaaaccattaggataggatgtgctttacttgtgtgtgtgtgtgtgtgtgtgtgtgtgtgtgtgtgtgtgtgtgtgcacgcgcgcgcgtgcatgcgtttgtgtgtgcacgcgcgcgcgtgccatgcgtttgtgtgtgcatgcatgtcgtatgtgtttgtgtgtgtatggtgggcatactaggcagatagtctaccacttagctatattccctatcctagagtgttcatttttacagtaagcaaaaatttgttgccctaaaaatgtctatttattggtttagttgtagctcctgccctgaggttgttgattgagttgcatgactcagtgctatagatgggatgtggtgtgtatcctgtgctgcatcttagtaggtggagagaaaaaagtgcatgagggttgagcagacagaatctagttggaagagatcccctaaaggataggtgtctgacactgagctgctttaattgaggtctggaaaaggaactagagcattgtgggaaggcttcatctatcaggagtgtcagcaatagctttgaaggatggaggtgcgaaggaggatcttttcaagtatagaggagagttggtgggaactcaaggctggtgggggtgcaaatgacaggatctctagtaggagttgggttgagtggtaggggccaagtaaatagcctcaactctcagatggagtagagagctcatgcttacatctaggggcagtgggagtcaccttggggattggtccctacatatggtctagagtgatggagttttgagtactgtgtccatattctatgttggtagaaactcccttggttaaaactggaaaagccacatattcatctagccatattccagactttaactctccttgacttgccatatcacttaatgttaccatcttctgaaactggttcttccttagccatcccttcccttgcttagcaaaccctccagatcttcctcagttcccttttttttaatcccctaacctcagcaagcatgctgtttggctgctctactttcatccccagggctgaccacgtcttacctccctgctctgagtcccactctttctcctggatttggattttcaagcccctctgccacttggtcccaccctaccttctccattcctcagcaactcaagtgaaccatgctgttttgatcaagcaattgtgttggttctctactctgtctgcattatgagagactttccagtggtccccaagggcactgtgatctggcctgattgtatggaaccttcttttcctctctggatctttgagatttgaaagactgatatagtcctgtactcttaactttcctgagtaagactgtgtgcgtcctcctggtgctgagagctgttggtgtgtgtatgttgacagaggtcagggtgttcctgatctaggtctaggcccagcagtaggctggaggagatgccccttgctcatgtatgcacctgttccctcctaggccgaagctttgctgggtctgtcagcccacaggaagaggaggaatttcgtcgcctggctgccctccccaacatatatgagctcatctccaagagcatttccccctccatctttgggggcatggatatgaagaaggccattgcctgcctgctttttgggggttcccggaagaggtaaggggtctgggaggaaggtgctgatgacaaggctgctgcaggaggatatctgtgtgatgaggaccaggtgtgttcttccatgtctcccaggtccctcagcctgctggccctggggagcacagtgggaaactctttggtctaatgtgagagatgccaccttgaaccaaagtttctgaatgagacctgtgaaatacctgacacttagaaattgtcatatgtccttttcctcttcctctttccttccttcctttctggtttttttttctttctttttttttttcttttagatttatttattatatcttaagtacactgtagctgacttcagatacaccagatttcattacaggtggttgttagtcaccatgtgtttgctgggatttgaactcaggacctttggaagagcaactgctgagccatctctccagcccctcctcttcctttttctttttccttacctttccttctctctctgtctctctctctcctttttttttttttaagatttatttatttattatatgtaagtacactttagctgtccttagacacaccagaagagggcatcagatctcattacagatggttgtgagccaccatgtggttgctgggatttgaactcatgatctctggaagagcagtcagtgttcttaaccgctgagccatctctccagccctttctttcttttttaagattttatgtacatgaacatactgtcgctttcttcatacacactggaagagggcatcagataatattacgactggttgtgagccaccatgtgactgatagaaattgaactcaggacctctggaagagtagtcttaactgagccatctctagcctgcttttctttctttcttttttcttttggtttttctttttaaacaggtcttattatgtaatcaagctgtctttcaaattcatgatcctcctgcttcggtctcccagattctaagattagagatgttggtcaccattcctggcttcctgtgttcttttgaaactctaaaataattgagctcaagactgtagcagcagtgacagtctattctagtggctactgtgtaatatgctttttgtactacattcagaacattcttgtaaatgcttcatctgtcctgaacccagcccattctctcagcagtctatatggatgttactgttgtattcatttcatagatgaagaagctgaggcacagagaatgtaaggacttacttcaggtaacaggttgggctggattctgccctatgtctactcttcagtgtgcacagccctcagtgccatttatgttacttcccttcctgagaaataccttaccaatgttaggctaggaatgagagaacggggtgtgagcttgtttctgggccagactctgtcatttccacctgttctgagactcttacgggagggtgaccagcccacataaagccaagagtgctgatacataactataatgctagaatctggaagactaaggtgggaagatcatggattagttcagaggatagccctcaagtagattcttactttgtcttctacctacctatcgtctctaggctcccagatggactcactcgccgaggtgatatcaacttgctgatgttgggagaccctggtacagccaagtctcagcttctgaagtttgtggagaagtgctctcccattggggtaagtggctgcagacaactttctagtggcttaggtgttccgcagggaggaaggctacagagtagagttgcctagttcctagacatgcatggggtctgattcaaccacatcctcttcctcattcatcttggctctggtcaggatggcagagggggtttgaaaaggaaggtgtgtacatagaggtgggtggtaagagcattagactgagtcaggcttgctttgcttctcagcctggcagtggacttggaagaggtagcctagattccctgagcatcagcttatactcatttgctaagtaatgacgctgcttatgatagtagctggaatcaagaaggaccagatgcttgctgaagtacctactaagtttttactcatttaactatttgtcttcttgtgaagtgctcctgctcatgttatgtattggataaggagtggagcggtaaagtgtcttgctcaagatcccactgctggggaactttagaacaaggttcaaggcagtgtgtctaatgacccaggtgccctgagtctgggagggatcagggagaggagggtggatgtgacaactgactagtggtctgtgaaatgggggaagtggtgcttttggatggagaggaggttgctaaagctaaccacattggcactgtctcacagaaatatcaaggcctgaaaatgtaagttgtgccatgttaagtcttatagaaagtaagaataggtggaattcatttgtggtttttttgtttttgtttttcgagacagggtttctctgtatagtcctggctgtcctggaactcacttcatagaccaggctggcctagaaatcagaaatctgcctgcctctgcctcccgagtgctgggattaaaggcctgtgccaccaccgcccggctggaattcatttgtataatctgtttagcctgtagtctaatataagcttttttttccctttcagtgtagttaaaccccaaatcttgtgcatgttaggcaaatattttaccactgaggtgcatcccaggcttataacatgcaagtattgagtatttggcattcatgttagcacaatgtgacctgagtatgtctcacatgcacctcaggtaggatttactgtatttcaaggggtaaatacctgtatgctacagatgatggactcaggatagagacctcctaaaagccaggaatccccaaccctgaggccagcttcaaatatattcttttctggggatcaatacttaatgtcaccgggatatgctgtagctcaggtgaaccttccaaagaggaaggaaaggctgaggcccagttaggccttgagttctgtactgttcaaccagttttgcagcgtgatgtgggtaagtcatagccctctgagctcttgccctttggggctggcactaagtactgacacctcctgtctcccccaggtgtacacatctgggaaaggtagcagtgctgctggcttgactgcctcagtgatacgggacccctcatctcgaaacttcatcatggaaggtggagccatggttctggccgatggtggggttgtctgtattgatgagtttgacaaggtgagtctaagtcttctagtcacaggactggggtgtgtggcctcaggtgtggtagcagatacctcctgagagacttatatatagttcttgtgcccatcactctgggggaacttgggataggttgctttgcttctctggggtactctggaaaaaagtgaaagccaagcccgtgtgattatctgctattgactggcctgaagtctactacagaatggttacggttcctagatttttctgccactctacccagcttgggatgggattctgatagacaaactctcaatgcagatgcgggaagatgaccgtgttgcaatccatgaggctatggagcagcagaccatctccattgctaaagtgagtgacagctacccttcagcaatcctaagtcctcctaaggctgcactaatgtgtgctgccaagtcctctttgcccaacgctgtgctagcagcaacgggcctggaactgggggtgggggagcaagagtgcacacatgtaagcatgtacacatatatatgcgtgtacataatgtatgagttcatatgttcatatgtgatggagaggcctgtcccaggatttttggttatttgctccatttactcccctttctacttcaggctgggatcactaccaccttgaactctcgctgctctgttctggctgcagccaactcagtgtttggccgatgggatgagacaaaaggggaggacaatattgacttcatgcctaccatcttgtcccgatttgatatgatcttcatcgtcaaagatgagcacaatgaggagagggacatggtacgtctcgggctaggctggtgacaacagataggttcatggtcatgaaattgaataagagatttagccacagaaatgctagtggttagatagtctggaaggaagcatatgaaatgacttgttagtggcttatggagtgttggagaggaacctagggtcctaagacctaggtatgccctgtgtgtgtgtgtgtttttttttttttttttaagcaagaagctaaaaaactgagctctgctctccacccttgttagtaaatttctgaaagaaaatagcttatggaatttgataaggctatgagtatagtatgggtatacctatgggtatagttcccatgaggctctaggttgttggaccagctgtctgtttctgcttcccttttggaggctttaattcttagacagttgctccctgtgatggtaaagacaaagcctatcttggccaggctgaggagtgcaggctttctgaactctggctggctggctcagactccttttcaagatggctgatttaatctggtgcctccctgcttctctgaattgctctgcttggtctcaaactaactttggcaatatgttttaattttccggctcattctcattttctggcttgttctgtcttcatccctgtctagtttgttctttttctgaaacctatctctacaattgtcccagtaaaactgcctccttctcttctttgtactgccccttaagtagcttctttttcttttcttgtgagacttgggcatatctttttctgtcaaatttttctctgattcatcagtttgtctgccactcaattagatatcactttcaaacatgggtgtttccttctacaaattaattttaccttcattgtttgggattaaagggctgagccatgccataacacgaaataaaatctcagggttcatagtgtgatcaaatatcctgcaacattagctattgatttaattaactgtcctgaaaggaagaagatgaagccttttctagtagttataatagaagtggcagaatagcttgggtattgtccgctgtccatgcttaagtagatacttgccctagttaggacagataggccaaaagtactggaacacaagcatttgccgtattatttcacctcattggcttggatatgtccagtttccatgcttaagtagatagttgccccagtgagagtggacaggccaaagggactggagcagaagcacttgccatattattttatcttgtctgttaaacctgtgagctgacccagtgttccctgtgctccttagatgctagccaaacatgtgatgactctgcatgtgagtgcactgacacagacacaggctgtggagggtgagatcgacctggccaagatgaagaagttcattgcctactgccgagcgtgagtgctgggagataacatgggctttttggatagagggagagcccagtcctgttctgctccttacctaggatttcctggtaaccctgttctgaactttgttctattcttacctgtcactgtgaccctctccatgagtttaacttttctcatcctcttaagtgagggaggtagagtggaggagctgaagactgctgggaagcctgctccctggtgggcctcctgctcctgtggggccctcagtttctggtggaacagtgtacacctggtagctagacagcatactgcagccagcattgagtagttttctgggctggagagatggctcagcggttaagagcactgactgctcttccagaggtccccagttcaattcccagcaaccacatggtggctcacagccatctgtaataagatttgatgccctcttgtgctgtgtctgaggatagctacaatgtactcatatatacactaaataaataaataaaagtagttttctgtacatatgttcagattcacttcccactatctcagagaggtgccatgtctgacacctgctgatagccaggtcaagtttttcttaaatctctttcaaatgacttatcagctatattatgcacaggaagctgtgtttgggaacattcatctttgagagccgatagaggcctgggaacagggtgggggcaacctcaagattcctttctggctttactctagctcactctgcaatctgcaggaggtgtggacctcggctatcagcagaggcagcagagaagctgaagaaccgctacatcatcatgcggagtggggctcgtcagcatgagagggacagtgaccggcgttccagcatccccatcactgtgcggtgagcaagtgggctcacctcagagagcagggccagttggccactgccattttcataatgcaggcccagggtgggttgggcaagggagtcatctgggaccatgtgctgtgtcttcctaattattttgttgtgtgtgtttgaggctggagatgcctgggtaggtctcactactttattttgcctggcttccctctttgagaggcagtttgagggaaggggaggactctgaccgacaatgtagctacagggaaatttacagattttcactgggtcatcatttatagacaatatagtaagagctggggcctacctgagctgaattatatctctagcattgattggttacaagtagatctggttgtgtatagtgaaacccaaagaaagtagcttaagttggaagtttattttcattattaaactttgggaagtaggttcatggtggttttttggagctgtatgggctccgttaaattcatctttgccaacctttcagccccatatggttttagaaggtatagccatcgtgtccacattttgagcaacaagaaagacagtgggaggaagatatgctttttaatggatattttcatatgatgcatggatttagaacttacaggccacatctagaccaaaaagtcaggaaatatcccttagcaggcagcatgtgctggaataaaaattgggttccagtactaagaataaagggtaatagattatcgggatagccagcaaactcccctgcagtcctaacaaccttggccctggccttcctggaggatcagaggagggaatgtgggctgagccctttgagtactttattgctccaacaggcagctggaggctattgtgcgcattgctgaggccctcagtaagatgaaactgcagccctttgccactgaggctgatgtagaggaggcattgagactgttccaggtgtccacactggatgctgctttgtctggcaatctgtcgggtgagtaagcgctggactgtggtcttggacgctaggatagagatttagttagcgggtggctggcagggtgcttcctggatatgcttttgataatagcctttccgctgtgtctctcctggatgttttagctattgtaggaggaaggagcttctctctagacctcttgagtcagttcattaaaagtaattgtaggcctgtcgctggtaagtagtggctgggagtcctccctgttaagctcagaactactctagagtttcccaatttgtggcctcgggtttcttttggttttttgttgttgttgttgttgttgttgttttggtttttttttgacagccaggtctggcacactagattgtcagtccttcctgtcatagagatgagactgacagatcttctgtcatggtcaccagtcttggtgaaatacatgcctcttggcccctgagccttaatgtttactgccttctttcagcctctgagattggtgatatgccaaccagagttacatctgccttaatctgacagtaaatctggtttcccatttgccaatcactgtctaaatgccagagctgtaagttcccaaggttcctgtcctacccattccacaagctttctaatctttcttggtgggataggtgaggaggttgttaaaggtagtgactgaaaggaattaagaggagcagtgacagctgggccaggtatgttggaggagtggttctctttcttacctgataagattgtacacctcttgcttactcagggcttctcagatttgtactctagagggctctgccttctctcccttcttgctctctttaactcaaaacttatacttccattgggcatggttgtggagagttaggaaaatctcttgagttggagatttgaagccagccaaggctatacaatgacactgttcctcaaaaataatgaagtaataaataaacccaaccaaataaaaactctgctcccttcagagtcttttctagggctgttcctgttgccttggtatgtgtagcccatagggtctcgaggcaccggactctcatggtgtctctgctatctagctctgtgcttgtcgcagggcctctgtcacctttccctctgcctagagcactcttccccatattacttgattctcacttccctggtgaggccttcactgtcataatggtgttctgtctttaattttctctggttcaggccactctagttagaggctgtcatctctctggcccttccagtatggatgaactggggtttctagcacccagtttccctattgcactcttgacaggggtggagggcttcactacccaggaggaccaggagatgctgagccgcattgagaagcaactcaagcgccgttttgccattggctctcaggtgtctgaacacagcattgtccaggacttcaccaaacaggtgagtgagcctttctaaccctgggtctacaagccaggcccaggatacagaggatgtcctgctggttctcttagtctggttcccactcagccatcacatacagtgttctgtgctcagcagaggggtgctgggatggggatgtttgagccactgttccttttgtaggaactgctacagtctacagttggggttggctatttatagggaaaggaggaagacagatctgtagaaaccaatacccaattttcccatctcttaggttttcccttgtttagatccttacatggtagggaggaccagaaacagatgagttagccttgcagcccattgggaagagggctactgataacatgcacaggaggtactgtttggggtaccagtaggagcctgtgccctttaaaatcatgaggatagccctggtttctgtttctcgttcccttccctgtgtatcctctccgtttgctcctggaagtaaattatacagtaacagatactggccctctataagtgaagagactagtcttgcctgaggctggggctggagaaagcttgacttctagggtcacagggacttaagtcctagctcacttaattgctatatgacccaaacaagtgacagcctgtgcctatttcttcctctgtaaaatgagattattcctaatactaggtgcataaagtcgatatatgtacttgcctagtacacaagaggcatcatcacatacacacttttctgaagtcaagggagaatggaggtggatattttttgtctgtttaaaattgtctatgatccggtgatgcatcaggtcccttgggtcataatgatatacctgtgcatctgtcttgtgctccctcctacagaaatatccagagcacgctatccgaaaggtgctgcagctcatgctacgcaggggtgagatccaacaccgtatgcagcgcaaggtgctctatcgcctcaagtgagcccattgcccatcaaccctcaagcctgaaatgctgccaccaccctatctcccagtcagtgctccaaacctccttttgccctgcctctccacctcagactgctgtctgcagcacatctgcagcccctggaaatgtactttggtctgttggcctcatactgtgtttgagtgtctgaggactctctgctctgggtgtctatcccctgtcatgccttctcaacaagatgagtctggagcaggaacaggccctggaatgtagatgggtctgtatattggctcccgggccactcactgccaagcttctttgtatgtacagaggtaataaagcaattgagtccctggctgctaaggtcagtggacccagtatgatagtagtgctgtgtgaatacaaggttgactctttcagctttcttcagcagcacctaatgtgagaactggatcattcattgagttgtctgcctcagtttcctaatctgcaaacaaatttgatgaagctgagctcagtgagtgagtggctgtcagtgaaaacccaagtagactccaatgtagaatgtctccagggctttatttatagcaagtgggcctcagtggtgtctggggaaggaaccagacgtcagggtttatcagttaaggagctatgagtacctgagcaagcttcagcacagtaggaggtattagtgacaacattgttaaaagaagacacccaacaccttgtattaccaaaatgccgaaaattatgattttagaaatctataatttataaaattaaggaaaagtcagtgaaatatttaagtatttgttatgtaaagtacatttataaatgggaagctagtgctgaaaacactgcagtcaccaacagtaaagttactgtaggaggaaggcttgagagaacaggaagtacatacacaggcctttctcgtagatggcgtcctgtgctgaaatggctgttgcttgaggtgtttgcttttttttttttttaagttttttgagacagggtttctctgtgtagccctggctgcctggaactcactttgtagaccaggctggcctcgaactcagaaatccgcctgcctctgccttctgagtactgggattaaaagtgtgggccaccacgcctggctgaagtgtttgcttcttactccctcctggaaatgtgcttgctcctgacgaatggccatagccatttctttttgattggtctgcaaacttggaacagagtgtgcttgtctggaagggcaggcttggtaagaacatttcatcctacttgaggccttgaggatgcatggacatgcgggcctgcaggagtgcttagttgagtggaagatgccgatatgatacctctttcttggtaggccctggctggcaggcacagtgttaagggagacaagcttggcttgcagggaagtgggcagtgctcggtatgccacagcacgaggaaaaatgcccaggaaaatatccaggaattaaggattggttggtttctgaatctgaactggatcctaacctttaattctacgagacactggcctgagctgctggggctaagttactgtagccctgcaagtatggccaagatggtcttaggacacactttcccctcttttcctcaccttcccatgagtgtctcagataagtaggatttgaagcagtgctctgaggactcagccctgctgcttgctctgctttcattgcttccccagacagcaacttgattttcacttttttttttgccttggcatgcttgggcgtcctggtgattcctggtctggtcccttgcccaaggtatagatagacatttcacatcccctggttggtctttcagcttaaatattatttgtccttagacatatattcgtgtcacacagtgacaggattggtacgggcccaaatgggctgcaatggcctgttatgttagcacctgagctctgctgcatctaccatcacatattgtctgacccagactgcacgtgggagaggattctactgaaatgcatgaggtgtggaggatttctggcaaaattctaagcaactgttaatgacaagctgttgggaatcatacacactgtcaccttagccaccatagaagtcatacgtacagtgaagattacaggccagacatggaagttagcatccctgtaactcccatatttaggagatggaagcaggaggatcaggagttcaaggttgtcctcagtttcaaagtgttcaaggctacaacctgggctataagagattggtcctgtttcaaaaacaatctacataaaaatgtgttagtgaaaatactattttagaggaacatttacaagtaccagaataaggccaattctctttttttgcgggtgtgtgtgtgtgtgtgtgtgtgtgtgtgtgtgtgtgtgtgtgtgtttcgagacagggttttcgtatagccccggctgtcctggaactcactctgtagaccaggctggcctcgaactcagaaatctccctgcctctgcctcccgagtgctgggattaaaggcatgcgccaccaccgcccagcccaattctcttatttttaaactattttttatttttatcttatgcatcttggtgttttgcctgcatgtatgtctgtatgaaggtgttagatctttgatttgcaggtgtttgtgaactctatgggtgctgagaattgaacctgggtccccaggaagagaagccagtgcttttagatgcggagccatctaccccatcccaaagaaacaacaaaaacaaggaatttcagaaatgcaaaagatgagttttctcagactgttgaggtggaagtggcagaagatgcacacttcacagggtaactttgtggttttagatgtaagtttttcacttctattaagtatgttatggttttagatgtaaatctttcatattgtgcgtgggtgtgtatgtgttggtcttaaatagcatgccacatgggtggagcttaggaggcaactgcatagagtctgttctctccttgcatgtttacatgggctcttgggaaaactcaggtcatccgatgtgtgtgacaagcacctttacctgctgaggcatacagatccgtgtgcttaaacatgaacactggtaggttggtatttatgagccaagggttgcagctcagtggttgactgctttcctggcatgtgtgaggccaggttttcaatcctggcaccacaggaacatggtatggttcaaagggtattaatggtagttttcagttaaatcagtgagggttttttcttctacttgaaagatgaggcggtaaggtaaagttctggtgtaagtacatgggcccaaacccaactggcctgggttcagattgtaactcagctacttactgtacctatcccagccttaatttcctattaagaaataggggtgctgggtttggtggtgcacgccttaaacaccagctctagggaggcaggcaggtggatctcttaggtttaagtctagcctgatctatagagcaagctccaggatgagagctcacagaaaccctgtcttgaataaaaagaaaagggggggggggagaaaaagatgtgagcaccgatttaaggatgaggcaggctcttctagggactgagctgccttgacagcaaattttggaattattaggaaactaagttccaagcaataaatagataggcagtttagggtcctttccattgtttcccctttctcaaagttcaggctgaggttaagagaatggccatgaggatgggttggtactagcaccttacccacagtccagcaaagggtgctgtggatggggtggaatagattaaggtagacaattgcatccatggtttgccagatcagttgcgctctctctctctctctctctctctctctctctctctctctctctgtgtgtgtctctctctctctctctgtgtgtgtgtatgtgttaaagtgaaaggataccaatcaggctagattagggcccactttaacaaacccacaggtctctacgtttaataggattaaagacaagtgctaccatacctgttccataactacctaacaactttgtactcaggtctgaggcgctggtgtctagggcttttttaacatgataggtggtgggggaacaggcttctttctaggacaggaggagtggggtggggctggggtgtaagcccctgttgcccacagagtggaaagttcctagccttaatctttcatcagacacattgaagagaaaaaggcattatatggggagcaaagtggctcaggagtcaagaacttctggccaccttgaaccaagtttctacttgtgtagggacaggatttggggaagggtttgggaaagaatttcatggagggtccagggctgctttctgatgccctcctctgccaaaatgttttcagcaccttatgaatgagtggtgaattctgcactcactgtgtgccaagtagtacactagacacccacatattctacagtgcccactaccccccaaaattttttttaaaaatttatttttatttatatgagtatgctgtagctgtcttcagacacaccagaagagggcatcagatctcattacagatggttgtgaggcaccatgtggttgctgggaattgaactcggcctctggaagaagtcagtgcacttatccgctgagccatctctccagccccctaccccacaattctgagtaacatacaactgagtgacaggctgctctgactctgtgtatcagggcagtgatatacagtgtctcagccttctgaaggtgtgcagaggtccatgtagacctgccttggcactcagccatgttctggggacatgaatgggtggaggcctgggaagagcagcagcttactggaagcttcacctctgctttcctggaatgccagagcctgtgtgaagctgtttgtcactgaaaaggggtagtgtgttaacacagacctgggtgcagcaagggtcgggaacaggcgggtcctgttgaaagggcccagtatgccatgtatggagtatgccatgcatggactattagttctcgtggggagacttgtttttcctgatcctggacgtcttctgagacatccagagatttccaatatcctgggttagaagctccaaagtagcctcttacctatccttaacactatccttaacatctagccttgcctttagttttcttttttagtttttttttttttttcagcagcctctagcatagatctggctgtcactctttgtagacctaaatctagagacctgtctgcctcttactttctgagtgctgggattaaacgtgtaccctgtgccctttcaaacgacattttgttgaaagtggttcacctgactgtcaggggttttaggaggatggtgtccatgagagggcgacagagtaccaggtatagcccaatttggctccaatgctcttgggcagcctccccagggggcctcagcaacccagtggacccaggaactcaccacctgtatgtgatcacaagctttgccatacactggagtttactgacatactgctatttttctccactgtggacctaagaaaaaaggtattccccttatagaacaggaaactgaggcacagtgaggttaaagtttacagcacagaatgaagctggcattcaaacaaagggcacctgatctacaagtctgctggctacttgacatcttagcaatgtttgttaaaatttaacaacatagatgaacttggtttatatgcatacacaaatacacatgtgaagtaatgcatgaatggaaaaaaaaaaaaaaaaaaggcatgccttgcgtctttccaggtataccccggtccctggtttccctcttgagatgacttaatttcttgtatctcttgatatagactggtggaatcttagaactgggcacagtttctaaagcctgggcacctggccccaaatggatatagagcctagcccttgggttccagcattcaccacggacaagacctgtgtgatcattgcctctcttagccctttgattctctactcagggcatggtagggttacatcctctctagcagctgaagactgagctacgtctggttttcttttattcctcctttctccagggagtcctcatcttaggcacagctgatcccggaaaatccactttcttgcctcagaagaggagaattaagtattcagagagctatgggttactgtaggcggtctttcttccccatgaggttgccctggaagggagggtttttaattgatgagaaggttgtactgtctgggtgtgttttctgtctgggcagctcctctctgaggccatcataaaggaagcaggttgccctctgtcaggccccagctgtagtttgccctgttctttctctgtctgaatggaacattggttgttgggaaggctttgctaagtatcttgtctctgagctcagcacaggacaagccctgaatctcacctttccccaaaatccatagtcccttcatctgggcctgctgaagattacatgtttagtgatccagtgactagctctggccaatagctagttcacagcctgtaataattaacataccatttctttagcttctcatcagtcattccaggttagttcctaggaagggcaacatgaatggaatctgtcttcacccctacaaataagccttagttttatgtcactaaggcagtgggttctttgttactcatttaatcttatttatcctgactgataaaatattttggacttcctccctagcctgttagaacagttaaaaggcatgtttttaatgcaacagttccctgctctggtattctgcccaagaatgttttttgttttgttttgagacagggtttctctgtgtagccctggctgtcctggaactcactctgtagaccaggctggcctcgaactcagaaatccacctgcctctgcctccccagtgctgggattaaaggcgtgcgccaccatcgcccagccaaggatgggctttatttcacctggtacagcccctttccagggagagaatatggtatcgtccattcatgcttgcctgcattccccactgctcatcagtctatatcatagggctaattctacttacactgtgagagtttaggattaaatgtgtcaatgctgggcccagggcattttctctgaggtgtgtctcagtattactgaagcttttagttcattcatctgtatttgcctggctgccatgtgtgtcctggacacagaagatagagaacaaagcaggagagaaagatccagagagaatgtcagcattgccttgtgagtctaaggtaataaaactccatgaatgctctggctgtgggttcctggtggccctatactttgagatgcatccaaggggctggcagggagtgggggtggcaggctgcattatataagcctgcagcctgaaagccagggttctgttttgacagttctgttcacagcccccacatggacatgctccttagttgcagagctgagtggggaagggagcatcatgggagtctggaagcatcttatcccaagctcctatgctaaacctggcagttctctagcctggacccaggccatctgctcagtcccttgctcaagcccagcctgtctgacctcttttggctgactctgggagggcctagagagtagagaaaggactggcagggcttcctgaggagagagagagagagagcaaagtaagcataggaagtcaaacttgggagggaggggaggggacgggagggaaggactgctggggccgtgcctctagtgatggtcaacattcttgtttatgaaaaagggccctctgaagatgccattctgtggataactgggggcatgctcttggcattgtaagataaccctggccctgtagcagagcagacttggccctgtgtcagattgctgtcctgttacaaatagatgagtagcttgaaacagcagatattcattgcccttggttcctgggagttagctcagcacagcctagctgggacttttatctcttctgttatcaggctgcagtctctaggaaagttggattgaatgagaactttctcatctccctcacatggctcctggtacctagagagggtgtgccatttaatcagacatgtaatccccaggactagaaaatgaatggaaagcctttgggttcttgagtgattccacattgccttttggtgcccccattttagtggggggagagccctgcatcatttattctgcctctctctgtcttacctttccatggggcagatctatagaaatagagtaatgacagggaatggaataatggccaaccgaggcttcctgtgagctttcccaccaacactggcaggcctaaggagctgagggtatttttgtctggcccaccccatctgttttgcctgtccctttctctgaagtattgtgcctgcagctgtagcctgagatgccttttcttggctctggtctagatagctgcaaactggccataaaagtccctcctcccagtcactctactttgttgtgagtaagccactctttagatttaactaaaatctggcagtggaggggcacggtgaaagggatgaggaagagataagagagctggcaccaaggccctgttccctctctgcatttcaaacttgctggagtgtgcctcctctgtgcacacagtgagatctgaggctggctcagcagctgggtgagggagatgagaaatactcctcattcaatccagctttcctaggagactgcagtttaataaaagagagattccagctaggctgtgctgagccaatccccaggaaccaaggacagtgagtatttcaagctactgagacatttactatgcagccacagagacctcatacactcaatactgcctcctaagagccaactgtcctcccattcttctgcttcccactgccctgaggcctgagcaggactcacaaactcaagttcaaggcagcttaaggctgaggagctgaccttaaatgtcattttgccatttctgggttcattttttggaacaatctactaaaaagcaatgctctccctgatgcccagctccttatagtgtacaaagccttttcctcctattgttctagcttggtgttcctgaccactctgagaggcaccgaggacaggtcaagtagcagatgaacagtctgaggccccaagataagaaatgatgtgacagggaacctgtggtggggtccctatgatagctgcagggcagctatttgtgtgcagacaacatagccacacccctcacttaaggtgtctgcctggaaaactttactacttttccaagattcctgtgtagctagcatcctggatagcgtctaactcatacaatcaagatgctcatacacaggctaacctctaaatctgctgagattagcagggagagaagttcagggaacagagtattatgtggtcagtggtggggaacaggaataaccctggaggtgacttcccagtgccacaattttcctgtggcagttggagccactcagctctggcagtccaggtctgttgtgagctccgggccattgataccaaaagcataggcatttagcattttgctcagctagctagaatggatttagttgatgcattaatgctgattgaagtactctctccataaggtatagaacaaaatcactggaaatttcaagaagcaacctgaataaccccatcctttcatcccaggggagaaaaagaggtgttttgttcagcatcatctgtcaatatctgattgactctgattggatcattcatttctcttgtattagtcacaacttctagagagatgagccataacaatggactggttaagcctacatcgcttaaaattattgtgtccagacagggcaggacttgtctccagaagtgtaatgagaaatcctggggcacatgtaaggcattaacggacagtctctttgacatcatcatcccacaggaaggaatgactaatagacaccacagggttcattgctgtaactgagtctgaagacaagggactgtttcaggagctggtgtccctgtctatttgagagcatccctggtctccatggctgcactcaggcaggatgaagagctgctatctccacaccaaccatgctttgggtggagaggggaaacagacttagaaggaatgaggaacttgagatgtatggagaaagacaggagcttggtctaggcctccaaatgattgttgggacctgaatcccagcagtaccgggttgtgtaaaccagccagggcgtctgtctcagaacctcagtgtttagacctgcaggctgtggatgatgagggtgaactcagaagaccccagtggtcttcaggacagtggatgtaatgttcctatacttgtggttgacctaggcaggctcctggagacagaaggttgat

SEQ ID NO: 1302 - DNA, 2649 bp, Mus musculus
gagggaattgcgggaccccgtctggggaagctcccgccgccccggggtgctcagctctctgtctcccttgacccaggtacagtcatgtcgggcttcgacgacccgggcattttctacagcgacagcttcggtggcgaccccggtgcggaagagggccaggcccgcaagtcgcaactgcagaggcgattcaaggagttcctgagacagtaccgagtgggcaccgatcgcacgggcttcaccttcaagtacagagatgaactcaagcggcattacaacctgggtgaatactggatcgaggtggagatggaggacctggccagttttgacgaggaactggctgaccacttgcataaacagccggccgagcacttacagctgcttgaggaagctgccaaggaggtggcagatgaggtgacccggccccggccagctggagatgagctgctccaagacatccaggtcatgctcaagtcagatgccagcccgtcgagcattcggattctgaagtcagacatgatgtcacacctggtgaagatccctggcatcatcatttcagcctctgcagtccgtgccaaggctactcgtatctccattcagtgccgcagctgccacaacaccctcaccaatatcgccatgcccaggcctagagggctatgccttcccaggaagtgcaatatggatcaggctgggcgcccaaagtgcccactggatccatacttcatcatgcctgacaagtgcaagtgtgtggacttccagactctgaaactgcaggagctgcctgatgcagtccctcatggtgagatgcccaggcacatgcagctttattgtgacaggtacctgtgtgacaaggttgttcctgggaacagggtcaccatcatgggcatttattccatcaagaagtttggcttgaaccccagcaagggccgggacagggtaggtgtgggcatccggagctcgtacatccgagtgctgggcatccaggtggacacagatggctctggccgaagctttgctgggtctgtcagcccacaggaagaggaggaatttcgtcgcctggctgccctccccaacatatatgagctcatctccaagagcatttccccctccatctttgggggcatggatatgaagaaggccattgcctgcctgctttttgggggttcccggaagaggctcccagatggactcactcgccgaggtgatatcaacttgctgatgttgggagaccctggtacagccaagtctcagcttctgaagtttgtggagaagtgctctcccattggggtgtacacatctgggaaaggtagcagtgctgcaggcttgactgcctcagtgatacgggacccctcatctcgaaacttcatcatggaaggtggagccatggttctggccgatggtggggttgtctgtattgatgagtttgacaagatgcgggaagatgaccgtgttgcaatccatgaggctatggagcagcagaccatctccattgctaaagctgggatcactaccaccttgaactctcgctgctctgttctggctgcagccaactcagtgtttggccgatgggatgagacaaaaggggaggacaatattgacttcatgcctaccatcttgtcccgatttgatatgatcttcatcgtcaaagatgagcacaatgaggagagggacatgatgctagccaaacatgtgatgactctgcatgtgagtgcactgacacagacacaggctgtggagggtgagatcgacctggccaagatgaagaagttcattgcctactgccgagcgaggtgtggacctcggctatcagcagaggcagcagagaagctgaagaaccgctacatcatcatgcggagtggggctcgtcagcatgagagggacagtgaccggcgttccagcatccccatcactgtgcggcagctggaggctattgtgcgcattgctgaggccctcagtaagatgaaactgcagccctttgccactgaggctgatgtagaggaggcattgagactgttccaggtgtccacactggatgctgctttgtctggcaatctgtcgggggtggagggcttcactacccaggaggaccaggagatgctgagccgcattgagaagcaactcaagcgccgttttgccattggctctcaggtgtctgaacacagcattgtccaggacttcaccaaacagaaatatccagagcacgctatccgaaaggtgctgcagctcatgctacgcaggggtgagatccaacaccgtatgcagcgcaaggtgctctatcgcctcaagtgagcccattgcccatcaaccctcaagcctgaaatgctgccaccaccctatctcccagtcagtgctccaaacctccttttgccctgcctctccacctcagactgctgtctgcagcacatctgcagcccctggaaatgtactttggtctgttggctcatactgtgtttgagtgtctgaggactctctgctctgggtgtctatcccctgtcatgccttctcaacaagatgagtctggagcaggaacaggccctggaatgtagatgggtctgtatattggctcccgggccactcactgccaagcttctttgtatgtacagaggtaataaagcaattgagtccctggctgctaaggtcagtggacccagt

SEQ ID NO: 1303 - DNA, 2202 bp, Mus musculus
atgtcgggcttcgacgacccgggcattttctacagcgacagcttcggtggcgaccccggtgcggaagagggccaggcccgcaagtcgcaactgcagaggcgattcaaggagttcctgagacagtaccgagtgggcaccgatcgcacgggcttcaccttcaagtacagagatgaactcaagcggcattacaacctgggtgaatactggatcgaggtggagatggaggacctggccagttttgacgaggaactggctgaccacttgcataaacagccggccgagcacttacagctgcttgaggaagctgccaaggaggtggcagatgaggtgacccggccccggccagctggagatgagctgctccaagacatccaggtcatgctcaagtcagatgccagcccgtcgagcattcggattctgaagtcagacatgatgtcacacctggtgaagatccctggcatcatcatttcagcctctgcagtccgtgccaaggctactcgtatctccattcagtgccgcagctgccacaacaccctcaccaatatcgccatgcccaggcctagagggctatgccttcccaggaagtgcaatatggatcaggctgggcgcccaaagtgcccactggatccatacttcatcatgcctgacaagtgcaagtgtgtggacttccagactctgaaactgcaggagctgcctgatgcagtccctcatggtgagatgcccaggcacatgcagctttattgtgacaggtacctgtgtgacaaggttgttcctgggaacagggtcaccatcatgggcatttattccatcaagaagtttggcttgaaccccagcaagggccgggacagggtaggtgtgggcatccggagctcgtacatccgagtgctgggcatccaggtggacacagatggctctggccgaagctttgctgggtctgtcagcccacaggaagaggaggaatttcgtcgcctggctgccctccccaacatatatgagctcatctccaagagcatttccccctccatctttgggggcatggatatgaagaaggccattgcctgcctgctttttgggggttcccggaagaggctcccagatggactcactcgccgaggtgatatcaacttgctgatgttgggagaccctggtacagccaagtctcagcttctgaagtttgtggagaagtgctctcccattggggtgtacacatctgggaaaggtagcagtgctgcaggcttgactgcctcagtgatacgggacccctcatctcgaaacttcatcatggaaggtggagccatggttctggccgatggtggggttgtctgtattgatgagtttgacaagatgcgggaagatgaccgtgttgcaatccatgaggctatggagcagcagaccatctccattgctaaagctgggatcactaccaccttgaactctcgctgctctgttctggctgcagccaactcagtgtttggccgatgggatgagacaaaaggggaggacaatattgacttcatgcctaccatcttgtcccgatttgatatgatcttcatcgtcaaagatgagcacaatgaggagagggacatgatgctagccaaacatgtgatgactctgcatgtgagtgcactgacacagacacaggctgtggagggtgagatcgacctggccaagatgaagaagttcattgcctactgccgagcgaggtgtggacctcggctatcagcagaggcagcagagaagctgaagaaccgctacatcatcatgcggagtggggctcgtcagcatgagagggacagtgaccggcgttccagcatccccatcactgtgcggcagctggaggctattgtgcgcattgctgaggccctcagtaagatgaaactgcagccctttgccactgaggctgatgtagaggaggcattgagactgttccaggtgtccacactggatgctgctttgtctggcaatctgtcgggggtggagggcttcactacccaggaggaccaggagatgctgagccgcattgagaagcaactcaagcgccgttttgccattggctctcaggtgtctgaacacagcattgtccaggacttcaccaaacagaaatatccagagcacgctatccgaaaggtgctgcagctcatgctacgcaggggtgagatccaacaccgtatgcagcgcaaggtgctctatcgcctcaagtga

SEQ ID NO: 1304 - DNA, 44366 bp, Homo sapiens
gccagtcttgaacacctgacttcaagcaatcctcttgcctctgcctccccacatgctgcagttacaggcgcgagccaccatgccagcctgaatgtttgttgttgttgttgtttgagatggagtctcacccaggctggagtgcagtggcgcgatctcagctcactgcaacctctgcctcccgggttcaagcaattatcctgcctcagccccccgagtagctgggattacaggcgcccaccaccatgcctggctaattttttttttgtatgtttagtagagatggggtttcaccatgttggccaggctggtctcgaactcctgacctcaggtgatccgcccaccttggcctcccaaagtgctgagattacaggcgtgagtcactgtgcccggccacctgcgtgtttttgtatgagaagtggagtgcaggcaaaaggacctggggtcaaccttcagcgtgtggctctgggcaagccatgagacttctccctacctcagtttccccacccgtaaaatccagtgaggttcagctacttctagcttattggctcagaagtgcacaagaacccctcagaaatcatgggaaactcctgcctccttaatttagactcctttttaggcctttggtcccctgatgtgggccagggagttggggacctgtatccagctatgaacccaccacaggaagatgtcccttctgagtcttgttgtgtgtgagcccctccctcatgtgcctaagaacgatcaaggctggctgtactgaaacatcttggaaacttccaaaaagaccaaagtgctccacaaaatgtaccctcactaagcctaaaacactgagggagggagtgtggctttgggatgggtagcaataaagaggtaaggcttagctacctcctggcaggttatattaggcctcccctcctgtgccaccctaacctacctggcttgtggctttctcacttgtgccagaccacacggacccctctgctaggggtttgtaaccccggagggcttggctatttggtggggtagggagacgtcaccctaatgaagcagttctcaaagtgtggtaccctggctgtgggaggtggtaatcctagtatcccctcaacggggtctgtgaggacaaagcatttttataacactactactatttttttggttttttttttttcgtttgagacagtcttgctgtcacccaggctggagtgcagtggcatgatctcggctcactgcaagctccgcctcccaggttcacgccattctcctgcctcagcctcccgagtagctgggactacaggtgcccgccaccatgcctggctaattttttgtatttttagtagagacggggtttcactgtgttagccaggatggtctcgatctcctgaccttgtgatccgcccgcctcggcctcccaaagtgctgtaattacaggtgtgagccaccgcgcccggcctttttttttttttttttttttttttttgagacagggtctcgctctttcacccagtctggagtgtagtggcacaatcacagctcactgcagcttcaacctcccaggttcaagggattctcccacctcagcctcctgagtaactgggactataggcacgtgccaccacacccagattttttttttttttggctttttttaaaaaagccaaaaataaatgagaaaattagagtttcactttctcatgaatgtgtgttggcattttccaaaggttatgtgacatgtgatgctctctcatggatttgatggctcatggaatgtgtgcctgtatgttcttgtatgttaagaatttctcagttttggccgggcacgatggctcatgcctgtaatcccagcactttgggaggctgaggcacggggatcacttgaggtaaggagtttgagaccaacctggccaatgtggtgagaccccatctctactaaaatataaaaattagctgggtgtgatggtgcacacctgtaatcccagctactcgggaggctgaggcaggagaatctcctaagtccgggaggcagaggttgcagtgagccgagattgcaccactgtactccatcctgggcgacagcgagactccatctcaaaaaaaaaaaaaaaagaaagaaaagaaaagaaaaagaatttctcagttttaatatctaattttgtaaatagtgatagctatactcacacaaacaaaagctcttttggatccttggttgcatttgagtataaaggagttttggaaccaaaacatttgagaactgcacccctaatgcatcagaaggagcaggagcctttaatatgaacaacacacatgtaaatgtcacagtgtacctgcttgcttgcttgcttgcttgtacttcctgtgaccgcagccctgggccaccagacctaaggccctgttttctctggggaagcccttctcatagcccagggcggggctaggattgaaacccagctggtctggctccagagacctgccctggactctgtcctgcttctaaagacctagggagcacccactctgtgcctgaggaggcaggtggcacatctacccaggttgcatggttggctctggcctatcatgttttaaatcttttttttttttttttttgaaatggagtctcactctgttgcccaggctggagtacagtggcgcaatcttggctcactgcaacctctgcctcctgggttcaagcaattctctgcctcagcctcccgagtagctgggattactggcactcgcaaccatacccggctaattttttgtatttttagtagagacggggtttcaccatattggccaggctggtcttgaactcctgacctcgtgatccacctgccttggcctcccaaagtgctgggattacaggcgtgagccactgcgcccggccctatcacattttaataaccagggatgggactgaacttgaattttgacctcagagctcctgctttctagctcctgccccatcatcaccatgcttagcaaacgtgtgagtttgagaggaagatttacagctcagacctaattgctggcaaagtttaaggagaggacagggagcaggcagaagtctgaaaaccacgcctgggcccaagaatgttttcacaatgtggcctggctgcacagggaagaacagacagcttggagaagtagtgagctgcccgtctttgaaggtattcaagcagtggctagagggacacctgtctgtggtcttgcagaatcctggcgttgggcagtgactgtaccacagaccctgaggccgctctgctttgctttcctatgacatcagacaccctgatgcacgcccacctgttaatgaccttgccccattttctctttcagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaagtagttttcatgggctttgttattcttggggaactgaccttttcctccctggtttcttgcgtgctcggtaggagaagtggtgatagggggttggcaggagctggtctgtttgagaatacagaaggtgagcttttcttttctttttttttttttttgagatggagtctcactctgtcacccaggctggagtgcagtggcgtgatcttggttcactgcaagctccacctcccaggttcaatcaattctcctgcctcagcctcctgagtagctgggattacagaagttcatcaccatgcccagctaatttttgtatttttagtagagatggggtttccccatgttggccaggctggtctcgaactcccgacctcagctggtccacctgcctcagcttcccaaggtgctgggattacaggcgtgagccaccgtgcctggcccaggaggtgagctttaagtagctggtgggcgaatatttgtgttgaaccctgcttgatgcaattctcgactttatggaagatggggttgccctgtttggtggaaatgagcagattctggggcaaaatttgtattttctgtccagtgactattagggactggagtgaaattcttaggttcaaattcctgctacaccactttgaggttagtcacttaacctctctgaggctccattttatcactggtgacatgaatatagtgatacctaactcacctatgtgtcctgagaagcaaacaagatgcaagtgaaatgccaacgccatacacagttagcacctattatgcaaagaaggagaccagtgttttgtgattcttgtactgtcgagtcacctcatctatgtcatccctgtgttgagggggtgtttccactatctgagggtcaggatggatttcactgaggtctgtccagctctaaaacccaagccctttctatggccctaagtcaagaaaatactaaatatgtagcctcccaatctgggaaagtgaaaaaccttttgctgaaagtgtcctgggcagagcatgggacaagattttttttttttttttttttttttttttgagacagggtctggctttgtcctccacactggagtgcagtggtgtgatcttggctcactgcaacctccacctcttgggcttaagccatcctctggcctcagcctcctgagtagctgcggctacaagtgcacaccaccatgcccagttaatttttgtattttttttttagagatggggtttcgctatgttgcccaggctggtctcaaactcttgaactaaagtgatcctcccaccttggcttcacaaagtgctgggattacaggcgtgagtcactgtgcctggccaaggtgtatttttttttttttttttttttttgagatggagtctcattctgttgcccaggctggagtgcagtggtgcgatttcagctcgctgcatcctctgctgcccaggttcaagcaattctcctgcctcagcctcccaagtagctgggattataagcacatgacaccgcactcggctaatttttttagttttagtagagacagggttttaccatgttggccaggctggtcttgaactcctgacctcgtgatccacctgcctcggcctcccaaagtgctgggattacaggtgtgagccactgtgcccagccaaggtgtttctttataggaccagtacctaaggactggaagtcaggagacctttgtcactagtctgactatgccacttcaaggctcattttgttcactggtaaaatgagaacaatacacatacctctcacagctggtgggaggatccagtggtgtccaaacaccagtctgtgcatggtggcatcagaattacttggagatacttaaccacagaatccagggctccacctgggatggggctctagaatttttttttttttttttttttttttgagacggagtcttgctctgtcacccaggctggagtgcagtggcgcgatcttgactcactggaagctccgcctcccgggttcacgctattctcctgcctcagcctcctgagtagctgggactataggcacccaccaccatgcccggctaattttttgtatttttagtggagacggaggtcacaggtttcaccgtgttagccaggatggtctcgatctcctgacctcgtgatccgcccgccttggactcccaaagtgctgggattacaggcgcgagccaccgcacccagcctagaatcagtatttttgaaaagtaccttaggagagtccaacgcgcacccaggtccaggagcacgtatggtcacgtatgcaaagcataggcattcaaatagcagctggagctgggcacggtggctcacgactataatcccaacacttttgggaggctgagacaggcggatttcttgaggccaggagtttgagaccagcccggccaacacagtgaaaacctgcctctactaaaaccacaaaattagctggaagtggtggcgcatgcctgtaatcccagctactccgggggctgaggcaggagaatcacttgaatccgggaggctgaggttgcagtgagccgagatcgcaccaatgcactccagccttagcaacagagcaagactctgtctcaaaaaaacaaaacaaaaacccaatagcagctgggactctcctgccctgggcccagtttcctcatttgtgaaaggggaatagatattcattgtactgacaaagaaaggaaggaagaggggaggggagagagagaaactatcttgaattttactaataggagaatggctgaacaattttttcctatcaattgtcgaacaaagccagacactagttaaagtggtaaggacgaccgggcacggtggctcatgcctgtaatcccagcactttgggaggccgaggagggcagatcatgaggtcaggagtttgagactggcctgaccaacatggtgaaactctgtctctactaaaaatacaaaaattaaccgggcatggtggcgcgtgcctgtaatcccagctaccaggaggctgaggcaggagaactgcttgaacttgggaaacggaggttgcagtgagctgaaattatgccactgcactccagcctgggtgataaagcgagaatccgtctcaaaaaaaaaaagtggtaaggacagattttaatcagtaatgattattgcaacagggaagagagttcagtatgaactgaactcagctttaatttgtatagaggtattttaaagggaggttgaccagcctgggcaatatggtaaaaccccatctctacaaatgaataaataaattcgccgggcatggtggtgaggttgaggtgggaggattgcacgagcctgggaggtcaaggctgcagtgagctgtgattgcaccaccgcactctagcattggcaacagagaccctgtctcaaaaaaataaataaaaaaaataaaggaagattgagggaggaaggggtgggcaagtgattagtagagtcagggaagtgaaatattacaaaaggttaagtcagtgtaaatgcagtgaggctagctgtgtctgccagttggcaatgatcaaagttagaatttttgcctcccacagagcctgggagacagaggtcacatcctcggttgttgcctggaataaacggtaaacatttaccagcagccttgagttttctcaggcaggcaccttagcgggggctggctagagtcattttagagatgttagcagctgttagaaactgttagtgtttgtttaagtctttttttcttttctttttttttttttttgagattaagtttcactcttgtcgcccagactggagtgtagtggcacgatctcggctcactgcaacctccgcctcccaggttcaagcgattctcctgcctcaggcttccaagtagctgggattacaagcgcctgccaccacgcccggctaagttttgtatttttagtagacacagggtttcaccatgttggccaggctggtcttgaactcccgcctcagcctcccaaaatgctgggattacaggtgtgagccacggcgcctggactgtcttttttttctttttagagatgagtctcgctctgtcgctcaggctgaagtgcagtggtgcaatcaaaactcactgcagtctcaaactcctgggctcaggccatcctcccaccttggcctcttgagtagctaggacaacaggtgtgctccaccatgcccagctaattaaaaaaaaatttcaagccgggcgcagtggctcatgcctgtaatcccagcatcttggaaggctcaggcgggtggatcacctgaggtcaggagttcaaggctggccaacatggtgaaaccctgtctctactaaaaatacaaaaaattagccaggcgtggtggcacacacctgtaattccagctacttgggaagctgaggcaggagaattgcttgaacccaggaggtggaagttgcagtgagccgagatcgtgacactgcactccagcctgggcaacagagtgagactctgtctcaaaacaaaaaaaattataaaaaaatttctagagaagcgggatcttgctatgttgcccaggctggcctcaactcctggactcaagggatcctctcatcttggtctcctgaagtgctaggattacaggcatgagccacagtgcctatagatcaaggttgaggcttagaagtgaagggagcccagaggaacctggctagagtttggtcaaggagagtctttgtcaccatactacagaaaattaagcagctgttaaacagaatgaggccggtctgggcatggtggctcacgcctgtaattccagcactttgggaggccgaagcgagtggatcacttgaggccagaagttcgagaccagtgtgggcaacatggtgaaaccctgtctccactaaaaatacaaaaattagctgagcatggtggcgcctgcctgtagtcccagctagttgggaggctgaggcaggagaatcgcttgaaccggggaggcagaagttgcagtgagccgagattgagccactgcactccatcctgggggacagagtgagactccctctcaacaaataaataaacaaataaaagcagtgtgttagggtgcgagaacccgggtcggggacgcgggtgagccgcgcggtaatcgccctgtcctgccaccagctggaggacaggggctcctcagagcctcaggcccagagaacgggccccacgaccgggaagcgaatactccacagggcacagtctcccaatgcaaaatgggcacctggacccaatcatttctgaacttctagttttttctccctatggctatgaaaagggtcattttttttcataggactttaaaagaaggcttaagaaaagcacgcaggcctggccgggtagctcacgccagtaatcccagtgctttgggacgtcaaggcaggcgggtcgcttgagagtagagtttcgagacctgggcaagatggtgagactccgtctttatgaaatattttaagaaaatcacgtacacctgtggtccccgctacaagggaggctgaggcggaaggattgcttgagcccaagaggttgaggctacagtaagccgtgatccagccactgcactccatccccggcaacacaacgagaccatgcgtcaggaaaaaaaaaaaaaaaccaagaaaataaaaaagaaaccacctaaaggcgtcctccgcgcgcccgcccctccgccatctttgcgtccgccccgtcctgcgccgccacttccttcccagccagaagtttcgcgccaaattgttccgcacacaaaatggagcccggaaggaggcgaggtcatgcactttgcagccaatcatcttcggcagacagtccgggcggcggggctggagggctcagaacggtccaatcgctggccgcgaggctccggcgaaccaatgggagcgcagcggctgcggcgtccgaacaccgcctcttgtttttcccgcgaaactcggcggctgagcgtggaggttcttgtctcccctggtttgtgaagtgcggaaaaccagaggtgaggctagtgggagtgggactgggactgggagccagcaggcatctggatttccgggtgtagttggagtgggacaggagtttctcgggaactggggttggagtccgggagcgcggccgggggtccccctgctccggactcagggcagggacccaggcgtcggaggggaggaggtgccaggcgctgcccccagcctgttctggccgtttgttcccaccccaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacaggtgcggctcctgcggggccgggggctcgagttccagtgtggccgctcacacgcctctaccagcctgctagagtcctggacagtcagggcacagatgggcccagacgggggaaagagccggtcctgggtcacagggctcatcccggcagcctcacgccttggtataaggctttgtgtattttgttttactttattttattttattttattattaacgtatttgtttattattttgagacggagtctcgctctgtcgccaggctggagtgcagtggcacgatctcggctcactgcaacctccgcttcccgggttcaagcgattcttgtgcctcagcctcccgagtaggtgggactacccccgccatcaccacgcccggataattttttgtaattttagtagagatggggtttcgccatgttcgccaggctgctctcgaactcctgacctcaagtgatccacccgcctcagtctcccaaagtgctgggattacaggcgtgagccaccgtgcccggcctgctttgtgtattttatctgtacctggagttaacttctgggtgagtcacctgttgagtgggccaccagcaaccagctagcgccacttggaccgtttagttctttatccagatcttgttcctgttcatctgcttcctatcatccttccatgtcatgtctgagaccttacaaactcaagttccctgtaggtgtaaaaggtgaagatggcagttaggattcacttcacttcgctcattcatttatttataccagtcttgcaccttcattgattgagcacctgctgcctgccagatactgttctgggtgctgggctgcagcactgaagctggacctggctcctgcttctaggtgattgtacgacctgtgacatcatgagaattctcataggcccggcctctatccctgaaatgttaaaatgcagagaacatgaggttgcaggttcagcactggcccattattagctgagtgacttccaggtgtcagtgtctctgggcctcaccaggccagaaatgggtaaagccattcctgctttcacttactcatgcagcagctgatattgcccacctgtgtgccaggcactgcgctacaaagatgaaaagacgtgcttcttgtcctagagaagctcctaagtcagaggagtgagtcgtgaagaccaacagataacttccacggtggtcatttcctccacagaggaaggtgaaaggacttagggaagttttccggggggctgaagtttgaggggacctttgagctaaggtcagagttgcaggtgtagaaagctttctgtctaggtaggagcaattgcttgtgtagaggtgtggggtgtcctcacagcaagtggctttcagtagcagtctggccattttactggctcctggacataagggagacggggctcaggcctgtgatactgcgaggctggggaacagcctgtgcgttggtcagtggtccccaaatatgttcttgccacagcagtcacatgggatgctctgctaagcatctgggctggacgcagtggctcatgcttgtaattccgacgctttgggaggctgatgccaatggatcatttgaccccaggagttcaagacctggctgggcaacatagtgaaacccaggctctatttaaaaaaaaacagtctgactagaggttgataaggcagatgtgttttctgctgccttggtgcctccagtttttttgttgttttgttttttgtttttttttttttgagatggagtctcgctctgtcacccaggtttgagtacagtggcgtgatcttggctcactgcaactgctgcctgccgggttcaagtgattctcctgcctcagtcccccaagtagctaggattacaggcatccgccaccacacccggctaggtttttttttttgtatttttagtagagatggggtttctccatgttggtgaggctggtacctttttggtttttttttttgagacagagtctcagtctgtcgcccaggctggagtgccctggcgagatctctggtcactgcagcctccacctctggggttcaggcattctcatgcctcagtagctgggactacaggcgtatgctaccatgcccggctaatcttcgtatttttagtagagactgggtgttgccatgtggcccaggctggtgttgaactcctggcctcaagtaatccaccctcctcagcttcctaaagtgttgggattacaggcatgagccacctcactgggccccaagtttgagctgtgtgcattgttcttttccaagagaagttaaaggctctgcggagtccttcagtgacagaactggtttgttgttttgtgcacgctggcctgggtgttgaaacatcctttgactgtcttgtggaccccttccatggagctttctttagggcatgcctgtgccagcagtgagtagcctctgcagggttaaataatggaatgatctggaattagatgtgtgtttgggaagaggaatggtgaggtcatggtggctgtggtgtgggcagattcaggggtgcaggcacacctcagccagtgttggtttcctcttctttgcacccttcctgccccaccctgctatgtgcccactccagggatgaactcaagcggcattacaacctgggggagtactggattgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagaccctggctctccaaaaaacaaaacaaaaaaaaaaacaaaaaaaacaaagctaggtatgctggcatatgcctatagtccaggctacttggaaggctgaagtgggaggatcaaggggcctaggaatttgaggttacagtgagctctgattgtgcctctcagcactttagcctgggtgacagagcaagaccctgtctctaaaaataaaaaataaattacagacatgacactttatcccgaaaaaaaaaagttttcttacatagtctcattagcacctcaactgaaacatcaaagatctcttagtatcattgaatatacagtctagattcagattgaccaaattacctcacatgactcttacagctcgtgtgtctcagccaggaccaggcattgtactggattgttgtttaaatctcttttaatccaggacagcttcctttactctgggtgtaagttctttcacagatacattattgatttgctaaagaagcaggagccattatcctgtagaatgtgctgccttttagatttatctgaaggcctccttggggtggttacaacataccccttcccccccgtgatttttggaagctggaagttagatgcaaaggcctgactgtgtttcgatttcacataccgggcaagaacgcttatgggtggtattggatccctcattgcatccctccatccactatgctgagactgaccaggtgctaggttgaggtggtgatggtcactttattgtaatgatgcaggcatggagtcttgaattccgcctccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattatggataattcaaacattagaatataaagagaatcgtataacgaatcctcttgtactcatcacccagcttaataattagcaactagaggccaatttttttttttttttttttttgagatggagtttttgctcttgttgcccaggctggagtgcagtggcacgatctcagctcactgcaacttccgcctcatgggttcaagtgattctcctgcctcagccccccaagtggttggaattacaggcacacaccaccacgcccggctaatttttagtagagatggggtttcaccatgttggccaggctggtctcgaactcctgacctcaggtgatccatagatgccaaatcttgtttcatctgtggccctggagttcttttgaaacaagtcccatacatcatataatttgatctggaactatttctccatgtatctctaaaagatgaatctctttttttttgagacggagtttgactctgtcgcccaggatggagtgcagtggcatgatctcagctcactgtaacccctgcttccccggttcaagcaattctccggcctcagcctcccgagtagctgggattacaggcatatgccatcacacctggctaatttttgtatttttagtagagacggggattcaccatgttggccaggctggtctcgaactcccgatctcaagtgatccgtccgcctcggccttccaaagtgtcggtattacaggcgtgatccactgcacccagcctttgaagagtcatttttaaaggcatagctacaataacatcacacttaaaaattaacattacggccgggcgcggtggctcatgcctgtaatcccagcattttgggaggccgaggccagtgaattgcctgaggtcaagagttcgagaccagcctggccaacatagtgaaaccccgtctctactaaaaatacaaaaagttagctggacatggtggcagttacctgtaatcccagctacttgggaggctgaggcaggagaatcgcttgaacccgggaggcggaggttgcagtaagccgagatcctgccattgcactccagccttggcgacacagcaagactctgtctcaaaaaaaaaaaaagaaaaaagaaaaaatattactgccttattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcgtcctggctccccttaaccaacaagcttcccgatggctctattacagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacgtgagtctgtggcccagagggactgtgggaggtgacctgagtgaagatcagaaaggatgagaacaagtagcaagcactgcctgcagctgcttctagagatccactgggatgggctgggcaggggtgtgcccttaggattggcacagatctgatgccctgtggctctgagacaccatgaacagggtccctctacattggtgacttctgtctcaccaggatacccagacagcgttgtagggaacccagggttgggagggaaaagcagtccagggtaatgagtctacttggaatcttctgaagcaaactatggtttgctcactaggccagatctagcctgctgaccctatggcccaggaacacgttcgttcatttaagtattgcccacagctggtttcgcactacaaaggcagggtatgtggcctcttggctggcagaacctggaatgcacatcctccggccctttctagaaaatgtttgctgcccccagtctgaaggaaccccaccctcttcactggctgctctttcttggctccttcgctggtgcctcctcagcttcccatccacctgtggcacagctgcctcattccatgctgttgacatctctcacttggagaggcacgctacctcctccctgatcccccgcgtccaccctccaccccctcagtctgttttccacccagcagccaggtgtcccttgacactcaggtggtccagtcatttacttcttagtcaagtcctgcacagcccaccacgatctgctcctggcttccccaggcctcgctgcccctcctctctccaggcccggcctcactgcctccttcctgtttctggaatacactgactacccccagtctcactgcctttgaccttgctgtttcctctactgggagtgctgttcctcaagctaccatagtctgtgtcctcacttcttcaggcttctcttcacatgtccccttaccaggggcatcttgcccaacccttcatcttcagtttggtgtgcatgtacctcgtctctcccacacctgcctacttttttacttttcttcacagcatgtagctgtcactctttaatatgattgtttgcttgtatgtcttttcagcctcccttgataggaacttaggctccacaagagcagggacctttttgttcagtgctgtgccccctgcacctggaatagtgtcagacacatagtaggttttgctatgatgtttacttctttatgttgctataatatctattgaataatgacataattacctagggatacgtagaggcttagaccctcagaatggtctagaactgcctagaatcccactggaaaagatcttgggatttgagtggggctttagtaagagaattgatgaactagctcttcacccatgaggacaccatgatcctgcaagaagaccgagtgtgacctgtctgcctcctctcagcaagttaatggaaggacccagcctcaagcagttcccttgactcttaatccagtgctaggtccgtcagtgttgccttcctttcttacctccaggcagcgttgcctgcctggcttatctccagcttattctggagacccccataaattgccgctggcaacgtctccttgctggctcctgggatgaatgagccctgcctttggattctccaggtagctttggtgactcttttcccttaccttgtacagagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtgaggcagacgggctgggaggtgggcatctacgacggtggatgtcccagctgtggccctaacccgagtgttgggagtgggtcatctggagcagggtgagtagggtggagaaggtggccagttgcagagcacctgctctgtgcctaatgcttccataagttcctctcatctcgtctttccataatctgcaggggcatgtcagccccattttgcagatgaggaaatgtaacttggagagattaaatgacttcctgtgtggaggagagccgggctttcagcctatgtgcattgctttccaaagtctgtgttcttcttaggataagaggcccaggatgcacagctagataaccaatagctggcaaagcctcttcccagcctgacaccccacctcctaccccaggctttcttttttttttgagacggagtctggctctgtagcccaggctggagtgcagtggcgcgatctcggctcactgcaagctccacctcctgggttaatgccattctccggcctcagcctcccgagtagctgggactacaggcgccctccaccatgcccagctaattttttgtattttttagtagagatgaggtttcaccttgttagccaggatggtctcgatctcctgacctcatgatccgcccgccttggcctcccagagtgcggggattacaggcgtgagctactgcgcccagcgtaccccaggctttctgttaagatcctgctgaacagccacggtggctcatgcctgtaatcccagcacttggagcggctgagacaggaggattgcttgaggccaggagttcaagaccagcctgggcaacatactgagaccctgtatctaaaaaaaaaaaatttattagctgggtgttggggcagacacctataatcccagctacttgggaggctgaggtgggagaatcacttgaccccagaaggttgaggttgcagtgagctgtgattacaccactccactctagcctgggtgacagagcgagaccctgtctcaaaaaggaaaacaaaaaagattctactgagggggagagggtactgagcttgggcccctcatagtaacctgggtggaaggttttgagatctttgattagggttctaacctgggcttgcatatcctgaaattgcatgcagatgttctgaggagagcggatctgtagcttctgttaacttcattagtggcaacagagtatgtaggggtcaggctcttgctccctgggcaagttatgtgactttgtcaagcttcagtttcctcatcagtaaaatggggataaggacagtccttaatctctcagagggctgcttgaaaatgcatgtggtgtttagcacaattccttcatgcagattacgtaatcaggatgtatgattttccaagcagttcatgaatcctgaaaacttacgaagtgggtatgggaagaggggagttggaggctcatggagtgacggtgatggtcttttctggagctgtgatgcctgatggtataaagcacttctatgtctgctgcctcacctgactccacaacatgagaggcaggccacttcgtcatccccctaggctcagaggtgcaatgacttcgttgaggtcacacagcgactaagtgtccctccacaccaccctgtctctgactgggggacttggagacttccctgtttcaacatctcattttgaaaacaggaaatgaaaacccagaggcaaaatgagctcacagagccatgaagaggcaaaaagggcgagtggcccctcaaggaggctggggggcgtgaagaggaagtcttgccctgagaggctaaagggcaccacacagcgagctgacagcagacacgtggagatggggcttttggagggctctgtgggctggcactaagcctcctaaaccagcgtacaaatgagttagcgagttcagcgagagtcaggccaccacctgcctttctgtttggctgtcactgtgggcaacaccatcctccaagcagctgagcatgggctgagtgacgtggggagagaggccgttctctgggctccgtggggctggagccagctcagcatgtggtgcctgtggcaaaaatgctgcagtggaccctgcgtgtcctgggcatgggtggaatcagagacttgctgtccaagtcagaatctcagcttttctcctttctcctctaccctcctctcaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggtgagttggctttggggtcctggcttagccctgctaaaaggctgtgcttgcatacttctggtaacaggcagctcgttacttcatgaggtagcccaggatgtccttgtgttgctcatatcattagaacgttcatttttatattaagtgatccctggaacttccacacattggtcctagctgtggctcctgggctgagggtgtttgcctaagtgcaggattaaggcagaaggactgaggtcaaatcactggggaattactgaaagccaagtcttcacttctgtgacaggaaatacaagagaagtgaaacgcagggttccaggcaggcagccgcctagtgtctagttggagaaataagaaaactgtgagaccgctggggacatgtgggtaaagtggtggctgttgtgggtcacgcagttccaaggaggtgctaaaggaggtctgagaaggaggaggtcggggctgggccttggggaaggttttctgggaggaggttaatctgagctgggctttgaagagtggtggatgtggaagaacttccaggcgggaggggatggcaggagcaggtgaagaccccggcctgggcaaggtactgagtggctggagggccgagtgggagtctaggggatgaggggccaggtggtgtaagaggccttgagtgccgagatggggagctcctgcttacacctgagggcagcaggggccactgagggttttcaggtttgtttcagccctctggctgcagtgaattgattcagaggggtggcttccccagggctcagtccatggcccaccccacatttacacaaactacctagattattacaactttaaaaccactgacaggtaagtagctctcacatttccatttctagcctgggcttctccccacgttccagactttaataaccaactgctgatttgacatgttcacttacatatctgaaaggcatctcgaactttacatggctgaagctaagctcccctttccccaccctcagactggctcctctcagtcttcccatcttcaccctttcagttgctcagacaaaaacccccaagtcacccttggtgctcttttctctcatcccccacatctaatcactcaggaactctggccagctccacctttaaaacgtgtccaggatctgaccacttctcatcctccccacctgctctgagcccttgtcagccctccctggatcaccgttgatcctccccagtgttcgtctccaccttgccctaccttctctgttctgcagcagccagtgagcgatgctgtcatgaccaagacactatatcactcctcggctgaaaggggagaccttccagtggtttccaaggtcctatgccatctggccctctgtttgctcagaacccttctccccacttcccctcaccctttggaccctggaacacaccaggcccattcctgagggcttgagagctgggatctctgtttactcagataggttgtgctgtcctggccctaagggccctaagggctctgccttctgggaggtccctgagctggtgccaggatgggcagtgggctggaagagctcccttgtactcactcatgcgcctgctttgcctaccaaggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggtaggggcttgagttcccttgggtttggggaggcggctgatgatggggctcacagtaggataattactggataatcaggactgggcactcttttttgtatttcctgggcccctcagtctgccaggcacctttgccagcccccaagcttgccatcagctggctagtggctgatctgcgcacctgtctcagcgatgccctgaccctggcaagggggagactgggggcctggcaagtgcagtgggagagcactgagcttagggtcgtgtaggtaccaggacttaaatctcagcactgagcttggggtcagtagcagggatattattagcagctgccatttactgtgttcttcctatgcacagccattctttgttttttttttttgagacagtctcactctgttgcccaggctggagtgcagtggtgtgatctcggctcactgcaagctccgcctcttgggttcacaccattctcctgcctcagcctcccgagtagctgggactacaggcgcctgccaccatgcccagctaattttttttgtatttttagtagagacagggtttcaccgtgttagccaggatggtctcgatctcctgacctcgtgatccgcccgcctcggcctcccaaagtgctgggattacaggcgtgagccaccgcacccggccgcacaggcattcttctaagtgctttatgtgtctgaagcccagtcattcctcacagtaacctgttaacgcagctgttgtgcccattttatagatgagggaattgaggcatagagagttaaagggacttgctccccagcacatgcaggggagccaggagcctgctgtcatggtgcttgttctgccgcaccgtgcacagcccacaggcagctctctgtccttttctttcaagctgggaggaacgttgctcagatgctgggtgtacccgagcacagccataagagccatttcctttaaccctcctcttctgggaggcaagctctgtcctcattgctaggcaagacctaccatggtttgggaactacagagctgggtaggaacatgggtctcaggccacagccactaccttcttaccaactctgaggcccatgatagttgggggagtcaactgccagcccaccaatctggtgactggatgtcacatgcgatgccctcatggattctcaccttgtccatctacccttcgtcccccaggctccctgatggacttactcgccgaggagacatcaacctgctgatgctaggggaccctgggacagccaagtcccagcttctgaagtttgtggagaagtgttctcccattggggtgagtggcctgggatacctttgccaccttggcttgcagggaggaaggctgcagggcagggcctctgggtccccaggacacctgtggtgggctggctcacccggaatctcttcctcctttctcttggctgcggtcaggatggccgaggagatgggaggaagaagggagccaacaggtgtatgtaggtttggggcagggggcgagtacactgtactgagagtcaggatggggtttgggtctcaccctggccagaaattggctgtgggctttgagtaagtcacccaatctccctgagcgtcagtttatccatttgctaaataatgatattgttatcattaatagctaaaatctggctgggcatggtggttcatccctgtaataccagcgctttgggaggccgaggtgggcggattgcttgagctcaggagtttgagaccagcctggacaacatggtgaaaccctgtctttaccaaaaatacaaaataactagccaggcgtgatatgcacctgtggtcccagctgcttgggaggctgaggtgggaggatcacttaagcccagaacggggaggttgcagtgagccaagattgtgccactgcactccagcctgggtgacagagtgagaccatgtttcaaataataataataaataataataataataataatagctaaaatgaagggccagacactgcttgaagtactttgcatatatttacttagtcttcacctcaactgtgtggcaggtactattacccctgtgttaggggtgagaaaactcaggtacagaatgggtaagtgtcttggcccaggtctcactgctggtaagcattagagcaggatgtgattgaacccaagtgtctgatgagctgggtcctctgctgcgttgttgaatgggtctgcggggatcagagccagagaaggtctgacatgatccgagtggcggggttgtatagggcgagatggtggtctttggatagataggaagtgtgccaaatttgccacactggcactgtccagtagaaatagtgaactgcacatgcgacccatgtatgtcttctcagattgtctaacagccacattaaaaagtagctgggtgcggttgtgtgcatacctgtagtcccagctacttgggaggctgaggtgggaggatcacttgagcccaggagtttgagaccagcttgggcaacatagcaagaccccgtttcaatttaaaaggaagaaggggaaagaaaaaaggaaaaacaggtgaagttacttctgtttaactcgctatatctaaaatctcatttcaacatgttgtttgatatgtagattattgagatactttacattcttaggagctctgagtctttgaaatcgtgcgtattttgcacgattaaggacatctcagttaggactttcccaatttcaggggctctatggcagtatgtggcgtgtaggtctatatagagacgacaagggactcacgatgggggcaggctttccctgggagtcaggagtcctcatcctagccctgaggctaactcctcttctctgggcctcagtttgctcatctgtgagttgggcctcacaagactgtgtcacagggctgtggtgaggcttaggtgagccatggatgtgatgccctcagcggggagaacatctgggcacaccgaggcccagggcagcatccccttccagagggagacgcactgagttggagccttgagtcctattctgtaccctgcagccagctttgatgtgtgaccttgggcaaatcacaacctcagtgggtctttttgtcttatgggggtcaaagcatggagttgttattgggccctgacaccaccccactgccccaggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaaggtgagtctgatgaggtgggtagtagccaaaaggtgggtggcaccagggtatgtgacttcctgtgctcagccagcagaaatcacctctgacttgggagacatgttttcaatccctgggccggtcactctagtaactgtgggaagctgcttaacctcttcaagcctcagttcccatatctgaagagtggggagaagaaaggcaagcccacacagttgttcccatgattagaggtgacctggttgctgccattggccttgcgtggagctggtattcaggagtgagggctgctgttagttttcctgtttctactgctccctgctccctcacttcagtaggtctgatgatatttctctcttccccacttagatgcgagaagatgaccgtgtggcaatccacgaagccatggagcagcagaccatctctatcgccaaggtgagtggccctccatggagagcccagcctgcagcagcccagcgtggcccaaccgtcctcaggctgccctgattgggaccaagttctctttgcccaggcctagaatctgtgtgtgtgtgtgtgtgtgtgtgtgtgtgtgtgtgtgtgtgtgtgtgtgtgtgtgttgtaaacgtgtatataagaaggcatctttgccatctcctcccccttttcgtcgtctgtcgcctgttaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtggtacgtccaggggcagggctggtggccatgggacctgcctccaggcaggcttgtgattgtgtgggaaggagaatggagaacaagggccttggctggcaaagtcctgactgtcaggctgtgaaattggggagcacgtgagagggcggttgttgtggactgcagaggattgaagcagggtctggagtcctgtggcctgctctgcctctgccgtgagtgataagctgtgtgatttgggctaaatcagtttctccctgggcctcagtcccttatatatgaaacagaggagttgacattgggttatgagtaatagaacctcagttctggttagtaaatttttcaaagaaaaaaacatagtggtttatagaattggtaagtccggcggcttaaggcccaggtagatctggattctcaaacaactgtctctgcctttctgttctgcttcccttggtggaatctttgtacttgggcagctgttcctcttgtggtggcaaagacaaaataagattttgtcctgttagcttgtagcttaacagcccccaggaaagaggaggccccgtcttttccagtacttctatcaaaagtcccaggatagactcctattggcttgggtagatcctatgtccatgcccaagttggggtggacaagatacatgccccaagtcggggtggacaagctgaacccacccctttatggaccagggcagaggagcaaggagcattaagttctctctaaaggagaatccagatgctcccatcagaacgagggcctggtgctgagcaaacaggctgagcacgcctgagatctcagcaccctttccggctccttgatgccagggccccatcagctctttctggctgttccacctcagtgctgggactcaggcttgggacggcctgtgggatgacccattatcccctctgctctccagatgctggccaagcatgtcatcactctgcacgtgagcgcactgacacagacacaggctgtggagggcgagattgacctggccaagctgaagaagtttattgcctactgccgagtgtgagtcctggacgcaggcccacgggggtgaggttgcccagcttccctgggtgggagagaacccagtcccctggtcctgctcctcctcatgaagaacagcccagatgttgctgttctgaggttctcagctctactgaatctgctctgctcccttctaaccttgcgtagctcactggctcttggcttcagttttcccacctccacaccaaggaggtgggatttagatggtcttgaagacctcctcgagtctgacatgcagggaggcagtgaagtgtagacatggtagacatgggctctgggtcatacctgccttcactctatgactttgggcaagttggttggcctctctgagccttgatttccccaggcctatcgatgtttgctaggatttttgtaaggattgcacaagatgatgagtaagtgcttggcatagccctgccctgggtaaatactcagtgagtcgcagctgcaatttgattgttctcacagattttcaataataataattatatacatagtactggctggttgcagtggctcacgctgtaatcccagcactttgggaggcggaggcaggtggatcacttgaggtcaggagtgcgagaccagcctggccaacgtggcgaaaccccatgtctactaaaaatacaaaaattagccgggtgtggtggtgcacacctatagtcccagctactcaggaggctgaggcaggagaattgcttgaacccaggaggcagagattgcagtgagctgagatcgtgccattgcacttcagcctgggcaacagagtgagactctgtctcaaaaaaaaaaaatatatatatatgtgtacacacacacacacacacacacactcactcttacacactactttctttgtgccaggcattctgaattactattcagtattttctatatgaataaattataaccctcccccaaaacctaccaggtaaggtgtgctattattcccttccctttatggatggggaagctgaggcaaaggaagttaagtaacttgcccaaggtcacatgccagaggtagtggagccaggatgtgaacccagctgcttgcctccagaggctgtgctcttaaccacagtgcttcgattcttgtcgtacagcgctttggtgatcttttgaaggagctaaaacccaggggttgagggctctttgaatgcactaccagtggggggctggtgggtccctgattcagcacctctgccagggtgagtgggtagtccctgggtcttcatccaagtctgagctctgtgtggcccagtcttgagaggcttgggcccacagctgtgagtcagggagccctggattctaatcttccctctgcactaagtccccaggtagccttggggagttccctccctccctctgggtctcagtctccacatccttaggatggttgagctaaggctttccctacatcagtgactgtcagttggcctgggggctagaggggaggggatgggatagggtagatgctgatcagacttccccacacctaccgtcccaggagagtctgaggtgctcccagcccctggactgcagtcaccgccaagcctcctgtgggtgtcatcagcttgtcgtgtcttcagatgtgttgggtggaggagtttgagactgctgcaaagcccaccacccagtgggcctccatgccgctgtgattgtgccattgttcattacatgtatgggggaccttgtggcaagacaccacacagcgtctaacagtggggaagaggcggttttcaccctgcagacgtgcctggcttttcttcacctgttttttaagagaggcacccatatttctccccagtgttgatgtttgtggcagctgcccacagccagatttcacttaaatcttttccgattgttgtcccccagcccatatgagtgggcagctgtggtgtggtgggaaagtgcatgtctgtaagctggcagggggctgggggaaagggtaggtgccctaagagtccctcctggcctcacaccagcctctccccactgtcctgcaggaagtgtggcccccggctgtcagcagaggctgcagagaaactgaagaaccgctacatcatcatgcggagcggggcccgtcagcacgagagggacagtgaccgccgctccagcatccccatcactgtgcggtgagcaggcgggcagggctgggccatggcagatggggcttgctttacacagcagggtgtgcttggcaaccaggggcagtggtccaggcttttcacttggcacaggcccatagtagctctgggcaggaagagtccctttggagcataaactatggcctccttgatctcaatgatgatccatgtttcttgatttaaggccgggcaaacctagacccctcttgtctgaatttggcctggcttctcccattgtaggaagcccgaagggagggaaggacccaggcctgggagtcaagagtcttgggtcccagcctctagcccactgtgtgactgtagggaaattacattccttctctggccctcagtgcttttagctcctaactctgttcattcttgtgactttgtagacaatacagtgggtaagagttgggatttacctggtttgaatcctgtctccagcactgactggttggaaatggatttggctataagtaatggtaaatccagataaagtagcttaaagaaataggaagttcatttctcttttctgtagcactgtctggaggaagatggtatggggactggtgtgaggactcctcaagctcccccttactcttagtccgagatggccgctagaacttcagccatcacctccaggcagcaggacaggaaggaaagagagcttcccttttaaaggacacttcatgaagtcccacacaatgcttggacttacaacttactgccatagattggtcacacaaatacaacctggtacaaaagatgtctgggatgtgttttagtggatcgctgtgtgccagactaaaaactggggttccaagctaggtgcagtggcctacattgtgatcctagcactttgggaggctgaggcaggaggattacttgaggccaggagtttgagaccagcctgggcaacatagcaagactcccatttctacaaaaaataaaaaattagccaggcattgtggtgcatgcctgtagacccagctcctcaggtggctgaggtggaaggatcactggagcccaggagttcgaggctgcagtgagctatgatcatgccactacattccagcctggtccacagagcgagactttgtctcaaaaaaaaaaaaaaaaaaaaaaaattgcagttctatgactaagatcaaaagggagatggattatggggacacctagcagtctccaccacagtcttaccactttgggcaagcacctccctggtaacgggctggctggggaggaagggaatagcggaccgaggctaccctgagcacgctgttgcccccacaggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggtgagcagatgcaggggccatggtctcaattgatctgggttccctggctcggagctctgtgggcagggctctggcctgctgggggcctgcagtgtgtgtcttgcttctctgagtttgctgagcttctctgagtttctttttgccataagacccctctcctcctttctccccaccgctgtttcctccaagatgggaagaagcagcttctctccagacccttgaacacaatcctcttgacccaggtcattgatgataacccttctcactggctaggaacaacagttgatgctctgcttcctagagcttgtcagcattttcagtgcttccagagttatttcttgcattttgccttacagctgccccctggaagccaggtgagcagtcagtcctgcccatgttagaaatgagacagctgacactcgaaggggcctttccctggtgcccaagatcacagtcgcttggctggaatgcaagtctcctggcccctaggccagcgttttccacaccataagccatactgtctggtttcggtcagcctttcaacagactgtcccaggcaccgatcatgagccaggctacctacgctggggaaaatctgttccttcacccagcagatacttcattagtgttactgtttgccaggcactgttctaggtgctgggagtataagagcaatcaatcacagggtcccggccctcctgggttctcattctcgttctagttggggagagatagacagtagagaaacaaatgcaggtagtgtaggtagtgaaaaaggcagtgagggagatgatggcagggccaggtgtgttggaaaaggaggacgtgctctttcccatggagtgagtgggcatggcctctgcaaggaggtgatgccaagcagggagctgcatgaaggggacagtgtggctccttgggggaagagctgctcaggtggaggcagcgctaagtgtcagtttccccaggagggagcaggtttggtgcatttgaatggggaggcacttgggtgaggaatggggtgggtggggcctgttcctcctgtcccccttggtgaagactcagcctctaccctggagacacttgctgtcacatgagacattgcaggtggaggcctctgggatgctgcaggcacagagggcaggggtgatatggagtggtgataatttgagttgggtcttatgggctatgtaggagtttgcctcacagactcccctctcaatgacttcttgaccatgagcccaccatctccttagctgaaacaccaaggcctctgtggcagtaattggaagtcacgagcctcctggttgccgagggctcctcagggcacctcgtagatgtgtccagggcaggctggcttccctcctgggtcactgatgggccccttccaactctctctctaatctatctgctccagcaacaaaaggagtcctgctgtggcctccaagggcccgcaggacttggtccctagtgacactctggccatgtctctgctgcgctgggccccgggctgctttttgaatgagacaggtgtgttcctgcctctgtgactttgtgcttggcctggagtgtccccacatgtgccatatcctgtctcctcaatcaggcctgcaccaccctggcacactcggtgcccttttctgacttactcttcggggcctggctcaggctgttcttccttgggctagaggctgtctctgtccaagaactcccattgtcccagctccccggctgcctcacttctccatgcccacaggggtggagggcttcaccagccaggaggaccaggagatgctgagccgcatcgagaagcagctcaagcgccgctttgccattggctcccaggtgtctgagcacagcatcatcaaggacttcaccaagcaggtgagcctgccttggagtgggggtgtgagccggcacggggtgcaggtcttctgctggttcccacccactcagcactggcatcttactcagcagacaggccctgaacgggggtaggatggacaactgtccctttctcagaccttttctagccatcattccttccctagggacatcttcatcaggagcagggatgggggtattttttctgtcccacgaaggggaggggagagcagaggtggttggattctggtgaaaccccatacaagttccccgcagcccttcccgtctgtgcctttccccgttggcgggcgtttcatggagtgggaaggggcagagccatgagagtgagctttctggctcactgaggagggtactgttggccccatagagagaagatgggatttcccagatgctctggaaaacctgtcacctttaaaatctcaggattaatcctagtttctggtctccgctccttgtacatcatctcattttgattcagggcagtttaatgggtggtatcgtgtctattctataggtgcgcagactgaggcttagagaaaggtttagagcttcggttctagagtcagatgggacttaagtcccagctctacctcttaattgctgtgaccttgagcaagtggcttagcctccgtgtgcctcagtgtctggtacacagtgggcactcaggaagtgtgggccctttaggtcaaaggagcctgagtacaaagttccccgtgagcctggggatgtctgggctctgtcggagtcccctcgggcagcacgtgccgttagccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcatccgcctggtcattgttgaatcacaaatgtatttttgtgcagaagattcctgcagctcaaagccctttctgattccatactgttcggggaaatggagagatgagaggagctaaatcagctttcctctgactcactcccgttcaaagctcatttcttttctgataattttgagagtgtctggaacagcttttgttttcttggtggggtggcaaccttactgggcgcgctgtgggttttgcatccaaggctgcatctccggttcctgctagcctttcatcttgctcaggtggggactcgcgtgcatctcaggcccaaggtcctcccgtcctgcttgttcatggagtgtggaactctcatgaggttcaccctgcagtggcaactttgctggtggccttttctccacccctgtggtgggtggtgctgctgtggtcacctctgttttacaggtggagaaactgaggctcagagagtcaagtgtcacagtgagggagtgcagggcaggcttcaaacctggtggctccgaactccacccatgtcaccttttctgccagattctctcttggcagtccctgacctcggcctgagtgggatgctgggcagagacagtcctggcctgggggaggcaggtgccagtcaggtgggggagactgaccctggggtaggttcccaggggtaggtggcctgactggcaggcacaggactgagaggccaaagggggtccgactggcttttccgtggtagttggggtagggctcataggaggagcagctgtgctcagagcatgccagtctccttccagatcggggcagcagcatgaagagaggcccctgagccagggaaacacctgcttgttggggaaagcaaaggctgaggagagagcctgaagggaggccaggagaggggagcattcaggctgagtaatagttggggctcggcttagtggaatctccagtcaggcctcagtgacacctagagaggcagggaggtggggcaagggggggagctggattcccgagctggtgctgccactcagggtggctgagctcttcactcacctgtgacctggctcccttaggcttgtcttctcagatctgtccctaccctcaccagctacaggccgcgacccagcggacatttctctctgctgagcaaatcacttcacccctcagcctcctttcatctgtagaaagggcacagcagtacagtagccctttcacccaggggtggctgtgaggattaactgagggggtagacatcagagcagctgggcctggccccggggaggtgctcccaggaagggctgggtgcctgtggttttccctgcctcacagcctctgccgtctcggatttcaccttttcatgcttttgtgtgagcagaggccgagcctctgctgctgtgttccctgccccactctactcctggctgcatgggtctctcaacttcgctcaccactatgagagccgctccaccccttctccagttccaggtctgggaaggagagagcagacaagcttgctcatgatggagtccttttacctggtttctctctctgttcacagataccacctctgttgatctgggaactaagaccatgttgcttgtccttagtcacatatgacttaatttgcacccattgtgggccactggtgtcagacaggaagcctaagcgcaggtatcactgaggaggatacacatgctaactacacgatcttcaccagacctgtgagcttccagccaccagatccaaagtcacagagcacagggacttacaaacccagtgctggaaaacatagcaaaggctatatccaatttaggtttctctttattggaaataaagatggcccatacttcaaatatgttatttagagaatgcttataaagagcagcctaaagtcccattctcttgcctgtaagcaacaaaattacaaaaatgttgaatttctaaaatgcgaaagttaagcattccagagaccagctcatggaagaaggttttatgtttttgggtgttgtaactattatccatatgtatttaaacatgaatacgtctgtttggtatttaacacattttttttttttttggctttcaaggcctttatttttttatttttatttttttcccttttttaatttattatacttgtttttggggtacatgtgcagaacgtaaagttttgttacatgggtatacacatgccatggtggtttgctgcacccatcaacccgtcatctacattaggtatttcttctaatgttatccctccctagccccccaccccccacaaatgtttaattaggagtgtcaagtctggatgaaccaaggtagatatttattttaagacattatggtgaggccaaagagtacattaaaatggttttaatttgtttttatagatcaaaaacaagcattttttattaaaaatatgaggcagtaaagcacagtggttaagaacatggacttggggccaggtgtggtagctcattcctgtaatcccagcactttaggaggctgaggcaggagaatcacttgaggccaggagttcaagactagcctgggcaacatagtgagacccccatcgctctctctctctctttttttttttttttttgagaccaagtctcactctgttgtccaggctggagtgcattggcgcgatctcggctcactgcaacctccgcctcccaggatcaagcgattctcctgcctcagcctcctgagtagctgggattacaggtgcccaccaccacacccagctaattttttgtatttttagtagagatggggtttcaccatgttggctaggctggtttcaaactcctgaactcaagtgatctgcccaccttggcctcccaaagtggtgggattacaggtgtgagccactgcacctggcctattttattatttttttagagatgggggtggttctcactgtgttgcccatgctggtctggaactcctgggctcaatcgatcctcctgcctcggcctcccaaagttcttagattacaggtgtgagccactgcaccagccaggattaaaggagttaacagccccaaagcactcagaacaccaccaggcccagggtaaaggctttttcagtgttccatatgtaaactatctacatatgtagatagttttttacatacgtaaaaaacctactattgacgtatgtaaacctacacacattggcttgctctaacagaagggctgtgttgtaaggtagtaagctccctgtttctgcacgtggtcaggtagaggcaacccagcatctgttggcgggcttggtcttccaggtcagggagacttctccccggctcctactcagggctcaccaccacctatttcatacttactagttgttttagagacagggtttctctgtattgtctggtctggaatcctccagctctggttattcacaggcatagtcacagtgcactacagccttgaactcctgacctcaagcgatcctactgcctcgacctcccaagtagctgggactacaggcgcatgccagtattcccagttcttttctttgaccttttttttttttttttttttttttttttcttttttgaggcggaattttgctctgttcccaggctggagtgtagtatcatgatctcagctccctgcaacctccgcctcccaggttcaagcaattctcctgcctcagcctcccaagtagctgggattacaggtgcctgccaccatgcttggctaatttttgtatttttagtagagacaagatttcaccatgttggccaggctggtcttgatctcctgacctcaggtgatccacctgcctcggcctcccaaagttctgggattataggcatgagccaccgtgcccggccaaatcttttctttgaaatgctaggtcctaaggttattatctccaaattacagatgagaaattgaggctacaagactttgaggaaatgactcaatgtctcagaggcagaagtgaaggatctgggtgagccaccaagggtcgtcttcttaggagatattattgccttcaagatttcaagattgattgttccgggctctgagattctagaattctctcctgccattcctcctcacccctcctgcccttgttttttgttcttccttttttttttaagatggagtcttgctctgtcacccaggctggagtgcagtggcttgctctcttggctcactgcaacctccacctcctggttcaagcaattctcctgccccaggctcccgagtagctgggactacaggcgcgcgccactgtagctggctaatttttgtatttttagtagagatggggtttcaccatgttggctaggctggtgtcaaactcctggcctcaggtgatccgcccacctcagcctcaaaaagtgcaggcctgtgccaccgtgcccagccattttttgttcttccttagagaaccagctcagcctagtgcttctcagccagtaggcctcattctagagcaagacttctgggctccatgctcaatagctgtggaatatattaccctctccaaatctcagtttccgtgtctgtaaaatgggtcgggcttttctggtgttaacaccgaaagtcttgcatcccaggagccccttcagccctaggcacacccgttggtcaccctaaaaatggggggaataaaagcccatctggaagagttgtggtcaggttgggctgaacagcgttcactggtattgagcatggtacctttcaggggcctgcagagaatgggagagaaaattactgctccttacacagggtgacggagtccatggcctgagtgtgacacctaatgccaccacttccagctgtgtgccctgagttcagtttatcttcctgggtctctgttcccccagatgttaagaggattgataatagtgtgggctgagtatagtgagagtataggaagatacagtgaaataacaagagctttgccaggaagtgggcacctggtgcccgctgggcaggagtgcctgtagttaatcattatgtgtctcaaaaggtgtcaaaagcttctgaacacttaatgctgtgttttgggcctggagccccaaaaccagccagtggggactttttttttttttttgagatggagtctcgctctgtcgcccaggctagagtgtgcagtggtgcgacctcagctcactgcaacctccgcctgccagtttcaagcaattcttctgcctcagcctcccgagtagctgggactacaggcgcgtgccaccatgcctggctaattttgttttgttttgtatttttagtagagatggggtttcaccatgctagccagtctggtctggaactcctgacctcctgatccacctgcctcggcctcccaaagtcctgggattacaggcgtgagccactgtacccagcctttttttttttttttcagtcgtatttccatgcaggacacagaaggaccagtggggactcttaccttgtctctagctttggtctttttaaaaaaaataaccctgaataatcaggagaatttttttgatgaatgagggcactcctctccagctgtcccaggggtgcgaggagaacagtgtccatgagggggcgccagagcaccaggcccggggctgcagcctcccgcacccacccggcctggcctgcagggccagctctccaggcgctcccagggacttcccggcctcctaccctgggaatctggaaactccctggctcagactcagcagcccagacgctgcctggaggatcctctggttctgggcattcaccactggctttgtttggacaaaggctctgctgcgtgacagatcctgggggatgcctgagttatcgttatcatgctccagcggaagtgggtatcctcgtcctgggttacacaccaggaaactgaggcacagaaatgcacggagccggggtccaaacccacggatgcccaacccccgaatctttgccagcagtctctgagaatcagtctggatctcagaatgattgtaataatcttggaggcttagaaggctagactcttagaaatattcagttcaaatatacacgtgtattattttttgtatgggtagcgcatgggtgaaaagacaaaagtaaaaccagtcccccttctctctgaccgtccccagccaccctggaggtgaccacagtgatagtttctcgggtcttgtctcctcctgatataggactcatcaaatcttagaattagatgggatttctgggtgactcggtctctggaacccatcagcttctagcacgcagccctaaggttcccactgccatccctgtcaaactcaaactcatgggtgagtttgaggatcttggctcctggaaccccccagcttcaggcccagctactcctttagagttgaaggggctgttttctccagcgacccagacttcagttccctctgtgcctctcctcctccagggggccctccttccagaaacaccctgcctgcttctggtggtataatagaggacactcagcatggcaccctctcactttatgcctggtgatgggcctgatctgtcgggtcagtgcctttccccagaaggaacgtggtggcatttgttgattcatccgtttgtgtcatggagataatgaccgtacctacaataaagggcgaggtgagcattaaatgcatgaatgtatgcagagctcttagactagtgcctgttacattctctatgggtttctattattattgatacttttagttcattcagctaaatttaccaagcattcacaggtttccgggacactgggaatacagagaacaaagcatgtttcttcctgcttgggggagaaagatccagaaagaacgtcagcgccagcatgaagagccttgtgagaaagaacaagtgctctgtgatatttcaagagatgggaccccatggaggcctggtgtgtgggtaccggggtggccttgtgctttgagatgaagccagggggtctagcggggagtacaggtggcaggcaggcatcagttacataagcgcctcaccctgggagctcaagtactgtgtgacggttctgttcacggcccccacacagaacgtgctccttgtcagtagagcagagcagggaggagaagcaccagagagctgctgcgtggagtctggaagtatctcctccaacttccttggggaggaaagcaagggcccagactcttaacaccagcccatgtagtcaggtgaataattcccagtcactatctagtccctggccctggccatctgctcagccccttcggcaactccagcctggtccagcctcatctggctctgtgtgtgtgtgtgcgggggggtggtgggtgagaggctggaggagagtggagggggttggggattggggccaggcagcgctgtgtgaggctagagatgggaggtcctagagggagaccaggaaatcaggcactcaggagagctgggagggtaaaagttgctgggggcaggtgtctcgggggcagatggtggagcccaggtgaaccccctaggttgtctctgtcccatcatccttgatcctctttgttttttgagacagggtctcacaatgttgctcaggctggagtgcagtagtgcagtcatggcccattgcaccctcaaccttgtgggctcaagggatcctctcacctcagctcctggagtagctgggactacaggcatgcaccaccatgtctggcttatttcttaattttcttgtagagacagggtcttgctatattgcccaggctagcctcaagcttgagggctcaaagtgatcttcctgcctccacctcctaagtgttgagactataggtatgagccactgggcctggccccttgattccctttgcatgatagaacttcaacccttggagccccagaggatccaggcagtatcaagtcaccatccatgttatagatgagaccatgtataacatcaccatctttaacaccaccatccagccttcagatgagatcacagccctgactgcaacctctctgaccacagctcagagagggcatgtggcatgctcacaaacagtctgttaggggcttcccctgggtcagaactcagacccctcggctcttagtccaatgctcctctcctaacccaggttgcctttggggaccttgggggggtctctcatttcattgggaatgcctaatggcattggttgccacgtgttgccattgttggtgtatgtaagtcgctcttctgtcctcatatccccactctgtcgtcctgccccttcttgggggtggatcctgcaggagagggggaagcagccaagcaaggcttcatttctacttttccatctgcaggacccagggctgggcacatttggtgcaacaggctggaaatattctcccctaccccaccctccccatccctcctcagaggcactgggccggggactggagcctgtggtgaggtccttcccctcaagccctgtcgggggcagccactaaatggccccaagatcccatggactcaagggattccatgtggcatcccttcccgtgctgcagaggctgggaaacttaaccacatttccagactctcttgcagctagtgtttctgatggcatggaaatcctgccattgaatgcaaacgcacaagactagaatttggaactgagtttcgtggggagagaggcagggcatggagcatccaagcatccattttgctgtgtggatggtggtagagtgcaggcctaatgctggagctggcagttgtaatggtggcttctgaattccacagcttcttgatggaggcaggagccctggcatcttagcccagttcagcagcgttttaggcagctttcctggatgctcagacacttagtaataatatgcttgaaaaaaaaaagccctttttttccctactagctggaatggattccgttgtctgtcactgaaccctgatgatacatcttctacacactgtgtgggacaaggccccatggaagtcccaagtcagtaacctgaactccccaccctctctgccaagaaagagcttttttctctcagtatccatttatcggtcccaggggagctctctgattggctgtgcttgggccagtcattatctcctgg

SEQ ID NO: 1305 - DNA, 2525 bp, Homo sapiens
ttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctggacgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggtgagggatgtgatgctggccaagcatgtcatcactctgcacgtgagtgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggacggggcccgtcagcacgagagggacagtgaccgcgtccagcatccccatcactgtgcggcagttggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgctcactggactcatggactcgccacgctcgccctccttgccgctgcctgccattgacaatgttgctgggacctctgcctccccactgcagccctcgaacttcccaggcaccctcctttctgccccagaggaaggagctgtagtgtcctgctgcctctgggcgcccgctctagcgggttctgggaagtgtgcttttggcatccgttaataataaagccacggtgtgttcaggt

SEQ ID NO: 1306 - DNA, 2202 bp, Homo sapiens
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctggacgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggtgagggatgtgatgctggccaagcatgtcatcactctgcacgtgagtgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggacggggcccgtcagcacgagagggacagtgaccgcgtccagcatccccatcactgtgcggcagttggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtga

SEQ ID NO: 1307 - DNA, 27846 bp, Mus musculus
  misc_feature (800)..(3999): "n" at positions 800 thru 3999  can be any base
  misc_feature (6822)..(7192): "n" at positions 6822 thru 7192  can be any base
  misc_feature (8486)..(9520): "n" at positions 8486 thru 9520  can be any base
  misc_feature (21270)..(21289): "n" at positions 21270 thru 21289  can be any base
gcgcagcgagactgcgcctgcaaccgtctgggctcccgggccctgctgaggcagttggtccttcctgcagaaccgagcaacagcccgtcagggcactctcaccttggtcttgcattggcttcaccctccagccaggacccgcgaggtagacacagggtggaggacagaagaacctgggaacacataacatcattttcactgtcttaaaagtgtctcaaggtggcataaatttttaaagaatcatgatttagtgtcccctctcccagagtgaaaccgttaatgcattattagacctcatcagtaagtcctgcccgctccatcttcaaaacacatctggaatccgttagattcctaccaacttcaccttggtcctaaccactatcccttgccttcccaactcagccttccatctgtctctcccttgctacagatgcctcttttagtttgtttttcacacagcaactagattactttaaaaaatttatttatggatatgagagctctatttgcatgtatgcctgcatggcagaagagaccatctgacagaagagaacatcagatcccattacagatggttgtgagccagcaagtagttgcgaggaattgaactcaggtcctctggaagagcagccaccagtgctcttaaccctgagtagtctctccagccccagattagttcttaagtaacaggtggctcagtggataaaaggcttgctgaggcaagcatgataacttgacttcaatgcccagaacccatcaaaaggaggaagagaaccaactgtacacctaactgcacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaatgcagctgccgcttgggctcgccctggctgtctggcattccccacttagggcaacctgcccacgccgccgccgttacctggtccaactccccaggaggctgggcccgtcgctctgtagccgcacctctgagctgtccggcaggctcaggtgagtcaaagggcccgggggcaacgaggggtctgcagggaagccagcgtaaaacccgtagggggacaagtcttaacagcctacgtgtccacgtctaacctgcagtaccttttccgatccccctctggcaaggccaacaaaatgcaggtcctccttccctaatctccctccacgcctggcaccttcccaaagtgtcctttccggattagctcttgaactcagacctctttggagcgcactttccttgggaatgcactttccctatcctaagggcgtccgagaaatttcctcttcaatgcaaggatccttatcaggagacctgggctcactctaatgggccactacttcaaagcaagcctttgaacgatgatgactcttctttgccctccctagacccccccccccccccgtggaacagcggatttggaaagctgaaattgagagggcagctgttttgactttctaagagtcctgaggtgcaagcgacatcaagtgcgtgttgacttaagccaagaggagcttaagggagcccttagtcaagagccaaccctgagtttcaaaggcccggtggagctatactcagatgtttgccctggggtgctggctccgctctggcccactctagaaaaggcttgcctttcctcctacctccaccatcaagccactggcacatctagctagcttgtcaccttaccaccacagaccctgccagaaggatttttgttcttctaccctcgctggaaagccagaagggagaagaatctcggataggaagctggtctggagtcagagccacgcaccggccttgctcagaatgggctcattcaaggaactggggggttgggggaggggcagccgtgggttaaggggcgatggcctgctctgccaagaaaccacagaaaaatggatagagcaggctcagtgtgccgtgtgggggtggggtggggaaacggaaagaaaggcttagtgattcttaggtgcaagggaaccaggcttctctggaggaagagacaggggtggggtgtaggggggtgagagctaggtttagttctgtgcctggagcccagctgcgtagtcttattgggcagcacattttccatccgtacagtgtgtgtgttcccttagtggttctcaagggacctagttaggctacacaggaaggagagggctcacctgttgtctccctggggtccatggctgctcatcgaggcccaggccgctctcttgctgccctctgggcacatctaccgccactgacttcgataccgttcacacatctaagccccgatccgatcctcacactggatttatcctgtccaagccttatcttcaaggtcccgggactcccagcggcctgtttgctctgggcagggacacctgctgggcagatgtaggcttcccaaggcagtagaagccagacccagcaggcgccccctggcggcctctcctaagagcaggcgagaaacagacaccgaggcgtgtcttgtgcaggactccactctctggcctaccactaagaacccagaccccaagagctgctctttggcgtgtggcacgggtttgggggaatatggggaatgatttctgtccgcagaagaagagagtgtggagcaccttagctgactcacacaccagatagacaggactctatctcggccgcagccactttcctgctataaggcgttgggtagcagcatttaatttcttaaagcctatttctgaatagggagaaccgaaccaaaacagccttaaatgtcggaactacaaagagggtcaatgccacaacggaaaagcacatttagcactatatctggtatttaggaaggggttctttcggggactggcaagatggctcagtgggtaaaggtgcttgctgtcgggactgaccaccggagttcagtcctgtttaattctgggacacacacagaggaaggagaaaacggacttcagcgaattgccccctgacctccacacgtgtgtgccatagtgtgtgagcacacaccatatacatgtatatatatgtaacacacacacacatatatggtgtgtatgctatataatatatatgatgtgtatgatctgtaatatatatcatatatatggtgtgtgtgtatatatatatatacacacatatgtatataattttttaatacaagcgtttatctccttttgagttttatgtatttttatctacttcttattaacttagtgccctgtagttctgtaaaatgccattttttacaaaggctcctctgtgagtttcagcaatcccagtgtggtgacatcaaaaaattatcatgagcctttttgttttgttttgagaaagaatctcactatgtagccctgggtggcctggaactcactatgaagaacagactggtcctcaaactcccagagatctgcctgcctttgcctcccgagtgtgcagctatgcctggcaaaacattttgaacatacgcaaagccagagtgttcatcccctgcaataaaagcaccgtcaaaactgttgctttgcgaccttcttttctagctgcaggctgtgacactgtggttcgtcatccttccaagcaccatgagaggcccctgctgctggccactctctctgttgctgctcttcctgcagtcctgggaaactcagctccagtctgcaggtgagttggatcccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgcttgctgggacaatccaagttatcagagatacaggagatgagatgttctagatataatctaatcagttcattcatttatggtgtctggctggctcatgtaggcatttgagacagcgacatctctttgttcactcctcaatacataacacagactcagaacagctcccagaactgcatgcgcgcgcgggggtggggtgggggaaccttgtgtgatttcctggctcaggtctcctcaaatgatggatgagtaactgtatccaaggctaatttgttaggttaaagacatgctgggcactgttccattcagataacagcaggtcttccggctttttctaagagaccagctttagctgacccgtgagagtcctcctccatcttcccgcaggtcctaggtgctataatgggcccctggatttggtgttcatgattgatagctcccgcagcgtgcgccccttcgagtttgagaccatgaggcagttcctagtgggcctcctccgcagcctggacgtgggtctgaacgccacgcgcgttggggtgatccagtattctagtcaagtgcaaagcgtctttcccctgggcgccttttcgcgccgcgaggacatggaacgagccatccgcgccggtggtgccgctggcgcagggcaccatgaccgggctggcgatccagtacgctatgaacgtggccttcagcgaggccgaaggcgcgcgcccatcggaggagcgagtgccgcgcgtcttggtcatcgtgacagacgggcgacctcaagaccgagtggccgaagtggccgctcaggcgcgcgcccgcgggcattgagatctatgcggtaggggtacagcgagctgacgtgggctctcttcgcaccatggcttcgccgccgctggatcagcatgtcttcttagtggagtccttcgatctcatccaggagtttggcctgcagttccagggccgcctgtgcggtgagttagagtggcacccagctcaggcaatgcagatgctcattctagttcgcatcattaaaggcgatccctcaattttactctgccctctgggtaccagttgccgtggtccctcctgcagagtggtatcctcagcagccagtcatgctgtgtcagagactgaccctgccacaagctgtcacccccccccttctcccgcctcccacaccaaatgtcttttaatcaagaatcgctcaaaattgatagtattgtctgtcaggagtcatgccccgcccacccgagtatgttcctccaactttaagtcccttttaaatacttgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttccgcgggttgcgtggcttccgcagttgcgtggcttccgaggttgcatggcttccgagggttgtgtggcttccgagggttgtgtggcttcaggaggttgcgtggcttccgagggttgcgtggcttccgagggttgtgtggcttccgagggtggtgtggcttccgagggtggtgtggcttccgagggtggagtggcttccgagggtggtgtggcttccgagggtgtgtggcttctgaggttgtgtggcttccgagggttgcgtggcttccgagggttgcgtggcttccgagggtggtgtggcttacaagggttgtgtggcttccgagggttgcttggcttctgagggttgcgtggcttctggaggttgtgtggcttctgagggttgcgtggcttccgcgggttgcgtggcttccgtgggttgcgtggctaggctgtgaaatgaagcccctagcaaagactgacttcatcctctttccagccttggatctctgcgctgaaggaacccatggctgtgaacacctctgtgtcaactccgtggactcgtatttctgtcgttgccgagctggctttgcgctccagcaggaccagaggagctgcagaggtaagtgagcctcccacaaccccctctctgtgagcgttctgaatggcccctggtggctacactcagaagtgacatcctgcggtttcttccttccctcagccattgactactgcagctttggaaaccacagctgccagcatgagtgtgtgagcactttggcggggccacagtgtcgctgcagagagggccacgacctgctacctgatgggagaagctgtcggggtgaggaggtgtctctcatatttgtagggaatagaaagggattctagctgctgggatctaacctgaccggtcctacttggtgtctcctttaaagtcagggacttctgcaatggtgtggaccatggctgtgagttccagtgtgtgagtgagggtctttccttccactgcctgtgccctgaggggaggcgacttcaggctgatggcaagagctgtgaccgtgagttatatataaggcagagggtctgctccggccccattgcctgcctcttcttcaatgcccagttacagccccacagatggtggtgtgtatgtgcgtgtgttggcggatgtgcttataatgcccagcttcttttccaaccagtcctctatcctgctgtcaagactgatttcaaaatccatatctgatcacgttcctctttcactcaaaatacttttgtggttcaccagtgtctacaaaagcaagtgccttccctccgaatttttccagtgctgggcacaaccacattaatggataatgaaaccaaattagtgggttgcaaccagcatttaaagaaaagaagagaaaaatagtttcctgagtttaggagagtaagtattgcttcatgagctggaccgttcagttacgtgaaatgcaccgtggtctatcattattctcttttttcatcgtgggctgtggtcaattttgaaatcatcacttaatctcattaccatgtagctttggccagctctttagcccatctcttgccacacttgaacattttagtcccactggcctgtccctctccgagtgtgtcatacccttcccggctcccatgcctttgtgtgtgctgtgccaaccttctagaatgccccccttgccttggcaaattcccggtcatccttcaagacggcattagcccatttcggttgccatggtgcaacaccgatgtgagttgctataatgaaaacgctcaaagcggggtgattggttagagagtagagcttacgtggctcacagtctggagcatagcgtcaacatctcagtattggcgatgaccacgtgacaggagagagcccctgagattgaagagtatgtgtgtgtgagggttcaaatgcaggaggtggccgtcctttgtaacctttcactgacagggtcattctagtctctcgagacctactcaatcctgtgatgtgggcgttaatttcttcctagggtggtgctccatgacctaatcgtctcccagaaggcctgttatgattcagagagaaagtgctctcttgcaagctcatgcctcaaaggcttggtccttaatgccaacatgttcagagcctgggatcttattaattgattaacccaaagatggattaaacacgagagtaggtttttagggtgttgggagatggaactgtagaggataggccctagattgagaaagtgggtcactgggggggttaatgccatttttttttgagacagggttttatgtagcccaggctggccatatactagctatgtaactgataatgaccttgggcttcctaatcctactgcctccgaatgttatggtaacccccttttctgtggtgttagggctctaactcagggcttggtacaagctaggcaactgctctaccaaatgagcttcatatccagttcctgaagcctgggatttggatgtgtattccaggctggtcttgatcctgcctgtctcccaagtgctgagattacaggcttgtgcctccatgtcctgtttgaagagtgtcttgtccctgcctgcctgtctgtctgtctgtgtttccttctgtaatgaaggatgttgcattcctccatcattttcctgctgtcatgatatctggcctctacccaggtcaaaggcaatggagccagacagccgtgcactgaaatcttcccaagtcgtgagctaaagcaaatccttccacccttaagttacttccatcactgcaatggaaagacccctaggtctcaatcacttctcagtcctgttaccctggggaccaagtttctagcacatggtctcttgggcacaaaccatatctaagccacaacaatatcttaaatgtttatttctcagttctggaaaggctaagaccaagattcgggcagatacggtgtcccatgatgctctgcttcctggcttatacaagatagttttctctttgttctcccttgatggatggacggaggaagcagactctgtagaagctcttgtcagaacattaattaattgcattcatgaaggcctgactctcatgtctgtgtctaatcccaatttcgtcccaaagatgatcacattgagacagggttttatgtagctccgactggcggtgtatagctatatactgataatgaccttgggcttcctaattgaaccccaccacctccacgaagccttcctcaaccactctcagggaagtgatttattccggtcttgggctcccttactgcctcctcatagtgcactttccttaactgtggcagatggcatgtctgccttgctacagtctgccctgatcttgtgggtcaggactgtgttttctttgttgttgaatccccttctggtactcaagaagccactggatcaggacaaaggaggcagtgtcttagtgagcaggtccagtggtttgtggtttagatgccgctgccttccaatcttggctttgccgctgttaacttcagaacctagtttatgggaaatggggagagcactcgaggagaaagtgtgtcaagtgcgagtttcagcgtctgacacgtgacaaacaccagaaaatgttgttcttgccattgtcattaatactgatatggtgcttagaatggtgacagatacatactaggtgatcgaggaatgctagctattgtggtatatttttgctcttggttgtttaataacgaaccgggaggtggtgatgtttgcctttaatctctgcacttgggaagcagaagcaggcagatctctgagtttgcaactagcctggtctgcatagtgaattccaggtcagccaggactacaccgagaaatgctatcttgaaaaaaaaaaaaaaaaagccaggcagtggtggtgcacacctttaatcccaacactcaggaggcagaggcaggcggatttctgagtttgagaccagtctggtctacagagtgagttccaggacagtcagggttatacagagaaaccctgtctcgaaaaaccaaacagagaggggggggggggagaagagagctttcaataaagcatttggttagtgccaagcacttaacatcaaaagttgtcatacaaaagaggacgatggttatgtattgattgctgggcacacacagtcaggacacataactggaatgcgttatatagtaaatactggcgatgaataactagacgagtatgtggttctcctgggcaaggacctgatccctccatccaagccttctccttggcagggtgccgggagggccacgtggatcttgttctcctggtggatggttccaagagcgtgcgcccacagaacttcgagctggtgaagcgcttcgtgaaccagattgtggatttccttgacgtgtctcccgagggcacacgtgttgggctggtgcagttctccagccgggtgcgcaccgagttccccctgggccgctatggcaccgcagctgaggtgaagcaggcagttttggccgtggagtacatggagcgcggcaccatgacagggctggccctgcgtcacatggtggagcacagcttctctgaggcgcagggcgcgcggcctcgcgacctcaacgtgcctcgcgtgggcttggtgttcactgatggccgctctcaggatgacatttcagtgtgggcagctcgtgccaaagaggaaggtaggtttggcaagggatggactggtgtggggttggagttggggctgggaagcagttttctccaggcttggagctttctcttgagtgtctgggccctacaggcatcgtcatgtatgccgtgggcgtgggtaaggctgtggaggaagagctgcgtgagatcgcatcggaaccatcggagttgcacgtgtcctattctccggactttagcaccatgacgcacctgctggagaatctcaaaggcagcatttgcccaggtgagtgaatctcttccagccgaccggagtgcatgcgtatgcgcgcgcgcgcgtgtgtgtgtgtgtgtgtgtgtgtgtgtgtgtgtgtgtagggatggggacgagagggcagggtctgttgtcttttttacctagcctctgatagatgccctggtcctcagctcttcactacccttcagctctctacacagagcttgttatttaaaacccagagcaggtctgtcctttaccgtagcttgtcaaaaacgcagccccgacagtgaatcggacccttatgtgctttgtgtgcacctcagagtcaacgaggcgttgggatttttttttcactcaaattagtagtgtctggaataacttgagaaaactgtattattaaaaatatgtttaaaattgcatttcatgcacaccttttgcctgcatgtacgtatgggcctggttcatgtggaggccagaagtggggggcagttcctgtgagactacagatggtttgtgagtcgccgtgtgagtgctggacattgaacctgggtcctctggaagagcaggcagtgctcttaaccactcagccatctctccaggtcaagagaaaacttttaaaaaagcaagtcaaatttagcatttacaagcgtaaccgactataagcttccagcttgtggagattcaactttatagatttggcaaagtgacaggacagggttgtttttttatttttattttttatttttatttttttacagtggcttgtgctttctggggacatagaccataaatgccatcattgtaatgtatctggtctccagctgggggtgggggggaggggaaggatccagacatgcccgcggggaacagctgggccttatagggggcaaagtttcttggtggggggcttgattttgactatggggtctttagattctaacacatgtctaaggcgtgactcttcttccactgtctactgctgatagaggtaggtgagcagggctgtgtccagggcagagaatctgtagttaaaagtgctccctgccctgccaccaactctaacaattaactaaggtgttttggacacatcaggcttaagggcccttcccgtcccgacttatttacaatggaccctggataactcacttaaccccggccctaccttaccctcttctgtatgaggaaagatgcccaaagttactgccagctttagatttcggaggcaagttggaacgctctgctaaagctcttcactggctgaccattcaggcccaggcagatcctcatctttctgtaaccctcggttctacagctctaaagtcagaggtgaacatttgggagtgttaacgaggccatcaataaaatgacacaaggatgagggtttgactgatagtagaatctccctatggaggctgaggctaagaatcttgctgctattttagtgcctgcaatattaaaaaacaagagctggtgagatggcacagcgtgtaaaagcagctgccatgcaaacccggcgacctgagttcgatcctggaacacattaccaaaaagcccgatgcgatggctcacatctgtacccagcatccctgcagggagatgggtggtgcagacggaagcacctgaaagcttgcctggatacaaagagaggcaaaaactaaagagagacgctgcctcaaaaaggtgtgaggagagagttgactcacaatagatgttctctgatgttgacatgaatgctgtggtctgccctcacacatgtatcatacacatacataataaaacattaaaatagaaaatggcgtggaccagcagtgatgctatctccgtaatattccccaccattttctgtactgttaaggaaacatagacaaccaagtttatctctactctactcttagatgttgaagtgtgtgtgtggagataaacttggatccataattttttgtttttgcgtttgagacggggtttctctgtgtagctttggctgtcctcctggaactcactctgtagatcagactggcctcaaactcacagagatccttccttctgcctatgcctcttgagcgctgggaccaaaggcatgtaccaccacgcctgacttggacctataatttaaacattaatttcatcagaatcagtggaatcgcatattgttgcacttcatcctgactcactaggtctgggatagggtttgataatttgccattatgacatattcctaggttatgctaatactgcttgtccacggaatgctggtttactagaaatacacagtacagggttgacttgtgcctggcattgctctagatattgtgccagtacggtattcagtcgctacgtgtgtatgatgaattacaattggtcacaataacacagaataaaaactgagttcttcagttgtacccgccacatttcaagtgtcttaagctccaggtggcttttgggtattgaatcggccaggacagacagatagagaacatgtccattgtttgtcgtggtctcatttggaccagctcatccatctagactttttctaatcaaagtgaaacccatggacttcagaattaatgtgtttcaggagcttagtgaaagtgcagatttttactctgagtcgaaatctggattctagcaagctctgtggtaatcccagcaagcataagggttggagaatttctcttgcaagtgggtccacatatgcaaatcgtctaatctcataaccactagtgggtagcttctttcattatatccattttacggatgcgggggaattgagacttgaggggttgagtttcccccaggacttctgtgctatttggctgggactcaggctaggtctaaatccaaagcctgcatgtacaccatcgactcggtagaggtgtatcagaaggtcgaagccacagcctggtgggctcccttttggttcctcattcctttgactcttggctctctccttgcagaggagggcattggcgcggggacagagcttcggagtccctgcgaatgcgaaagcctcgtggagttccagggccgcacgctgggggcgctcgagagcctgacgcagaaccatatccttttgggctggaggtgcgggttgcagggcgggtgaagggatctctgagaccacatcttccttaaccgctcactggctcggctgacagagcgcctggaggagctggagaaccagctggctagccgaaagtgagggtcgcacgctgtctgagcagccacgcgagaccgaggccgagccccgcagcctggaccgtccaggagggggcgctggcgggccccacgcgctgccttcgagctggcctcacctggaccaggagccagatttaggggatggggatgaggggatggggaggtgctggtggggaaggactgctacactcgccgcgagctttgttggatttctttttttgttttccttttctaaaaaaaaaaaaaaatttggttttcacggggtcggtttgtggctattgctatgctggcagagggaggggagttcagacgagcgtgctcataggcgcccgggtggcgtcctcttggagaaaggcgcattgtgcagtactggggctggggggcagggggccgctgcttcccgtctcttgtttattcagccccagaacagatggcccgttatgtaggacgtggggagggaggggatgccccgagaacctttgggtccgaggaagtctgagtcccccatcttctagcacgtcgttttcttgctgttcctgtcttctggagccaaaaaatgtggctcaaaggccgcttgggacctggctggggatgtgagaaactctgttgagcccctgaccagaaagagtgggggatgcgggatgtgctccacctggattgtatcatctgcctctgacacttggtggcatccctgagcctgtggctctcttctgccactccttcaagaagcaaagctgagctgcatgcacacaaccctctctaccagcaaggaacacgaacttcccgggtacacacggcaaactaaagcttaaaatacgttgggttccagaatgggcgtcaggtaaattcccccgggtttgttttgccgttgttaaagctgggacaagggttaactggtacaagcaggactgtggctagaggaatgtatgctaaggtacctgactttgtgcccgacatgtattttaggtcctttgttaatgatagttagcaattattcttatagaaatatgtcttggacctggtttgaagcgatttcctaatattgccattgtatccgttttttatccagacaacctcgtgagataattaggatcttagaaggcaagatggctcagctggcaagcacatttacacattaagatttacaatctgctttcaaacatcagggtcctcatggtaaaagagagaactcctcctgtaggatgctctctgacttccacctgccacctgttcctacttcatcagaatggtcagaaacggggcgtggtcagaacggggtgaaagggaggggcctggactcgataccaggtgacagaaggctggataccttagagggaggggaagggtatgactgacctgagcctcgtgttctctaaagccacattccagaagggccggaggagagaggggagtggagggcagttgcttgtgaatcaaggaataaccacgatgatgaaaatggtcctaataatgtaaaaataaatgctaaagataattattgccttcatcatttccattttagacaagaggaaatggagtcatgtagtttcccaaaacggcacgtctagtcagaggctggactgacatgctatatttctgattgctgctgtaacaaacgagagcttcgaaggcaaaatcagttccctgtctcacagttcccggagtcagaagtccaagatgggttggcagggttgcattctttctggagaaatctgctttcctttgtagcttctagaggcctcccaagtcccttggctcatggtctcactgccctctgatcttaacacctctctctctctctgtgtgattctctctttctctgtgattatattgttatgactttgacaatcacagacatgcttctacttcagaaaaactcccagaagtctcctttgtcatgtagagtcatagatttattcataggttcccatgattcaggcatggaagttgttgagcggaacagggccgaggctaggctggctgatgtctgtactgctaaggctggatagggagtgaggtccacctgtgtacaactgtatagaaaaggggaatgtctgatgaaggatagtgcaggcaagaaaaaaaaaagggggtggtggtggtggggagctttgagcaaaaccttaaatgatatggcaatactttctgtgattggtcatgtgggtcaggagcggctgggaacaggagctgagatgatcaggaccttacttagatatcatgatcagataaagtaagcaggccggggtagtggctggcatgagagctcaccttgcccaatccctcaagtttaaagttaaggaaagtccttcctaggggccacaggttcttgtctgagagcacaccgtgagtaagcagaggggccagatagaagacttgcgtggatgcgggactgcaatagggcacttcctgttggggaactgtgagggctggtggaagctagagcatccatctttcctggatgcaaccaacacctacctgcttcctgtccctaccatttctttacgtctgcattctcccttgtggccacaggatggcgccggaagctctgctttagacctgtatctcagcaccctagcaggtgcccccctgccccctggagcttgggctaatgatggtccttccttttaacaccaagggttttgaactgcaaagaggtccgtgggccagggaggaagtctcgggtaactaagatggaagacatccttcacacttggtccatttccccgaatcaagcacactttctcagggttggatcttaccattttattttggactggagggcaccatcgattcaacctctgttaacttgcgggtctgatggtaaatgttcccctttcctgcgagcatttaaagtttatgaggagccaacagggaagagagagggagagagcaatggttgatgcgaagagaacacatggaagggctttagacaggttttagacagccaagggggtaggagcgttgtgtgaccacgtgattctcaaggcaacactgtgaggggtttggagcatagatcctttcactatcagaggaagccactggtgagagaggggaagacagatgtcccaaatcactcaccaagctcgtaatgtcctggccccttcctaactcatcagaatggtcagaaatggggcgtggccagaacgggacgaaagggaggggcctggactcaataccaggtgacagaaggctgtataccttagaggagaggaggggaagggtttgattgacaggagcctcgtgttctctaaagccacattccagaagggcaggaagagagagggagtggaggacagttggtgtgtgaatcaaagaatagccacgatgatgaaaatggtcctaatagtcaccgtgactggcgtttatggtgattcacaaggaagtttcccatcactttgcagctcagcagagccacgtgccacccaagggggattacagggcagtgcggtggctgctattttactgaagggagacacgggctacagaggggagggtgcctcgttcaagattatacgtccaattactgccagcgctgggctggacagagacctcctggctcccagccacacatgggctgccccacatgggctccagctgtggccagccagaaagaatggggcctttgtcagagctgaggatcaggcacaagcctcccgnnnnnnnnnnnnnnnnnnnnaaacttttcagtcctcctgctcaaagaaaaggagccccttctttgtgagtaatgtccactgagttcctactgtgtgccgggcttctgccaggcacttttatcttttttttttttttttttttaagatttatttattacatgtaagtacactgtagctgtcttcagacacaccagaagagggcatcagatctcgttacagatggttgtgagccaccatgtggttgctgggatttgaactctggaccttcagaagagcagtccggtgctcttacccactgagccatctcaccagcccccccaggcacttttatctttgtggtctctaccacaccttcacccttttgtgatggattttattttctctgttaccttcctatcccgcgttcaaaatggattgtgattcagggtggatatttctttccagatttcattagtgtcttgtgactttcaaggaaggtcatggcaggatggtggtagtgactatccctggaattttgctgtctttaaccagacattcttatattaaaaaaaagaaaactaacaataaaaatcctactatgcagaatatgcttgtgttgctcttgatgagcctgcgtctgggcccagggtgtccttgccaagcaaaatagaatccctactgtgttccatccttctgtcctgcttacgcattatctcatatgtgggaaatgcacagtggattagagagtagagaggaaaggacagagaataaacaaataccacctttaaaatatccgaggtgagttcaatgccaatactgatagataaaaactagagcaagaccctagttacattctctggtagacgccagccacaagcctcctcttccaggaagtgtcccatctgtcccgaaggacctggttgtctcctggagaagaggactcatgggtccttggatctctctggtgtctgatggtctatgtacccattgaactttcttatgctctgcagcttagagaggggtggcctccagaccccagaaataaaacctataattaaccaggaatactgtctgcatctctatagttcaaagataaatagtgctatctcaagcttcataattccaatcattggaggacattttataagactttggtacacttccatattactctctaggagtacagctgtattttttcccaacttgggttttaagtaatttcaaggaggacatgtttctcatagcaagaacaaagttttaaggccaggtctacacgagcttgagttacttctctgccactttttttttttttttttagctgtatgatgttaggggaaaaaaaggtctctcttaaccctttgaactttaacttctctgtgagataatgacagcacatccccaattgcaaatcccaagcctgagtgcagggattcaacgtgagcatgcacaagaggcacggttcacaggacgtcagtaattacagggatgacagcaaacagtcatttgcgtgcttgctgtgtgccaggccctagacatccatcattgtcgttaatctcagaattggctcacagagtagatgttgtaacgctccccattgcacatccgggaaggggcaaaattagcaccgagctcatcccttggtgctgtgcctgtgaatggcagcagggtagaaaagaggccaggaacttgaggggtctctctctgtgtctctgtatctctttgtctctgtgtctgtctctctctgtctctttgtgtctgtgtctctctgtgtctgtctctgtctctctccctctctccctgacaaggttttgctcaggctccattggagcttgctctccttttgcctctgtatcctgagcactgggattacagccaagtatacaccactctccccagccttggagagccttacagagagatttcctgagacccgggaaagagtcaagaaagcatgaccagctctagcttgtaaactgggacaaaggaggaagctggacagacctctgcttctgagataaactagaaggtgtgcatcttgtgggtgtaggagaccacggaggcaggggagagcacagcaaggaagctttgttcccccaccccaccccccgactccatcccaatcccaaagacagggcttctctgtataactccagctatcccagagctcactctgtagacgaggctgaacttgaattcacagagatctgcctgtcccagtgctgggactgaaggcatggaccactatggtgctcttatgaggaagagtatagggaataggagttaggtggcaaagaactagttcagtgggttggagactaaagcgatggcagtcatgcacctgggaaggactgtaggccaagctgtgctagatcgtcatattaagaaatggatgtgaaagcagaaccttctcccctccatcttgggaatcatttaattgaggaaattacaggtgcttcaaattcagtttcacagtcacatctaagggtagcacaagccaggtttcccagtggattacacagggcatctgaaagtaaatgagtcaaaggacatcaaggtttttggtctgattgactcaggatgatgtcatcgtcagagacaggaaaaggtaaggcagcccagggattcagtattagagctattaaacgggagacgtgtaggaagcactcatgttgagaaatcagaagtcagttggatttgtgagctggaagtcaggagagagactggggaaacaagccatcagtgtgtagctgatacagaggctgcacagtggatgagatcagatgggaagcaaatgtgtggatccagaagaaccaaacctatgcttgccctcctggctgccctggatgcagagactggggcggagaggagcaattagcgggaaaatctgaggagcatctggagactggagaggaaggggtcaaaccatgacgttatggtgtcctagaaacaactgtgaaggaaactggtgaaggaagactgggggactagcgacagtaactgagcatggcgtttagcaacccaaaagtcagtagtgacttggcagggacacaatggagggatgtgaagttggtcatcctaggaggcataaaagagagaggatgggaggaaaagaattagagattttatacacacacacacacatatgtatttgtgtgtaaatatataagacattgttatatatattatatacattatagacagattatatatgatatataatatatgtattttatatagggaaggtatatacaacatagagatttttatgatatatattatatgtaatatatgcatagttatatgatatattatatgtaatatatggagagattatatataatatatatgctaaataccatatatatattatagagagagaatttcttttttgttaatcaagacatagtctcaatatatagctctgcttggcccagaactcttttgtagattttggcttaaagatatccacctatctctgccaactgaatgctgggattaatcaccaggttcggtgagtatgggtggagttttttttttaaataattgtgtatttgttgagcttatagtataattgcatcatctcccattatccttttctcatgccaaaacctttcctatatccattttctgcaaataagcaataccctacctgtccttggctcggaagtttaactgtagagataaacttaacaaatgtgttagggaggtgaagagatggctgttcttccagaagcccagagttcagttcccagcgcccacaagggggctcacagccagcggggactcctgtcccagcagatgtgatgtgatgctctctgctggccacctccagtactgcatgactatggtacacagacatacgtgtagacaaaacactcacagtcaatatttttgttaaagaatagttttaaatctatagaacgccttgagagctgtggaggcagcatgcggtcttcatcctctgagtgtctctctcaacgcagatgcacctgtggatgaattgttagagctccagagtattttttttttaacatttcctcgttttcccccaatattatatgagtctatccaggacttattcctgtgtctccttagactcttccagaatgtttccatgaccttccttttcttcctgatagccttggtcacttaaaatttacatttatttatttatttatttatttatttatttatttatttattgtgtgtgtctgtgggggtacatgtattctagggtgcacaagtagaggtcagaggacagtttgtgggaatccattctctctttcatttccactgtgtgagctccagggcttaaactcaggttatcaagtttgtttgtttgtttgtttgtttgtttgtttgtttgagacagggtttctctgtgtagccctggctgtcctggaactcactctgtagaccaggctggcctcgaactcagaaatccgcctgcctctgcctcccaagtgctgggattaaaagtgtgtgctaccatgctgggttatgtcatcaagtcttgttggcaagtgtcttcatccacggagctatctctctggcctgactttgataattttggagagtgtaagttaggtgctttctaggttatttgttaactggggtccacataatgtttttcatggttaaaaatgggatataaatttttgcgaggtagaccaggggcggtgaatgcactattacaagaggtagcttgaaaactttgtgctaggtggtactggggctaaaggacaagtgttaggagaagtttgagaccccgtacaacactctagtcacactaactctacctgaggggcatccaagtgatgtggaagagcactgatctccacaaaccaaggaaggaaagggaagaagaggtaaacctgggcttcgatgggcttcctcttagagcagtgtccagcctttgctgacaccggctctgggtacaggggtgagtcttcaactttttctgttttccactttgttcttattggcctcttgaggtgtttattatattccaggaaccaaggtcaccaacggaacagagagaacacaacacttacgcaggggtgtgcagtttcaaagcagtgagatcaagccggggtagtctgtcttcacagaagatcagcgtgcctcagagtgtccattgtggtctccgatctgcagatgtattaaagggaggtgggaaaaggggaagggacttgtttggggacacaactggcaagtgacaaagtaagacctagacttgaggcaagtgtaaatcaagcttagagtccttgccaccactggaaagatgctcaagtctgccatacatatttactagtgtgtgctagggagtatctacttggtgagtgttctcagccctcaggtatgaggcctggagtctgttctctgtccttcctgctattaatgcacacagacaaaccagttagtcactgagaacgacactaagtccctttctgacatacggatgagagtgagcttattactgtatttttcttggaaaatggtttttccataagcattaagaaacttacatcttgggctagagcgatggctcagtggttaagaacactgactgctctttcagaggttccaagttcaattcccagcaaccacatggtggctcacaaccatctgcgatgggatccaagtccctcttctggtgtgtttgaagacagctatagtgtactcatgtacacaaaataaatagataaattaagaaaagagaaagaaacttacatctcagccaggcagtggtggtgcacgcctttaatcccagcacttgggaggcagaggcaggtggatctctgtgagtttgaggtcagcctggtctacagagtgagtgccaggatagccaaggctacacagagaaatcctgttttgaaataacaaaaccaaaagagaaaaacaaaacagaaaagtaagaaaaaaatctttacatttttcatttctgaacacatctactctgggaactatgggctaatgaataaatataaaacagaggagatgtttgtattttaacaatatatgaagaacagctacaagtcaatcatgtgaagataaaacagacacacagctcaagactaactaaggactatataggaagggcctatacaggaggagaaaatatcattgatcatcagaaaacacaaattcaatccacaataagatatcgcttcatgcccactggagagtttaagatgtaactctgtgaagtgtccatacgactgtggaaaacatttcctttttatgcagttatggggataaaatccagggcctcacacatgtgtggcaagcacactgagccctgcaagtgggccctgatcctcctgcctcagcctctccagagctgggattaccagtgtgtgccaccatgtctagttcctggaactcttgcacacagctaacgatacactaggatcaccattctttgcatatgttgcagagtagtacagttactttggaaaacatttggtagtttacaataaaggttaaatatgtgcccactctctggccagcaattcatttcaggtgtgtatgttcaaggacgtacatcgacttttattaaacctgaactcagaatattcgaggcaggaaaaatcca

SEQ ID NO: 1308 - DNA, 2193 bp, Mus musculus
ggcccgtcgctctgtagccgcacctctgagctgtccggcaggctcagctgcaggctgtgacactgtggttcgtcatccttccaagcaccatgagaggcccctgctgctggccactctctctgttgctgctcttcctgcagtcctgggaaactcagctccagtctgcaggtcctaggtgctataatgggcccctggatttggtgttcatgattgatagctcccgcagcgtgcgccccttcgagtttgagaccatgaggcagttcctagtgggcctcctccgcagcctggacgtgggtctgaacgccacgcgcgttggggtgatccagtattctagtcaagtgcaaagcgtctttcccctgggcgccttttcgcgccgcgaggacatggaacgagccatccgcgcggtggtgccgctggcgcagggcaccatgaccgggctggcgatccagtacgctatgaacgtggccttcagcgaggccgaaggcgcgcgcccatcggaggagcgagtgccgcgcgtcttggtcatcgtgacagacgggcgacctcaagaccgagtggccgaagtggccgctcaggcgcgcgcccgcggcattgagatctatgcggtaggggtacagcgagctgacgtgggctctcttcgcaccatggcttcgccgccgctggatcagcatgtcttcttagtggagtccttcgatctcatccaggagtttggcctgcagttccagggccgcctgtgcgggaaggacctgtgtgctgagttggttcatggctgccaacacctgtgtgtcaacgccccaggaacattctactgcgcctgcaactctggctacaagctagcaccagataacaagaattgtttggccttggatctctgcgctgaaggaacccatggctgtgaacacctctgtgtcaactccgtggactcgtatttctgtcgttgccgagctggctttgcgctccagcaggaccagaggagctgcagagccattgactactgcagctttggaaaccacagctgccagcatgagtgtgtgagcactttggcggggccacagtgtcgctgcagagagggccacgacctgctacctgatgggagaagctgtcgggtcagggacttctgcaatggtgtggaccatggctgtgagttccagtgtgtgagtgagggtctttccttccactgcctgtgccctgaggggaggcgacttcaggctgatggcaagagctgtgaccggtgccgggagggccacgtggatcttgttctcctggtggatggttccaagagcgtgcgcccacagaacttcgagctggtgaagcgcttcgtgaaccagattgtggatttccttgacgtgtctcccgagggcacacgtgttgggctggtgcagttctccagccgggtgcgcaccgagttccccctgggccgctatggcaccgcagctgaggtgaagcaggcagttttggccgtggagtacatggagcgcggcaccatgacagggctggccctgcgtcacatggtggagcacagcttctctgaggcgcagggcgcgcggcctcgcgacctcaacgtgcctcgcgtgggcttggtgttcactgatggccgctctcaggatgacatttcagtgtgggcagctcgtgccaaagaggaaggcatcgtcatgtatgccgtgggcgtgggtaaggctgtggaggaagagctgcgtgagatcgcatcggaaccatcggagttgcacgtgtcctattctccggactttagcaccatgacgcacctgctggagaatctcaaaggcagcatttgcccagaggagggcattggcgcggggacagagcttcggagtccctgcgaatgcgaaagcctcgtggagttccagggccgcacgctgggggcgctcgagagcctgacgcagaacctggctcggctgacagagcgcctggaggagctggagaaccagctggctagccgaaagtgagggtcgcacgctgtctgagcagccacgcgagaccgaggccgagccccgcagcctggaccgtccaggagggggcgctggcgggccccacgcgctgccttcgagctggcctcacctggaccaggagccagatttaggggatggggatgaggggatggggaggtgctggtggggaaggactgctacactcgccgcgagctttgttggatttctttttttgttttccttttct

SEQ ID NO: 1309 - DNA, 1875 bp, Mus musculus
atgagaggcccctgctgctggccactctctctgttgctgctcttcctgcagtcctgggaaactcagctccagtctgcaggtcctaggtgctataatgggcccctggatttggtgttcatgattgatagctcccgcagcgtgcgccccttcgagtttgagaccatgaggcagttcctagtgggcctcctccgcagcctggacgtgggtctgaacgccacgcgcgttggggtgatccagtattctagtcaagtgcaaagcgtctttcccctgggcgccttttcgcgccgcgaggacatggaacgagccatccgcgcggtggtgccgctggcgcagggcaccatgaccgggctggcgatccagtacgctatgaacgtggccttcagcgaggccgaaggcgcgcgcccatcggaggagcgagtgccgcgcgtcttggtcatcgtgacagacgggcgacctcaagaccgagtggccgaagtggccgctcaggcgcgcgcccgcggcattgagatctatgcggtaggggtacagcgagctgacgtgggctctcttcgcaccatggcttcgccgccgctggatcagcatgtcttcttagtggagtccttcgatctcatccaggagtttggcctgcagttccagggccgcctgtgcgggaaggacctgtgtgctgagttggttcatggctgccaacacctgtgtgtcaacgccccaggaacattctactgcgcctgcaactctggctacaagctagcaccagataacaagaattgtttggccttggatctctgcgctgaaggaacccatggctgtgaacacctctgtgtcaactccgtggactcgtatttctgtcgttgccgagctggctttgcgctccagcaggaccagaggagctgcagagccattgactactgcagctttggaaaccacagctgccagcatgagtgtgtgagcactttggcggggccacagtgtcgctgcagagagggccacgacctgctacctgatgggagaagctgtcgggtcagggacttctgcaatggtgtggaccatggctgtgagttccagtgtgtgagtgagggtctttccttccactgcctgtgccctgaggggaggcgacttcaggctgatggcaagagctgtgaccggtgccgggagggccacgtggatcttgttctcctggtggatggttccaagagcgtgcgcccacagaacttcgagctggtgaagcgcttcgtgaaccagattgtggatttccttgacgtgtctcccgagggcacacgtgttgggctggtgcagttctccagccgggtgcgcaccgagttccccctgggccgctatggcaccgcagctgaggtgaagcaggcagttttggccgtggagtacatggagcgcggcaccatgacagggctggccctgcgtcacatggtggagcacagcttctctgaggcgcagggcgcgcggcctcgcgacctcaacgtgcctcgcgtgggcttggtgttcactgatggccgctctcaggatgacatttcagtgtgggcagctcgtgccaaagaggaaggcatcgtcatgtatgccgtgggcgtgggtaaggctgtggaggaagagctgcgtgagatcgcatcggaaccatcggagttgcacgtgtcctattctccggactttagcaccatgacgcacctgctggagaatctcaaaggcagcatttgcccagaggagggcattggcgcggggacagagcttcggagtccctgcgaatgcgaaagcctcgtggagttccagggccgcacgctgggggcgctcgagagcctgacgcagaacctggctcggctgacagagcgcctggaggagctggagaaccagctggctagccgaaagtga

SEQ ID NO: 1310 - DNA, 32055 bp, Homo sapiens
atttttagtagagacagggtttcaccatgttggccaggctggtctcaaactcctggcctcgtgatcctcctgcctcagcctcccaaagtattgtgactacaggcatgagccattggcccggcctgggatagctgatttctaagggtcttttttcttgggattccagaatttttttttttttaacattgtgcaattctatgctctaataatctacaattttaatattctttgggaaggaatattcttggggaaggaataatacttgctattttccacatattataattctatctcgtaacattctatgataatattcttttgggagtactactgcttaacgataattattattttccacattctataattttccacattctgtgtctttatctgtgcttcgaatagtctttgctcattaattctctgctctctattacctatcatgatttttatttacatcctacaattttatatcccaatttatttacttactttttttgagatggagtcttgctcttgtcacccaggctggagtgcaatggtgtgatcctggctcactgcaacctccacctctcaggttcaagcaattctcctgcctcagcctcctgagtagctgagattacaggcgcccactgccatgcccagctaatttttgtatttttagtagagatgggatttcaccatgttggccagtctagtctcgaactcctgacctcaggtgttctgcccacctcagcctcgcaaagtgctgggattacaggcatgagccaccgcacctggctatatcccaatattttatgactctaaaattctttgggaaggaatattgcttcatactattacttattactatttttctacatcctatgattctgtcctgggagtctatgattttaatgttccatgggaggctgctcaggaagtagcaaccatggtgagggtgatgatcttacattctgtggttctctgcattctccctttccaggacacttggtgctggtattctctgcttcttacctgaaattgcaccaccttctctgtggcaaggcataagtaggtgccaccccctcctgggggactgcctggaaactggaatgcacacttgtgcagctgggagatgggctcatccacatcaaggagcgcacactgttttgctactttacggatgatctgcaatggaaggatggtaagaacagtggtggcaaggagcccgggcgtccagaggctgccctcctagccggctgtctgctactccaatagccacacaggcactagcagattccccctgccctttgacttctgtctggtcctacgcgacactgggtgagaacaggtgtctccatgccttggggcctcactctccagccctgcccgtgtgtgccacattctctgcatggatctgaggggacccctccaggcatgccctcccttcctataccatgggaggtagtgtgatgccggtgaccgtgcagacgagctgcaccagggagccatagcgaacgtagccctctcgcggtgggaagtctccttgggcagagtgcccatcagctgggggacaaaaaaagcaagggacaaggttttcagcggcccccaagcttctgccttaaaccctgccttgttgcctctggctcttcctcacatcacacatgggccctgcgggaaagcttggtactcaggggagccaactgaaggttctaattctggagaggccatttgaggccatcctcacaaatgtctgccctgggggcaggggttgggggcaggcagcttagttgatatatggggaaagggcatggataagggagtcagaatagcttggaacagtcaccagctcactgggactgtagtcaagtatttttgtgtttctgagccttaatcacatggggcagagtttaccttccttaaggagttgtggtggaggttaaataagctaatgcatgtgaagtgcccagctccagggcctgcagatgtcattacccaggtggagcgtgaaggcagcccactgtcgtgcactggccacaaaggccccatcctccacagagaggtagcgtgtggagaccgtctgagagcgcaggcggttgaagagggagacctttgagccggaggatatgcacactgtgagggtgagggtcagggttagggtgagggtgagggtcagggttagggtgaggggatagggttagggttaggattggggttagggttagggtgagggttagggtgagggtgagggttaggattagggtgagggttagagtgagggtgagggtaaggattaggattagggtgagggttagggtgagggagggggtcagggtgagggttaaggttagttggtgctatcagtgccctgtcctggcttggttccttggactttccagacagtttccaatcttctgtccctgtgccggcctggctaatgtgcccacaggcctagatacactgggcattcccagttcacagctgtttttccaggacctgctgcagtcctgctttggaacctttgcctgttcctttgctgtctggacatctttcagttcaacaaacaaaagtaaaacttttttttttttttttgagatagcatctcaccctgtcacccaggctggactgccgtggtgctatcacagctcactgcagcctcgacctcttgggttcaagtgatcttctgatctcagcctcccacgtagctgggacaacaagtgcaggccaccatgccaggctaatttttctttttctttttttttttttttttttggtagagacaagatttcgccatgttgccctagctagtcttgaacttctgggatcaactgatccgcccaccttggcctcccaaattgttgggattacaggcatgagccaccgtgccccacctatgtcacttttagtctgtccctagttcaactcctgcctagttcaacttttgtctgctctgggaccccaactcccaacctggaatttggtatctgtccctttcctctctgcttttcatccttcaactcttctcatccccaggcctgggccgcacccactcatccagactccttcccctctcggctccgactccaccttttccactctgacccctaagcccagcctacccccacctccgcgccccagtttagccgttctgggcttggttgcacctccccgcccgggccgggggtcaggccccgccctgctcacgatcggtgtttttcagcgactgcttcttctgcgagggcttcgagatgaccttgataaggcggctgtggaaggtacccagctcccggcccccgcgcagcaccagccgcagcaccagccgaaagtgcttcctcttgtctgcatctgagatgtacagggtcttggcgcagccgaattcctagggggctcacaggtacagggccatctcatcccagccctcccccgtcggatgaaccaacctctcccagatatcggacgtccgccccgtcggaggtgaccagaagctccaccatccaggctctcaggctcggccttaaggcaggaccccggcctcccggtctccccacctatctcttggctttcggaggggagtaaaggagccctcctttcccaggagaggcagggatgggagcaggaatcggaccccttcccgtgcgctctcaccctggagtccggctgctgctcgaaattcagcttctgcgtctcagtggcgctgccggacgcgctgtccagtcccatgtaaccgcagaccgtgggccccgtttcccccgcctggtgagctggaaagggacgcgaactggctctgcaaggactcgggaggacgcaggtgccaggcaagcttagcgctcgccgccagagggcgcggggagactgcgcctgcgaaccgccccgtctcgggcccaatctcgtggtcctccctacagagcaggcggccggcagcccttgattccgccctcaccttgatcctgccctggcttcaccctccagccaggccccgagaggtagacacagggcggggggcagaagaacctgcggagataagtgagtgttggagtcgtgcatccatctccacttggctctcctgtaagcacggcaaggtagtagcataaacccagcagaaccttcgtttcctcctcccgctccccccaacgctttttcacgactgtaaaccccattcatagccaaaccttattgtttttacacccctcattcaactcatcagaaggtcctgtccactccaccttcaaaatataatatatccagaatccactggcttcttaccacctcgcccttcatcccagccgccattactttttgcctggaccacagcatcagccttcaaactggtctatttccagaaagttctgtttctatctccttcccatttcgcacagcagccagagtgctccttccttccttccttcctctctctttctttctttttttctttcattccttccttcctgtttctttctttttctttttctttttttttttttttgaggcagggtcttgctctgttgcccaggctggaatgcagtaacttgatctcggctgtctgggctcactgcaacttctgcctccccaactgatcctcccacctcggcctcctgagtaggtgagactacagacacaagccaccacacccatctaatttttgtgttttttgtacagacatggttttgtcatgttgcccatgcaggtctggaacttctgggctcaagcaatctgcccacctgggtctgccgaagtgctgggattacagggatgagccaccaggctggccagagtgttttgttaaaaacatgagtcacatcatgttaactccttaaaatcctccactggtttaaaattcaaagtcctcctgagatctgacccctgcttacctctctgacttgtttcctacaactcctccctctgatttcagccactgtcatttcttttgtacctcaaacaggcctaattggtacagcctcaaggtcttcccattttctgttgccctttttttttttgagactgagtcttgctctgtcgccaggctggagtgcagtggcatgatctcggctcactgcaacctccgcctcccgggttcaaccaattatcctgcctcagcctcctgagcagctgggattacaggtgcccgccaccatgcccagctaattttgtattttttggtagagagggggtttcactgtattggccaggctggtctcgaactcctgacctcaggtgatccgcccgcctcggcctcccaaagtgctgggattacaggtgtgagccatcgcgcccggcccttctgttccttctaattgtagcacgctttccccagatattctcctgtctggctccatttcagcattcaagtttcagttccaatgttacctcccaaaaggtctctcaacctccttgacctttctagctaatgtcccccctgccttcagtttccgtcaaatggcctcgttcagttttccttctagtgctcatcataatctgcaagtatcttgtttcctgacttgtggggagtttactgtctgtctcttccacacttgagtgagagtgtgggctacagagcaggggctgtttctgtcttgttcagctgtatgcccagtgcccagcagtacccacagagcctggtgcatacatgacaaacactcagtaagtagttgttgaatgaatgaataagtgaatcaatgggagaatgagtgaatgaatggagacaggagattcacagggaatctcctgctgtagaactatagaccaaagtgggggctaatggtggctgagggtcaaggccctggtcgaccaatagctgagatctcagccctgaggcctgctctgcgtctaaaagaggcccaatgggtggatggaggaggtgcatagggctgacagttgcagagacctgggaggggctgcggaggcacctaccgcttctcatttccgtatgatttctgggccaccttggcatgcaggatccgcacagtctgttcacactgttgctgcaggcacctgcgcacgcctcccctcagaatggtggtgtgctctggggatgacctgggagtagggcaggcaggtcgaccagccacaggagggagaagggtcaaggtggcacagggtccaagcactcaggttgagtaaaatgaagtgagcagggggttagagtgagtgggagggtggggctgctctatatcctgcccctgtggggtcaggaagaggaagcattaggtaaggaggagacttggctgcaaattgtaggctaaatatttaggctgcaaggtgctcaacgaagcctgcatggaacccatgggaccacccaggttccactctgtgggtctggcatcatgcccattggagcccagggccatagggacacgtggctgtgacacaaaggctgcacttatactggccttgggatggagaagagtattttagggctgatggaattggtagagatgaagcttccccaccctggggaaggcagggtggggggtgaggagggaggggaagggagagcctttcctgggctcctggcctggagcgctctctagcctcctgcctgcaaacagaaaagggcccaaaaccttgtcctcaggatgggggatggcctgggggaatctgagcctttctggggccaaagccatattcttccctttctcccatgagaagtggcctgttgctgtgtgggctttcctacccttgattacaggagtcaaggcagatgacattggtcctgcagagtgagccaggttagagcctagaggtctggtggcttcttaacctgggggtcttgagcggtgtgggtgggtaggcccgagcaattgcagggagcaagtagaggaggggaggtgggagagatttggggggttagcaggttgaggcccaaggagagccatgaaaactgaggctgtccttctgagcccttattcctcttggcaggaccagagtctctcctcactcctggaggggacagcgcaagaccgcaccctcgaaagccaggccagacaggcagcagccacagccaggaccgctccaccccttggggctctcctcagggaagtgccttctaagcttccaatgaattccggctgtggagtgtggctgccccggtctccccagtctcccgctgtagctgacttccagcctggcccgcagctagccctgtctgcagctccaagcgtggtaggagcagggggtgctgggtttgccccccctcaggaggaaggggggatccctccctgccagtgggaggggttgcagcctgcacttcccctccccacccgccagccctgggttaaatgcggccgttgcctctgtgtgctccagctgcctggcagtccccacctagggcacgctgccacgccgccgttacctggtccaagtgcccgggaggctccgcctgtcggcttcgctctgcagctgcatctctgatctgtcctgcaggctcaggtgagtcaaaggattgggaggcactgaggggtctgcaggggagtaggcatcaagccaggtcaggcgagtgtattttagcagagacgctgcctagggtgccctatctgatttgcagtgcccttccccacttctgcagggtcctttccaaatcgagcccccaccctcaaagccatcaaaataggatcatcccttttctactctcatccctccaggaaccccctgaaatgtccctaagggacttttgagaatttatttacaggcctctcctcccttgctgctccactccctcaacctcacctcagggcatctctgaatctttctttttttaatgcaaggattaactcctcagaggaatcccaggttctagtatcagtcctgccacgacatcgccatgtacccttcagcaagacactaccctctctggacctagttcctttctttgtagaatgaggggtttggaaaggtgatgaactttgaggcatttgctattttgactttctaggattcctggggtggaggcagggtgccaggtgagaagttggctcagactaagaatgggatgaggggaaccttaaccaagatttaggggcccagaggcatctccgggtaggaaagtatgggaggtggcagaggccccttgtgccttagccctcatgctgcccagggatgttggctttgcctgtggcccaagcttgacaagggttccccgccctcccacttccaccagcgctgccacatcttgcttggtcaccctcccacgacgggccctgccagaggatttatgttcttctaccaggcctgggaggggaaaagggagaagaatccgggatgagaaggtcgcctggagtgagaagcaggcactggcctcgctcagaataggcgcattcacggaattggggggcgggggcggagctgctgttgggttaggggcagctggccctctctgccaagaaacagcaacagaaaaatggctaacacagcttcagcatggggcgcggcggtggggtaggagctggaaggaaatgaggtttagtgaattctaggcgccagggggcctcaagagagagaaggggaaccaggagccctaggttctaatcctgcttttgcagttcggcgggctgcctccttggggcttagttttcctatttgtatagtggggagggggtgggggggtggtccttcgtagttctcacggggcgtctccggggcctcgggagggtaagcgctcacctgctgcccctgcggggtccatggtggctccacggggccccagccgctcacccgccgccctctggacgagtccagtgctgctgtcgctggaaccctgcacacccctgctcctcggctcttgcgcgggttatatcctgtccaggccttatctccaaggccccgggccccggccccctgtttgctcggggtgggcgcacctgctgggcagatgtgggcttcccacgccccctgccatctcgggcgccccctggcggtcgctcctgagagcaggcgggaaacaggcgccaagccgcgcgttctcgtgcgcagtgggttttggtccactcgctgccacgccaccacgctcagccccgcaacagggcgcagcccctccctgccgcctgcggttgggcagtgcatgtctgtgtttgtgtgtgtggaggggtctgggggggttggcgagttgcaaagacagccacacagaagcctgtgtgcgtaggggagtgggccgaggtggggaagggcttctgtctgcagaggttcgcctggcaggaggagaggcaccaaacgcccaggctggctcacagaaactagcaggcgtgggattgtatcctgccgcagccactttttggccgaatgactttgggtaccagcgcttaacttttctgagcctcaatttcattgtctgtatgatgggggacaatcacagccttagtcttacaattgcagagaggattaaatgccacaatgcgtgaagagcatttaacactgtgcctgacatttaaggaagacctgtttttttctgtttaaattttgcatatttgtatctatgtatctattcttatttaccattctcttgtgggccgagcgcggtggctcacgcctgtaatcccagcattctgggaggccgaggtgggaggatcacctgaggtcaggagtttgagaccagcctgaccaacatggcaaaacccgctctctactaaaaatacaaaaaattagccaggtgtggtggcaggagcctgtaatcccagctactcgggaggctgaggccggagaatcgcttgaacctgggaggcagaggttgcagtgagccgagatcatgccactgcactccagccgggacgacagagcaagactctatctaaaaaaaaaaaaaaaaaaaaaaaaaaagaatctcttgtgtttcccagcaatcccactgtgatgagaattttttaattctgaaacatttcaaacatacacaaaaatagagagattagtaaaataaacctgtaactgtcttccccctccaagtgcctatcacccagaataagagctctgtaaatactgttgcttttctattttccttcctccctccaggctctgacacctccattctctgtccccaagcgccatgagaggccttctttgctggcccgtgttgctgctccttcttcagccctgggaaacccagctccagttgacaggtgaactggggcccagccctcaccagtgggaggaggggagcggaagcaggtcctccctctgcagccagctcctcctgctggggagagggaagcaagggctttggaacatatgggactgggtttaagttccccacttcacctttctgggcctcagtttcttcatctgtaggatgtggcttagttttgggcgcatgcagaactgcccatggggtgtttaatttggaaaaattatttgaaaacatggaaaaaaaccaggaaattttacataaaaatccctgtttagtatttctcttgaaaaaccagggatctgctgacatccaattcgcaggggcatggcctcatttggatgcagctacctgcccaatttaggagtgataggggctctttgggtctccagcgtcctaacccaaccagttcatccatgttccctgcctggtccctgcaggctttgagtttgcgacgcttccttgccccctcgtcaatgggtaataccgcctcagaatagccctcagatctgtaagatgagggaatttgtgaaatctcctagcccaggtgctaggcacatgccgggcgagtgcatctgtctaatctgcgtttgctgtgctgggcgctgttatgtcggcatagcggcatttcccctgggtttcctagggggtctcctcggaggtgaggctttgctgacctaggagagtcctccctgatctccccgcaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtggtgagttaggagggcgctggagtgaagctcgaactctcaatccaaatgcttggattcctttcccaccacagtaaatcccatcccgtgggggtggccccgcgatttccaggtagagttgccctgacctaccgcaggctgtgtcagatttcagctctgaccacttctgctcagcctccatcaacaaggagcaacctataatttcttgccctacccgccacagcttaccacaggcttaatgtcaaattccagcaccaaccccctgcacacacggaaccagtgattctcaaagctaagagggatcggctgctccaaagagtcgtggccctcccacatggggatgacttctcccattatcatcttagctcctcccacaaatgctgcaagatctgttctgatctgttttgagtttattccgcccacctcgacttagcacctctccaccttcctacccactcctgcccctgtgtagtcctgtcccagcccactgacgtgtctaattgagtgtctcctcttctgagcctactcacaggggctccttaagccttattctttccctaagccctctcacttggtacggcccttctcaaattagtcatttccttctgaaagccatttgagggtgatgcctgcctctgaccccatccccatccagctctctcttgttggaggcttctgcccatctgttccctactgattctagtcctgtgtgtcctcagggaaggaccagtgtgctgaggggggacatggttgccagcaccaatgtgtcaatgcctgggccatgttccactgcacctgcaacccaggctacaagctagcagcagataacaagagctgtttggatgacagctatccctgtcctgcaatctcactgctcctgaaccttctttggctctccattgccccaacatcagaccaatgagtctggaagggcctttggcagtaaaagcacacctccatcactttacaggcctaagaaagaaaggtattgcctggggtcacataagtccctggtgggagcccacagttcagtgtgctttctgccctctttctccctgttttcaggccagtctctaatcaacctcccaaacttgtttctgttttcttcttttcttttctctctcttttttttttttttttttttgagacagagtctggctctattgcccaagctggagtgcaatggtgcgatcttagctcactgcaacctccgcctcccgggttcaagtgattcttgtgtgtcagcctcccaagtagctgggattacaggtgctggccaccacacccagctattttttgtatttttagtggagatggggtttcaccatgttggctaggctggtctcgaactcctgacctcaagtgatctgcccgccttggcctcccaaagtgctgggattacaggcgtgagccactgcgcccggccatttctgtcttcttacaggcacatccttacggtttctcttcttagatactgttggggggtcttcaattaggtgggtgtcccccctcatgccacccattcttgactctgcacctcagctctttgtgtgctgctcacctgagctgcccttgccactcccctctgcctttgcaaatctttcaagactctctctttttaagagatagggccttgctatgttgcccaggctggtctcacactcctgggctcaagagatcctcccgccttggcctctcaaagtgctgggattacaggtgtgagctgcttcttcatttttgtcttctgaaaagctatggcatagaataccttgcttattcaattcagttttttactgagtaccaagttagtattagacattgtgctaggagcattacacatgttattatctctcagcctcacaacaacctggaaaaagaaatcatgtaatcccaataacccagatgtcagctggggtcttcttgtttctagaaactaaaagttggcttgaactctgatttgatgactgtttaacattcaaatctctctccaagacctctggaaatcccccaagtgcttatcttctggttgtcacctcttgctgtgagcctctgctaaattcatttgatttatggatcctctctcatttctcaaccctgcacatgctgttcttgttccatgcatgttaatcaacctcttcgttggtttacacacttgtgtatgcaggggcatacacaagcgtgtatgtgctaagtaactcatagcgcgtgcacacacacacgaaaaactcattataattgaatattagacagctttgtttctgaaagtcctcagtcagcctagtacaagggatttttcacaggcagcctcaacccacagagttactcatcttcatactggctctcttgttcttttttttttttttctttcctctctccactctcatctcctttccaggaaccccaaatactcacttttttatacagggtaattatcttctctccagtccagctctcggccatctttgcctatccagatcatcaagatgctcaacagggcaatagttccccatcttccatggaaggaagctgtgaatagcaatcactgtcttccattatattcccattttgcaaatagaaaaatggaggctcaaataggtaaagtggccaaacctgtcctctgtaagtcagagagcatcttgaggacaggggccctgactaattaggtcaggatttttggggttggggcccaggcgtaggtattctttaaaatttccttaggtggttgtgctaccagagctgagaagggcagtcctgggcatagactgaccccatttcttcctcagccattgatctgtgtgctgaagggacccatggatgtgagcaccactgcgtcaattccccaggctcctatttctgtcactgccaagttggctttgtactccagcaggaccagaggagctgcaggggtgagcaacacccccaccctcccaccacaccctggactgtggcctccgagggctccaatcagaggcaacatcttgctgtttcttccctcctgccagccattgactactgcagctttgggaaccatagctgtcagcatgagtgtgttagcacccctggtgggccacggtgccactgcagagagggccatgacttgcagcctgatgggaggagctgtcagggtgaggagggctctcctacatttgtgggaggggtaagagatcttagctggtggggtccatcctgactcatcctgacctgtctctcctttcagtccgggacctttgcaatggcgtggaccatggctgtgagttccagtgtgtgagcgagggcctctcctaccgctgcctgtgccccgaggggcggcaacttcaggcagatggcaagagctgcaaccgtgagtgatgggcgggagggtgttctgttggcttctgccccattgcccacattcggagtgtccttgactttgccattgctgtggcccctaggctgtggtgtgaatgtctgtgtgtgttgtgggggtgacattggagggtgtgccattccctccttccatctctttcctacaatcctctactctgctgtcaatgttaatttaaaaatacatatttgatcacattcctcctttgtgcacaagccttctgtggctcaccaatgactacaggagaaagatcaaatgacttacccctaagtatttcaaatggtgagcagaaccacattaatgaataatgaaatcaaattactgggttacaaccaacattaaaaaaaaaagagtggaagacaatatagagtttactgcctgtagaaagagttatattatttctgaaattttagttctgtgtgaaatgtctcatgatgtattgtcattattattatttttactgtgggctgtgataaaaattttgaaaccactgccttaggtcatcacgatctagcttcagccaactccatctgcccatctcctgccacacttgaacatttcagtcttactggcctgcccctccccggatgtgtcaggatctccccagatcccaagcctctgcacgtgctgcatctcaccttctagactgtcccttactgccttggcaaactcctactgatctttcaagactgtcttagatcattcaggctgctatatcaaagtactgtagactagacatttagttttcacaattctggaggctgaggagtccaagaccaaggtgccagcagatatggtgtctaatgaaggcctgttttctgattcttagatggcacacctttcaaagcctccccacgccaacacacacacacacacacacacacacacaccaattttcttgctgtgtcctcacatggtgaagacaggaagcaagccctcttcgactcttttttttttttttttttttttgagactaagtctccctctgtttctcgggctggagtgcagtggcgcgatgtcggctcactgcaacctctgcctctggggctcaactgattctcctgttacagcctctggagtagctgagactacaggtgtgccccaccatgcttggctaatttttgtatttttagtggagatggggttttgccatctcagccaggctggtctcgaactcctaacctcaagtgatctgcccgcctcagcctcccaaagtgctgggagccaccatgcctgacctcttcagactcttacaaggacagtaattttactcataagcgctgtaccctcatgtcctcatctaatcctaattaacctccaaagatctcacctccggagactatcacataaaggcgtagggtttcaataaatgaattttgggaaacacactcattcagttcataacaaagatcagatagaaggccatcatctccatgcagccttccttaacaactccaggaagaatacactattcctaccttgggatccctgcatgatcttctcttctagcactttccttgaccagagcacatagcatgtctgacttgctctgctctgtcctcatggaacaggattatgttttaattatttcaaaacctttgaaaacctccccacgccaacacacaccacattttgggcctagcaactttcctggctcagaataggggaggtgacattgtagagtcattcaggagcatgggttttggagtcagatggacctggcttcatgtcttggctcagtcagtactagctatgaaatctggggcaatcactttatccatcagaacctcaggtcatagaaaatggggacaatattcaagcttattgggaggattgagaatatatataagcacttcacccagtacctaccacatggtaagctgtcggtaaataatgtttttgttattattattgttaatactggtagagtgcttagaagtgtgcctgatacatagtagatgatcaataaatggtagttattgtggtcattactatgattgttgttaaaaaaagatgcttttagcagagtggtttgttctaagcactgaataaatgtcaagggcgatgatgagggtgatgatgatggtgatggtgatgatgatggtgataattattattacttagcacactgcctggcacaggaaggactcaggaaatgttgtctgttatataataaatgtttgcgaatgaacgactagatggatagacagctgctgccagtccagaatctggtccctcaattcaagcttttctggctgtgcagggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggtgggcttggcatgggacacagtgggctggggttgggtcagacgctgggaggcagctttcccgaggcctggggcaccctctgagaccccggccttgcaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccaggtgagcgcatctctctcggggctcctcctctctctcattgcccgtcctctgatatctccccttcctattcactccctgcccactttgtagttatagccagaggttgggctcactagacagagctttgctactccaaatgtggtctgcaggccagcggcagggcggtcacccggtagcttcttagaactgaaacatttctggtgctctccagaccgaatgaatcagaatttccacttcgacaagattctcaggtgatttgtaagcatattaaagtctaagaaatcctagactaggctacctgtcccccaaatcagtggaggttcagaataatttgggaaatttttttgaaggcacaccagacagcatttgtaagtggagccacagcatatatccctgaacttgttagaattcaaccttatgaacttggcaaagtggcaggactgaatatattttaagtatgcaaagactttttttttttttattggggacaacatacctcataagtgcaatccctctacttcatcatctggtgctcagctgaggaaaaagagactgactctacctgtgaagaaggggactcttgaatcgcatgcagtgtactgtgctctaggtgatacagggaatgtctccagggtaacttttaccctagagactttagacactagcccaggcttaagatgtgactcttcttcccatttatcagactgcagctccagaaacagactaagtagggctggtttgggtctggagaatttgcctttttttttttttagatatatgtaggggggctgggcgcagtggctcacatctgtaatcccagcactctgggaggccgaggcggctggatcacttgagatcaggagttcgagaccatccttggcaacatggtgaaaccctgtctttaccaaaaaatacaaaaattagccgggcaaggtggtgggcactgaggcaggagaattgcttgaacctgggaggtggaggttgcagtgagccgagattgcaccactgcactccagcctggtgacagagtgagaccctgtctcaaaaaaagtatatataatatactatatatactatattatataatatgtgtttgtgtatgcatgcacatgcacgtgcatgtatatacatatacaaatatacacatacagtccttcccccaactctccttccctccccgctctcagccaattctaattattgtggctctttcagattaggggctctttcagagctcttcctatgtgactcttatgggccctgcagtgtgactttggacgagtcacttaccccacacctaccttaacttttctcttcggtaacaggagaggcactggctgcccaaggttacctctagttctagagttctaagagaagtctgggttttgtggttgaagctctttatcaattggtggtatgactgttccctgtctccaaccctttgtttagagaaacaaatctgtgaagttaggggtctttgctggattccagcagtttgttcatagtacatataagactaagatgaagagacaacttttaaatcattatggcagtgttttcaaaggttaaatggcaggtattgtgcttattatttcaccacctgtaatcctttttcttttttttcctaaggtacttttattgtagcattttttttttctatgtcattccctgtaatctttttttttttttttttttttttttttgagatggagtctcgctctgtcatccaggctggagtgcagtggtgcgatctcggcttactgcaacctctgcctgccaggttcaagcgattctcctgcctcagcctctcgagtagctgggacaacaggcgcatgccaccacgcccggctaattttttctagttttagtagagatggggtttcaccgtgttagccaggatggtcttgatctcctgacctcgtgatccacccgcctcagcctcccaaagtgctgggattacaggtgtgagccacagcacctggcctccctgtaatcttaacaatggcacatgcttatagaatttcagtgaatctaagataccattcattttaagattcatcactaccttatgtactgctaagaaaaaacatgtgccagttttaattgtaaggcctcctgcccaacccccaagatgttgatgtgtggggagatagagttggatcaggatcagtggttcctaaaaattaggtcacaccagaatcacctggtggacctttaaaaacacaaattgcagctgggcatgatggctcatggctgtaatcccagcactttgggaggccgaggtgggcagatcacaaggtcaggggatcgagaccatcctggctaacacagtgaaaccccgtctctactaaaaatacaaaaaattagcagggcatggtggcacatgcctgtaatcccagctactcgggaggctgaggcaggagaatcacttgaacccaggaggcagaggttgcagtgagccaagattgcaccactgcactccagcctgggagacagagctcaaaaaacaaaacaaaaacaaacacaaattgctgggcttcaactctagattttctaattcagcaagtctggggtgttgtctgataattagcatttttgataaattcctacacgatgccgatgctgctggtccaaggaccacactttgagaatcactggtctagttgaaatacactataaagcagtggtttccaacctttttggcaccaggcagtggttttacggaagacaatatttccatgatggtggtggggagaatggttttgggatggttcaagcacattacatttattgtgcactttatttctattattacattgtaatatacaatgaaataattatacaactcaccataatgtataatcagtgggagccctcagcttgttttcctgcagctagatggtgccatccgtgggtgatgggagacagtgacagatcatcaggcattagattttcataagaagcctgcaacctagatccctcacatgcacagtttacaatagggtttgtgctcccatgagaatctaacaatgccactgatctgacaggaaaggagctcaggttgtaataggagcaatgaggagcggctataaatacagatgaagctcccttgcatgctggctgctcacctcctgctgtgtggcccagttcctaacaggccatgggctggtactggtccatgtaatgtgctggtactggtccatggcctggggattggggacccctgctgtaaagtatttacttgaaccaggcagtgttctagatctgtgctttttcaaaaaggtaggcagtacctatttaattacaattgattaaaataaaatacattttagtcctttagtagcaccagtcatatttgaagtgttaaacagccacatgtggcttgtagctactgctttggacagggcagatgtagaacactttcatcattgcataaaattttatttggagagtgctacacaaagtgtggtccacagaccaggagcatcagcatcatttgggagcttattagaaatgtaccttctgagcttcttctccattctgaagcagaatctatattttaacaagctctcctgatgattccaatgagcattaaggtttgagaaacagtcttgtaagttgtgcgtgagcacacacacacacacacacacgtacacaggtgaatgaatcctcgaagccactaatgcgtacactctttcattatatccattttatagatgagaaaactgagcttagaaaggttagtgagtttttcagtatctcacagctacttagcttgggactcagcccaggtctctctaaatccaaagcccatatactcaaccataggcccagtgcagggaaatcagagggccaaagctagggcaatttctcatccccctgaccctctgtgtccggcttgcagaggagggcatcagcgcagggacagagcttcggagcccatgcgaatgcgaaagcctcgtggagttccagggccgcacgctgggggcgctcgagagcctgacgctgaaccatatcctttggggctggtggcgcgggctggagggaaagtgaagggacctcggcgaaccccaacggcctccttaaccgctcactggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggggtccgtttttgggtcttgctgcgccgcctgggggaggggaagccagacggagcgtgctgtggcggcgcccgggcggcgtctccttggagaaaggcgcattgtgcgggggtcgggctcgggggcaggagacccggcgctgcttccccctgcttgtttattcagccgagaacagatggctccttatgcaggctgcgggaagggagggggctcaacaggaatccttggggtctgagtaagtctgcgccactccattccccagcggactgaacgcttcgctcccggccacgcctatcccatgatgcccccaaatctggctcaaaagctgctagtactgagcgctggtaaggggtgcgggggtggcgttggtgggaaagtgagaggcagtaattgaacccctaaatggatggggtgggagtggatagatgagctttgaccgattttaactctctcctgcactaggtaggaagagaaggaggtatcagctaggacccctgtctgtccagcctgtggccttccttctgtcatcttatcaacccctcccaaaacacctctatcagcaaagaacacaaaccagtaccatttcccgagtgcatgtaagaaacaacgaagtttaaaatgcttccagtcctagagtgatttggggaaaattattttgtgtttgtttcctcatctgcaaagtggagactggaattgttacccccaagcgtgatggggagaatcaaggacattcttctaaggcatgtgccttgtacctatccctcaattaatggtagctattaactgttcttatagtaacagctaacatatttagtgttgggcattattgtaactgatttgcaggtattttcattttatacttggaaccagtgaaataagaattattgcctttatcatccccattttacagatgaggacactgagacacagaaaggttaagtttccaacagtaacataaccagtacgaagctgaaccaggatgtttcctatggctgctctaataagttaccacaaattgagtggctagcaacacacatttattaccttacagtttttaggtcagaagtctaagatgtgttggcaaggctttattccttctagaggcttttgtttcctggccttttccagcttctagaggctacctgaattccttgggtcatggccctacatcacttcagactcagtttccatcagcacatctctttctctgactctgaccttcccgtctctgtcttataaggacccttctgtttatattggcatgaccttgataatcaaagataatcccatctcaagctatctttttttttttttttgagatggagtttttgctcttgttgcccaggctggagtgcaatggcgcgatctcggctcactgcaacctccgcctcctgggttcaagcgattctcctgcctcagcctcctgagtagctgggattacaggtgtatgccaccactcccagctaattttttgtatttttagtagaaacagagtttctccatgttggtcaggctggacttgaacttccgacctcaggtgatccgcctgcctcagcctcccaaagtgttgggattacaggcgtgagccaccgcgcccagcctcaagctctctatcttaaccacatctgcaaagtcccttttgtcgtgtgaggtgaaatcacaggtgccggggattaaaatgtgtacatctttgtggggaaggccattctgcctaccacatggggcttgaagccaggctgactgacttcagagcagctgctcttaagtactctgtgccgggcaccttgctaggcttggtgaagagggagaaactgatgattgagaaaaactcttgagctgaggaagctccgggctagaagggctgaggtccacctgactgttgcagaaagagggaacttcagatgagaggagggagaaatcctggagaggtgatccttaaacggtggctggaatttccgcaggaggccatggaagactttacaggtgagtgaagcttgaactatgcgtggtcaggagggactggagtatggggggatgggaatgatcatcttacctggccatgaggatcagatgagctaaagacctatggacttggcatgtgacctcaccttgccttaccattcattttacagttggggaaactgaggcctagaggccagagttgcctgcccaaggtcacacagagagaaaacatcagttgcaccaggaagaagcctagtggggaggtcaaactggagcagggtagtcaactgatagggggcactgagggcaaaggccaggctccttccttcctcttccctggagttggcaggcactggcttctctggggtttcttttctcatgcttttttctcttgcaatctccctaatggccactggatggcgccgggagcactgatttggagctgggtcctagagccttcgcaggccgttggcatctggcacttgggctgcagagcctgtcctcccttaattccccgactctggcagccccaccaccgaagtctacaagctgcttctgttcccatgcagtggccccatagtcctggatttgaagaccagccctgctacttaccaggtgtgtgttggtgttgacaggtactggttccctttctcacttcttgattcctttctctcatttccctttcctcctaccagcttaaccctgctggatacagggaattcctgttccctaaccatgccccacataaggtcagctagcgcttgcttctttgtttatacccccatcttacgttatgggatagaagacttacaaaggacccgtgaattcaggaaaacaaacatccattaactcaagaacagaaagtgagaacccaagtaacagtgtgaggagagtaacactgccaagaaagcttagatggagaaggcaccgagcccgaacaaagacccccgggcccgggtcttttggtacccaggcaagcacgggtttatgtggctttcagagcctgttaagatcaggaataaagcacgtagatattgggggagtcctgagcccaggtgtgtggagagaactcagcgccctcagccttcttggttccctggagagtttgaatcattaaaaaacgacaatatcttccctagtggttagcagagatgccacttctggagctgtttcttagacttagtaacatgaactaggcatggccttgggtgggaaagggcagggcaggaagggcctgtaacttcagccaagtgctggactcgctttctgaatttcacctctgtgttgtctggctctgtttctccgtggtttttggcctttctcttcttctattctagctcacagctctctccatttctgcagccggcacagctgctgtctctaaggactgtctactcttctggttctttggacctaggatagtgaaacaggagagaaaactatcaattaccaaacactggcctgcatgctgggggccaggctgtgcctttcatctgtgttgtctcgttgaaacctctcaacctacaggagggaaaactgaacttgaaagaggccagttagttgcccaaggcccagagcttccaagttagggtttgaacccaggtggtcttgatcccagagtaggcccatttcacatttctacccttcagttattagggacaaatttggactttttcaaagaaacctttttcaggaagtttatggagtagaccaaagcaaagcccgagatacagtgcaggtgaatggcaggagccgctctgccgtttgtcagcagcacagcctccatgggacacttttgcctcagtgtcccctcttgtaaaacctgtgagcaggccaggcatggtggctcacacctgtaatgccaagcactttgggaggttgaggcgggcggatcacaaggtcaggagttcaagaccagcctgaccaacatggtgaagccccgtctctactaaaaatacaaaaattagccgggtatggtggcatgtgcctgtaatcccagctactcaggaggctgaagcaggagaatcgcttgaacccaggaggcagagtttcagtgagccaagatcgcgccactgcactccagcctgggcgacagagggagactccgtctcaaaaacaaacaaaaccaagaaacaaaacaataacaacaacaaaaaaaacctgtgggcaacgccaacctcataggttaaaaggaaagagcgaagtcattgatgaatgtgaacatgcacagtggatgatcaggaagggcccctttctctgcaggccattacttgccctttttccacaccctcccactcatttgaagtggcgtggcttcagatccccaggcccaatgaagaagttcggccacatcacacaatgaaaagcaaattgctgttaaatacacagaggagggcataagcagctcagctttatggagcccaggaaggcttcctggaggaggtggcaagtgagctgcaccagcaaggaagggtagacattccgcagatgataaaggaggagagggctcctgggcacaggactcgagtggcttttcaagggcatgtggggagggtgaggctggagaagacagtcgccctcagtcccccaggtggatcatgctgcatcccatgacaagggcttgtgggttagtggttctaacccacaagacttcatggacttatgaatcacctgagggtctgttaaaatgcagcatcctgcagtggggcccaggaatctttgtttctcccagctcctgggtgacactgcacaagtgatcagaggaagaaaggagacacaaagcttctggtgatggacatgagtgctgggcaagggctcagtgtcctccaccaggcaggggagcagactagggtctcaggatcttgggtgtgggcgtgtactagaccttgcgccccacatgagcggacgtgaggagctaagctgagaaacagcaaatgggaaagcaaatgtgaatgccagggcaagcattacaagtttgttaggagtcaccaggggctgggcagagaaggcaggttcagtcacaagggttttagtccagagacatgtgctggagaggagagggaaggctggaaggggaggtatgaggagcaactgctgggaagcaatttttttgttgcgggaggtgagtggcagccctggggctttggaaaaggtgataaaaaagaacatatactaagggcctgaaattctaaggacttatgaagaacccatttaattcccataaccatcttaattagaaaaatatattgttattcttaatttacagacaaagaaacccagtcccagaaagtaatttgcacagcaaataagccgtggagcagagacttaagtccagactgtgtcagtccagagctgggcactgattcttcattctagggtatcccaagctcatttaaaactcccggatccatgagccactgtttctttctgttcttcctcctgccatggacaatcccatctccagcccacctcatcccttgctctgctctttcccaggtccaagatggttctttttcctgaagcggtgaatggaactgctgctgtttatccctctctaggcagccagggcatgcgtgttcttcccagcagctgagatgaggatggaaattaatagaggatatagacagaaaaaagctaacaactaactacactatgcagataataattgaggtgtattttctcccagatgaacaagataatctgagtgacccctgttccctattacaggactccaattcctaatcttggcagttgccccccaaaataccctcccagtaaatgtttcttgaatacctgctttgggaatatgttaggtactgtgctgaacactggggattcagtggtgaaaaagagagtcctacactgtctttaagaaacttgtgttctaggagagggcagacaacaagtcagtaaatgaataaggtttcaactagtgatcattgctgggaagatgatgaaattgagtaagggtagagagctgcgctgtccacaggatttccgtgatggtggaaaggttctatatccttgctgtccaacatagcagtcaatgtgactaatgtgaccaagaaactgaattttaagttctgttttagataatttaaatttaaatagccccatgtgatttgtggccactgcgtcactcatcacaggtatagaggacacctggaaaggggagaggtgattaagtgaggtggtcaagggagactccctgagggggcgaaatttgaactgaggtctgagagggaggcagccttccattgttccagggggagagagtgcagatgtgggggccttctgggataaacaaagcttgaagttctggggcggagagaaggcttgtgagctggcattcactgggtgaggtagtgtggtgggagctgatggtggaggggtggtgggtaccggataactggggcatggcaggctgcggcgaggtgggcacccctcattccccttagcaacacagcaggtatagctgccctgcccttgcctgcccccttctctctcagggctgtggggaggactagatgagaccaggtaacgtgcacatgctctgtaagttgtacagagctgccaggcgatggctcatgcctgttaatcccagcactttgggaggccgaggcagatggatcacctgaggtcaggagttcaagaccagcctgaccaatgtggtgaaatctcatctctactaaaaataaaaaattagctgggcatggtggcgggtgcctgtaatcccagctactcgggaggctgagacaggagaatcgcttgaacccgggaggtagaggttgcggtgagccgagattacgccattgcactcgagcctgggcaacaagagcgaaacttcatctaaaaaaaaaaaaaaaaaaaaaaaaaaagttgtacagtgctgcccataagggtagagctgtggttctgagtgtgatcttggaccagcagcatgagcatcatctgggaacacgttagaaatgaacattcttgggccacaccctggatctactagtttaaagctctgggtgtggggcccagcaacgtttccaaaagccctccgggtggctgtgatgcaggctcaagtttaagagcaactgcagaagactggcggcaatcacctcctcctcctccttctcatctcaggcccccaacaaattgtccttccaactccaaccctggcagaattccttggtggctcattgcgcgccctagccctccttccctcagagctagctcagcttttggcttcacatacacagactaaaacaaacaaacaaaaatcagatagataaaacctttgtattaaaaatattttcaccatacaagccgtccagggtcgtcattaaaataaaacttaggccagacacagtggctcatgcctacaatcctagcagtttgggaggccaaggtgggcagatggcttgagctcaggagtttgagaccagcctggccaacatgaagaaacctcatctctgctaaaaatacaaatattaggtggtcatggtggcatgcacctgtagtcccagctacttgggaggctgaggtgggaggatagcttgagcctgggaggcggaggttgcagcgagctgagattgcaccactgtactctcgcctgggcgacagagtgagactgtctcaaaaaataaataaacaaaacgtctatagcatagaaccgatcaagtgaaaaaagatcccctgcttccgttaatcctattccctagagattaccacagaatgatttcttgtgattccttctagacgtctcctatgcctgtagaggcagctagtgtagtgctccaaaaccagtttgtttggtttaaaatcccaggtttgcttatttgtcaaataaattggacaagttgtctcagtgttgtcattcagaaaatgaagttaataatagcaccaacctcatagaattgttgtgaggattaaataaattcaaataaagcaatcaggagacaatccacttaacattcttacaacagtgcctggtatatagtatgtacaaacatgagtgtttgttaataaataaaatgcatggctgaggtttaattattctatgccttttccttggggatatagtcttgagagaataagccaaaggtgcaggaacagttggaaagccatttacgatggggatgatattgagagccactgaaaaaatcctgaccagatgattcttgccggtgacctcggctgacttccttggtttctgatcattatttcttattttattttattttattttttatttttttttgagatggagtcttgctctgttgctcggctggagtgcagggacgtgatcttggctcactgcaacctccaccttccaggtccaagcgattctcctgcctcagccttccgagcagctggaactacaggcacacgccaacacactcggctaatttttgtatttttagtagagacggggtttcaccatgttggccaggatggtctcgatctcttgaccttgtgatccgcctgcctcggcctcccaaagtgctgggattacagccataagccaccatgcccagcctctaatcattatttctataaactccctggtatctttgcaaagcttctaagtttcacagtttcaaaaaacatagcaggaggggggtatttacatagaacccagtgtggatggtacaccctggacttgtgaaatggtctgtctgatatcagccaggtgtggcatgtctgttgcttgcaaccaagaactctgaccatgccttcctccattctttctaagggctgtgtagtattctactctatgtatgtgttgtatttcacttaaccatttcttattgatggatgtctggatagtttagctattctacactacacagacaaatgcaatgacaagcttcccagagcctattgtccagcccccacctgtaccctattccccccgctttttttttggagacagggtcttgctctgtcatccaggctggagtgcagtggcacaatcacagttcactgaaggcttgctctcgcaggctcaagtgatcttcccaccttagccttctgagtagctaggactacaggtgcatgccaccacaactagctatttttttcattttttgtagagatgagatctcactatgttgtccaggctggtctgaaactcctgggcgcaagtgatcctcccacctcagcctcccaaagctctggtattataggcatgagtgactgcatccggcctgaaatgggctctttatcttacatgatcctgtgtagtgctcatgccaacactgtgaagtttgcatcaacactttccctctacagatgaggcagctgaggtcagagagaggatgagatatgcccccaaaccatcagtgagccccttgatgagcagggctcttgccacttcatcagggtggtcagtcggggggagaatgtttgggatgaaagcgggggccttcccttgactcaataccagctggcaaaaggcagaggttcttggaggagagaggtaagtcagggaaggactcgtgggagtgctggggagccttccactgtcaactcagctgctttccagagggcaagaggagagagagggtggaggacagttggcatgtggattgaggaacaataatgatgatgatgctaataatcacagtgactaatgttttgggcgagtcacaaagcaatttcctattatgaatagttcagcagagccacacaaccatccccttggaggaagacaaggcaatgtggctactcccattttgcagaagggaaaattcaggactggagagggagagtaacttgcccaagtttacatgtcaagataatcgccatgctgggtggggccagacctttcaggtcccagcccaggatctagctccctcccatgggccacagctgtggctggcagagaggtgcggcttttgtcagggctgaagctcagccacaccctctctccagcctcaagttgggtgccaggcagagggtttggactgaaggctg

SEQ ID NO: 1311 - DNA, 2092 bp, Homo sapiens
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggaaaaaaaaaaaaaaaaa

SEQ ID NO: 1312 - DNA, 1746 bp, Homo sapiens
atgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtga

SEQ ID NO: 1313 - DNA, 52479 bp, Mus musculus
  misc_feature (13300)..(15985): "n" at positions 13300 thru 15985  can be any base
  misc_feature (50929)..(50948): "n" at positions 50929 thru 50948  can be any base
gtcttgtgtcaatttatatggttttatccagtctccttccttctggagctccaagtttacatacacaagaccatgtggttgtgttccatacattcctcgagttccatttttattttctcgtgttctagttatattttcaaatgatatatcctctatgtttctcacttttgaagtcttttattgaattggctttagattaattgtatcagccttgtacctggtgctcagtaaatacttgctgagtaagcaaagatcaggagaacaaagacacgaagggctgacaagaaacagcacagggtgtgaagacagtatgcattgtttatgttcccaaagtagacttttacatgcagggtacacagtgataaaagacgggactaacggcacacgttgaataatgaaggagcaagaagctcaggtctcaaacattatgaaggtaacacacataatcagtagatgaaccaggaaggttggttccatggggcaaagcagaacaagaagaaaattatttttacactgcagataccaaagggcaagaggatttagaagaagcgagagggaaattggggttctgggaaagcgtcaacacaggtgatttcttttcataactgcttgcttctgtcttaaatagcaacagaagatgtgtgattatggatacgtgcctacagcttccggatctgatgagatagcatagaaacacaagagcacagactgactccgagacaaaactgtttgcaaccatgggtgggcctatgcgttaaacagaccattcagaacaagggcatggttcagcaggaaagggcatttgccaccaagcctgacaatcctgcttaatgtccagaacttatgtggtggaaagagagaactgattccctcgaagcagtcctctgagccacacgcgtgctctacggcatacaaacacacattaatgtaaagaatagactctataacgtctctataatgtctgaaaagagaagcaatcccatattttaccgagacttgatgccatatatcttaagagatgtgtggaatctattggaaactccaagcgctggcagaaactcactggcttgcctttggttgctctcttgtggaggaaacactttccttaccttgttcataagtgcctaccactgcccaagatgcacccagtcaccagacatagtcaggtacagtagacattcacattagtgaactctggtagagtggggccagaaagctgagcaactgggggagccatctagagcaagggtgaggtggagacatgtccgaatcctgaaaatctcatcctgaaactgacaggagtaggactgttctccccctgctctgggcctgcatattctggtgcatgtagccttgagactctcacctctgccatctctgaggtagtcacatagcttggtagccaggttacaggttaaacttcctctcttcctataaggatgtgtccagcaagcacctgaaattcctcctcatgcatatgaagcattcccagctccccaggcccagccaatgctgtcctctcactctgacaattcctaccccattccccaaggtgtatccatagcccttgttcccctccttcccaataaggagagacttttcactaaaatctttctccagagaaggctgtttctcctgcattcacaacaacagagatcttgcctaacccacccagctggataagctccacttctttcagtccagcctggtgtctaatgtgcctggataccctgaagggagaagcagaccaggggtggcttggtgtaaaaagagaaggttaatgtcctttacatttctaccaccatggttctgaaagctcgagtcaacacacaagcataagtttttttttttttttgttttttgggtttttttgttttgttttggtttttggttttttgttgttgttgttgtttccagaaagttggttagaagaagtggagtcatggctgtgactaaactggaccaagtagttcagagtcttcagaaatagtttttgagagggcttagaaaattttgaagaaattggcctgagaaagccaaaagtgtctttagtgaactacactaatgagaagttatggtagaacttaatgactgaaatgttggcaggaatatagacaacagagattgtgatggtgaagtttcagtaggaatgagagtgctactgtggactggactcgtggatactcatgttattttgtgacaaagtccgtgtctatattttgtttctattctgagactctgtggtagactaagtttcaagatctctggaagataaaattccaaggcagcccaagatggagcactgctattgctggcttcttttagccatctttacgctgaaaactgggaacaaaagcagaacatagacattagaaaccactgtgtgcatcggtaggaaaacaagaccattgaagctgtagacaaggaaggtgtataaagaaggagataaactcagttaaaaggaaatgagaacaattcactatgggcaataggaaagaaatctcaggaattcctaagaccctacccattcagagtataaaatagtaaacttatttgaaagttttttccccctggagaagagagtacactcagaggctggaagagacgtgcgtgtgtgtgtgtgtgtgtgtgtgtgtgtgtgtgtgtgtgttttaaattagatattttcttcatttacatttcaaatgctatcctgtaagtcccctataccttccccatgccctgcttcccaacctacccactcctgcttcctggccctgacattcccttgtactggggcatataatcttggcaagaccaaaggcctctcctcccattgatggccaactaggccatcttctgctacatatgcaactagagacacgagctctgagggtactggttagttcatattgttgttcctcctatagggttgcagaccccttcagctccttgggtactttctctagctcttccattgagggccctgtgttccaatagataactgtgagcatccacttctgtatttgccaggcactggcatagcctcacagagaaagctatatcagggtcctgtcagcaaaatcttgctgacatatgtaatagtgtctgggtttggtggtttttttatgggatggatcccaaaatggggcagtctctggatggtccttccttccatctcagttatgaactttgtctctgtaactccttccatgggtattttgttccccattataagaaggaacaaagtatccacactttggtcttcattcttcttgagtttcatgtgctttgaaaattgtatcttgggtgttctaagtttctgggataatatccacttatcagtgagtgcatatcatgtgagttcttttgtgattgggttacctcactcaggatgataccctccagatccatctgttgggctggagagatggctcagtggttaagagcactgaatgctcttccaaaagtcctgagttcaattcccaggaaccacatggtggctcacaaccatctgtaatgggatctgatgcccctcttctggtgtgtctgaagatatgtgttttgtatcacatttccttcaactgaccaaaaaattaataagatgaggcaagtgaatgctgatgtatggcaatgggaaatcaaatacatttttttaggttgatggctgggaaatgcacagccttcaccataaaggaacatacttctagtaggaagttatcagctacaaggtggatgagttagttactctgttcacactgggaccaaacacccgaccagcacaacttaagacaagggtttcttggcacaccccaaactttcctttgagtcttttaagtctctatgactctgtagcttcttacaaacatggctgctgaactagcaccatgttgctgatgacacaaaggtgaggaagtgcttccaagagatccagctgtaaggcattttctcaaatagtgattaagggggaaaggcccattgtgggtggtgccatccctgggttggtagtcttgggttctataagagagcaagctgaacaagccagggaaagcaagccagtgagtaacatctctcatggcctctgcatcagctcctgcttcctgacctgcttgagttccagtcttgacatcctttggtgatgaacagcaatgtggaagtgtaagctgaatcaatcctttcctccccaacttgcttcttggtcatgatgttttgtgcaggaatagaaaccctgactaagacagagtccatgtgggctgcagtcaggaaggctgtggattagagctgtccagcccttccttagaagcctgtatcacaccaagaaatgtgccagatgccaggcatgatctgcaggattatccaattgccctctggagtttggtcttgctgtgtctgtgccttctttcaatgtgctcctcttccttcttggaatggaaatgtatagcatgttccactgctgtgtgctagaactatgtctttcatttttgcttttacagaggctcacagccaagagttctgcctgagtctcagagggaatttgaacttagaattttgaaaaagattaaaactcttgacactttggggattgttagacatggactaaataaacttcgcattgtataatgaacacaaacctagagggatgaattggagtgttctctacaggagcagaaccgatagaatgaatatatattaaatgagagtttatcgggttactgtacatgtgtaccagtttgggtaatctaacaatgactgtagccacactggagaaagctgaaccagtagatgttcagtctacatagttggacgcctcaaaagtccaaatgtagggctgagggtctggaggattcctgaagagccacccatcttcatcttcttggaagcctgaagaggctcggttctgatatcagtgaagaaatgaagcagcaaggtgataaatgaaccgagcagtgtaaggtgggaggccatgaggggaaagtgaagctttgtccccagagctccttttatctgggctgcccagccacatgcaggatagatctttctacttcacatcacctgagcaagaaaagcccttcgaggtgtgtccagcagcttacttctcggtttcttccagtcaagtactgacacaagaatcaaagacagaatgtgtggttggagtctaccatgccttcccaaagctcctgtgtggaagcccactactgcagatagggcttagaggaatccattggatcaggaaagctctgacttactggttgcatctatccactcatggggtcataatttgagagcacagttgtgatggttgagatttataggtttgtgcctagtgggaggagctgggctgcctgggaggtgctttttgaaggacatattttgtttctggaccccatttgtctttgttttttcttcctggctaacagaggtgagtagcattctccactacatattcctgctgccatgttgttcagcctacctcagtgttggagccaaaggactatggattaaagattcttatactatgagtcaaagcgaaactccctcatacaaaataaagtagtaaggaccctgttttcctcctcctgggttgccttctcctgccttgatgtgatggatggcatgtgtctagtctcattgtagcttgttatgcagtgtttgaatgatgtcccttggaagcccgctcttttttgaggtgaggcagggtgggtggatcttggggaaaggagagattgaggagggaggaagctggggagaggagagggaagggaaactgttgtcatgatataatttatgagagaagaattttaaaaaatattaaaggtcctaaagaaaaaaaaaaacaagaaaacagagagatatctataagaagaaatctaaaataattaggaaagttcttgagctacatgaaagcatctcaaaagactgacttaaaacttaggtctggatttccaaatacagcagatcactcaaacaacagaatagaaacagctgaaaaatctaacaaagatctattacagaagatcaagtgaagggcgtatatatgtacgtatgagaaatgatacagaaaagttctaacaataagaatggaagaattcctatgatccacacagtaagagcttcagccatcaggacagaggagacattaacacggtagcgtttcataagcaaaacgaaactgcacattgattcagaaacaattaggggatacatacaatgcgatacttatatatcatttgactgttttcagaaacaacaacaataatcttccttatttatttcaatattctcaaaagtttgcttcaaaggtccaatactcaagacagtatttttcatttgataaaatgctagtattagtagttgtgtcacatgcttagattcctcatccaatgaaatgtgcatatttaaagccaagtgctttcttactttaaacgtgttgctttgggtgttgctgaaaatagtatacagagttgagtacatactgaccttggtcacagcaacttttcttcagaggaaagcttaacagggagtgtactgggtaaaagatgggaccaggctgtctcatactgcagtgggaatgtgaaaattagcctctatcctggtggtgatctgatggttcaagaagagaccctggtgagttctgctgtgtagatttggacgtaggaaatgtttatgaaaccggtgtccttataccagttaactaggaaaagtaatcaccagggacagaggataatgactgacattccttgttgccctgaatgggcccgatctcctctgatctcggaagctaagcagggtcgggcctggttagcacttggatgggagaaacgttgaggcaggctagagtgcaattcccaacactggcccattgcttagtgtttctgagttccaagctcctcacttgtgcctgactcatttccttcttccggataacatgtctttctctcttgctttagaatcccccagtgctatttactaccttcaaaacttcttttgaccaagcacttgccatatacactaaaactagctgtactgtgcatggctttcccaaaagaatttttcactgaagacaatgattctcacccttcctaatgctgcaatcctttaacacagttcctcatggtatggggaccccaaccataaaattactttgttgttactttataactgtaactttgctactgttatgagtcataatgtaaatatctgatatgcaggatatctgatatctcccaagggggtcacgacccacagattaagaacagctggtctaagagagcaatgtttctctaagggtcctcttagcaccttgacaggatcacacctatctttatagtatccctgtggcatgggtttatttatttaatagttgctcagttttttactatgtagacattaacactgacagacagaatggtccagccgcatcacaaagcaaggagagccagcatgaaacctgtatagaagaacagaagacatttttcatctaagcatgtccttcgctagctgggcatgatggcgcacgcctttaatcccagcactcaggaggcagaggcaggcagatttctgtgttcgaggccaacctggtctacaaagtgagttctgggacagcctgggtaatacagagaaaccctgtctcaaaaaaaaaaaaaaaaaaaaaaaaaaaaaaaaaaaaaaaaaccacccaaccaaacaaaaacaaacaaaaaagaatgtccttcgctgaggctgcaaaaatggccctggcgttatgaccacttgttactcttgtaaaggacctgggtttggttttcaggttccacatgggggttcaccagcatgctggaacttcatgtccaggtatctgaggctctcttgtgacctagaggacagcaggcatgcacgagatgcatgcacacatgcagatggaagcagatgtacacagaaaaaataagtaatcctaaaagcaaaagaatgtccttgataggccagtaaaagttgctgttgttatagcttgacacttagatctcgattttaaaaacaacatcctgtgggcaaagtgggaagtgtgcattttgaacctttctgctatagaatgaggtggtggtcttgcagacgcgctgatgcctggttgcaagctgatcacaagacaggtaaacttggttattctggaaaatgaataagacgcttgtcaatttaagagcaactggcctcattagtggctaacgatacaactcaagttctcaaggaaaaaaaatcatagctttgagaaacttctgtcacagaaatgtactttcccaaacactaaagattctcatgattaaataaaaaaagtggcatagatgatttagactcttgctattgagacataccatgtgtcagcactggacgctctgtggaacccaatcaatactttccaaatgaccaatgaatgccttgtgttggcatcggttcaagtgtccctggataagagattcgctaaaagaatacgaggaaccatggatctcattgtagcacagtgagaaaacaccacgatctcaaagacaggtcaccagtgatacatggcccctgtggaagtgtctgttagagaactaggctgagacaaatgcccaacaaaagtactacttaaaaaggttagaaacacccaaggtttataggtgttctaagggacagcacctcacctttgaaaacatatcagatactttgaacatgtatactgtgaacttgtatcaaaatttgtaagagctaatatttgtcacctaaaggcacaattctgattcaagacatttttttaaaaaacttttaaaacatattttttaaaacatacatttattctagttgtgtggtacatacctttaatcccagcattgaggaggcagagaggcagagacagagagaggcagagaaaggaggcgagggcaggtgcagaagccgacgaggcagaggcaggggcaggggcaggggcaggggcaggggcaggggcaggggcaggggcacgggcacgggcacgggcagggggcacgggcacgagcacaggcacaggcagaggaggcagagatggcagagaggcacaggcagaggcgagtggatctctgagtttgaggtcagcctggttcatatagcaagctccaggccagcctagtttacatacagagaacttgtctcaaacaaataaaccaaaacgacaacaaaacaataacaaaaatatttgtgcgcgcgcgcgtgtgcgtgcttgcgcacatgccggaggaaaaggatgaggattcttctggtcaaattcaggtcctcaagataagttgcaagtgccttcaccagctgagccgtcttattggccctcagcataaggatttcttaagcagtgaggcttaactctgacattagctctgctaacagctctttcctgactgttccatcatccccacgctgggaagcctgcatgcagttttgtaccctctacccatccctttgtctagttcttcctggctcacccaccccattcttttcctacttcattcctctcttacgggagtctataggctcattggagcatctgccccatttgaagtcacttttgagatgaagataaaggcacttgggagggagttctagaatttccccaagtcttcccaatagcccgtgaggctatatttggagggataactgaggctaaacctcacgattcttgatggtggtctcctctaagattttgagagtggtgtacaggaaagggcttcggacggagttcactagagctgactttttaaatcttacagaggaaactgaggcccagagatgcaaaggataggggccagcctagagagccagaaaccaaccactggacccaacccacagcctccacctcagagggccctgatggggagggaggaggcgggtccctgagagcgaagaagagtgggagggcgaaggaaaggaaggagggcagatgtgggagtgaaagaggcaccctcctggaggctgattggctctggaggccagctctctccacgaggtttataagagttagggctgcctggggtaccctgccatctctcccacgtcccggggagccactgccaggacctctgtgaaccggtcggggcgggggccgcctggccgggagtctgctcggcggtgggtggccgaggaagggagagaacgatcgcggagcagggcgcccgaactccgggcgccgcgccatgcgccgggccagccgagactacggcaagtacctgcgcagctcggaggagatgggcagcggccccggcgtcccacacgagggtccgctgcaccccgcgccttctgcaccggctccggcgccgccacccgccgcctcccgctccatgttcctggccctcctggggctgggactgggccaggtggtctgcagcatcgctctgttcctgtactttcgagcgcaggtgagtgattgacatccctgtccgagtctctgcggtgagttggggggtggggtgggggctgagtctggttctaggacttattctggaagggaaagagacccaaccccccacaaggaagggaagttgggggcctccagccaagctcatctcctaccagcgcagcgtgcagaagctgaactctgattctggctgaggatgggtttgaatttccccccattggccgctcccctcgtgtgcctcaagtgatcgcacgctttctccccaccgtgaatttttcacttggagttaagaaccaacttcaactcgtttagggaaagtggggaaagtgagaacttttacttgggcatctaagcttcccaatgccactaaccgacctgttccctgacactttgggaccacaacgtgtcagtagtctttggaagagctagggatgacactcacaattcatacagtgacagcgctatcagatgtgcccggtctcaggtctggggctctggggctcctctggagctcaggttctgaaaggtgaagggacagccccactgcgcctgcctaggaggtgggtggaggaaggaaggtgcctctctgtgtgtgtgtgtgtgtgtgtgtgtgtgtgtgtgtgtgtgtgtgtgtatgcgcgcgcgtgtgcctgtgtgatagtttagcctgaatacaatctagccagtaaccaacctttgaagagaggaggaagctccgtgctaaagattcagaacctcggggagatggcagagggaggaaggggtaaatttgtaatattatgctttctggtggtttgtgctcttgtgttttcttggaaattgcagcgcagttggtcgtattcattcaaatactcttgtctggtgctatgaattctttctcagaggaagtggggggctgactgtgcatatttttatgggaaaagaaagttgggtttggacttcgtttgtttccagaatccgaggtgattactaaaccgaactggatgcattacaatgtgtcattgcttggactgcataggtttttgacatgtgccaaagccttgagccgtactttggatcacgggctttgttaagtcttcagacctactggtttgcattttatcccatgctgtggttacccactaatgcaaaaacagacagaccataagccagtccttctgaaaaccagggtctccatgctcataatcacatgcagtacctgtagagattttcttcctcagacaaggtctgagtggtttgcttgcgatatgaatcacagaaatctgtatgaaagtgagtaaacatccacccccctttcattgggatacataggaatcaatgaagaatggcttatctgttgttttctgccgtctgccattttaatggatgtgtccagagaccctgcatagttcatgccagtatcaaatgcgatgggattggcttagaaacaactctatatgcagtccccgtgtctttctgtgtgtggtaccagaggatagcgtgtgcttccaaggaaaggctattgtaattctttgcaaagagactttaggccagaagatatgcagtagttctcagtgtcttctatttttttaagcctgttggggtcacagcatcttttcccagcagtaaaagtgatgtgagcactgaacttggaaagaagtgtggggtgagcacgttctcggggttcttagcttaccaggaaccctgggacttggcatggctgtggaggaatgagtcaccagctgtgttcttgtccagttttcctgaaggaattctatggtggtagggtgacatgagatgcctgtcactctaagggtatggtcaccttttaccttgatggcataaaaattgtacaaaacaactttttcccaatgtaaacacttgagatagcactcggagccaggtgattttcctctggaggatttaatgtcatcagaattctggatccaagcgtttgtcttctcttttccttcccccgccctcccctgcccccgtcccttcttctcttcctccatctcttccttcctagctagggtctcatgtagcccaggctgacctcaaatttgtcatatagccaaggatattatacctccaagatagtgtttcagatatgcatcacggtgccccatttatgtggtgtgatgcttgggactgaatgcacatacatagctttgtgtgtatgttaggcaaacactgtaccaagtacactgactgtacctctagtgcccggttgctgcaaggattgagtctctcagagacttacttaaaataactttagtcattattctgaacccaggtctgtcactacattgttaaaaggtcgtctccgtcaccagggtagttttaggaaaatgtttgaatattctgactgcatctcactgagtgtcgtatggcatccgcatttgacacctcaggggaccctagtcacttagagatacatccagaatcccttgcccatgacatgctatgtctggaaaatgctccaaaatgactgagtacgtgcaggcgttgggagatcttagcttatgcgggaagcgaggtctcttgctgttggcgaatggttgttgaggataggttttgggtacacaagggttcgatctacaactcttttcctttttatatattatggaaaccttcttttgtactttaggtattggtgttgactaggattctgttttctttttttaaagttcttttaagtttttaagttctggatgaaatacttggaattgaaatcatctcctatcagggaacacatttatactttaagataaagcaagccagatttattacagtttaaagacattgaaaagagacaatatgaattctctgaagcaaaaggattggaagttccaggccagcctggatcaaaacaaacaaacaaacaaacaaacaacaaacagaaccaaagttaaaaccaaagctaatgcaaaatcaacctgggtgttttagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacacacacacacacacacatatacacacacatacacacacacacacacacatacacacacacacacatacacacacacacatacgcacacacatacacacacatacacacacacacacacacacacacacacacacacacacacgtttatttcatcgtcacaacatcatccgttagggatagttgcattttccaagtcccctgtttatcccctgtttgtctgtgtgtgtggtgctggggatggaacccagggcctccagtatggcagacaaatgctttcccagccccaaccttccttttacaatcagataactcaagatttagtgttggcaggtatacctgtaggtgtgactcactgtaactcagtttgctatgctcttttgtggaatgtgatttgatatgccttccagggaaagacaaggacagcttgtttgttctgttcccctgccccaccaacccccagtatctaacacaggacctgaagtactgaaagggcctttcaaatgatttgccaccccacacatctttccatttctactttactattatgcaaagtaagtgtctagtagctgacatggtacaggtcttcaaccgtgaaagtgctctatctagactgcccagtaccccagaacatgctgctgggtgggagctacatgcatttggtcactcaacactctgttagtcttgcccaccaaccttattccttgccccgccttccttccgcagactgtccttggttacctgtgcatttgcccctgcgcctctcaaacctccttccttccagggcaccggaaggagaaaacacatcgggttagagacacaaagcggctttctgacttgggatgcttaagaaagaaaatgagggaacaaagttaatggttgccgagtaatcattctttcttcattcacagtaaatgatgaggtcttaaacatcatggagatgtgacgagtggctcttaagtatattttgaatgaaagattcgacaactgaatctaacttaggcacgcgataaaattgtccaagggctccaaatgagccatgtttatttttatgtttttatttaagagagaaaagacaaaatctttgcattctactttttaatttgctccaaatcgtgtaccgttattaggtgatgcaacattgtgctaattagtgaaccttgctgtggggtggaggggatttacattcatgttcataccagaatagctataagagctatatgtatttgtttatttgacacttcgaagcattatttctcagagaaataatattttaatacagagaacatgaccttggatctagttaatatgcagctccccataagcccatgtaggtgattagctacatcctaaatactgacagtgttggaactgctgcttctgttagatagcttcaatttgtttgtgggatgcaagtctaaggaactttgtttagagtctccgggcatttcttaatgccacatggtctcttcagctcaggtcttatctggtaggaagctattgcagaattctgctttcctaaggtctgaacccagctatgattgacagctgcccttcagtgaaaactcacactctctgatctgtacttcttattgtaaagaaaatacatgaaatacgtacgcattgcaagtaattttgtttcgtggtatgacctcacctgtgctttcagagcatccttatgtattttagagctttaatgcttatttttttatttagttgtgtgtatgtgtctgtgtgtgtatgtgcatgtgtgcagacaccttcagagagaccacaactaggggtcagatctcttgaagctggagttataggcaacaaatactcctgtgtgtgtgtgtgtgtgtgtgtgcgcttgtgtgtctgaaaatatacaaaattttaaaaattatttttatttatgtgcattgttgttttgcctgcacatatgtctgtgtgatggtgtcaggttccctggaaccggagttacacagtttgcactgctatgtgggtaccaggaactgaaagagcagtcagtgctcttaactgctgagccatctctccaggcttagatgatccttctattggcatgactagaataataaaacatgtctctgtgtgcatagagaggggaccttttagattgtttctgaggattggttaataacggcatacatctttctgtgtattttaattaaatcaggaaaggagatagtttatttctgactgagctttagttattataaactttgcctttggtctagtttttatttactgacttctgaaaggaagaggacatgttaagctgttaaaacaatcaagttcagctgagtggtagtggcacaggcctttagtctcagcaatctggaggcagaagcaggcagatctctgagttcaaggccagcctggtttaaaaaaagccagttccaggacatcaagggccacacagagaaaccctatctctaaaaacaaagcaaaacaaaaacccaacaagaacaaactcccttttctatggtgatcgaagccaccgaaaaaccttgagggggcttgggaaatagaagacaagattctagaacagcactcgcagagaggctgggctgggtgggacaccttttttaaacccagtgtccagctagtaactccacggggatgtgttgggcaagacaatgcttatattttagtatttgctagcacttgcccagatagcctgcaggagtgtcctctccaccttagagtgatgagggatgtcactttaacatatttgtaggatccaggcctggagtactagctacatagtattcatcagaaagggaagttacataatattcatcagaaagagacgttacactcctggcttccggttttgattgaggtgcagatgggtttctcattcttttctttcactcatcaaaatactcatagattagggaagaagaccaatggcaacagtagctaaagattatgctaattttgcctgatttatgcaggcttcaagctttggttcttaaagtgggcttcatctccatgtggtttcatctagcattttggcttgtgtcttattcgtgtttatgagacagggtcttacacggtagccaaggcttgcctggaaaccactgtgtagcccaggttgtcttcatactcagtgttccttctgcgttagagtctcaaatagattataactatgagccaccaatctagtgtcatgagtcttcccctgcctgccgggatcacgtgtgatatctgcgatacctcttctagccacgaagaagttcaattcctgaaaattatacacgtacattttttgttgttgttaagaatctatggcctcatgtatctggggtgattgtcagctactcatcaaagtgaattagaagtcagtgtgtccagggcaggggaaatggatccatcaataatccttgtgatgggacatagagacaggagatcctgaggtcttgctggccagccagtctggtgagccagacagtgagctctatgttcaatgaacatcctcatgtcaaaaaattaaagtggagtgtggaacacactcctgtgtaccacatgtgcatgcacaggtgttcatacccattcacacatgtgtgcatacatacttacacactccaaaaagatgttttaatatgtattaaaataaaattatatatatataatatatatatattttataccacacttttttcaagacaatgtttctctgtgtaagcattctggctgccctagaactcactttgtagagcaggctggcgtctcactcacagagaccgacctgcttctgccttccatatgctgggattaaaggtgtatacgaacatgcctggcttgaggataattttattatcaaccactggaggatagaaaagtctaagcatgacccttctcttatcaagtcacagttcattaactataacccctttcatatcctttcccctcgtagatggatcctaacagaatatcagaagacagcactcactgcttttatagaatcctgagactccatgaaaacgcaggtttgcaggactcgactctggagagtgaagacacactacctgactcctgcaggaggatgaaacaagcctttcagggggccgtgcagaaggtaagtcctccctgacgtcgtaaagtcaagggtcttgatgatgctacagtaactgaatgttaaggcttgtgaagggctaactaaaaaatctatatttcatctctgctaccccagacccaattggcgaagtgacccactaggtccactttcctggattcttacatgctggcgggcctttaggtttcatctttctgcttctcagtcatggccattctccgtctctcccgctccctctcggtcccttgcccagaccatctaaaagtcctgcccagccttcctgcccagccattggctgtactgtggcaattctttattatcgattgaagctagctgagggcagggaccctcaggtctggaagctcagcttttgggagtgaaataagacaaagcattagaatcagttcccaaccatgtggtgagagggaggggtccggagcaggagatatagtgatgtgcgacacgggtattctgtgcttctgtctcatgttctgggagagctgggccacaggagagatgggaatggagaagactggtgtcagcagctgccaccgagagaaacatacctgcctgtcagggtttcctgagcctcctgggaattctgctgccccagaactagagtacttactgactccaccaaaaactcggtaggagtccagtgctcagtgctgtgtgtctgggtgtgaacccatgcgctggccctcccagcttccagatggctactccttgctttgcctcatcatctcagagtaaaccctgaccgtctcaaagccattggaccttggatttgttcagacttactaattagctagtacaacccgttctagcttagctcttcagaggcatagtgtaggtctgacagtgtcagctaaaagtacaggcaaggtataatacttttaaggtaagtataacattttgaaggtgaggtttgcattttattagacttacttcgttgtgtcacatcgcccagacaatatgctaactaaaaaaattcaacgtgatcatcacagagtctacttgcatcttaatttcagagatgactaaaactgagtgtcgtagagttgatgaaatagatgttattgtagcaagcacaggaaggcgtgttgcttatggcagccttatctgcctgtgtgaatatatgcatgtataatttaatacagtatacaattattttaaataagtgaacacaactcggattaggggaaaaaactttaccagtttttaaaaagttatggctttccttggtctgggatgaacctcagtagtggaatgtgtgtttattgtgagtgaggctctgcattcagagtcagagcctggcaaactaggactaaggctagcgtcaacaatagagtcaacggcttctattaaaggcacatggttaccaggtgtagcccatgtctgtaatcccaaactgcggcagggggattgtgaggttgagattagcatgagttacataatgaaacactacctctgaggaagagaggaggggagggatggaggagggacagggggacagaggggggcttttctattaacagataataatggctcgctctcaagaggaattggactgtatttaattaattttgtacttgtttttgctatgctgtaggagtttacatgtaaaaaaatgagcaatttataaaatctttttaaaagctcaatgaataattacaataagccagtacatattggaatagcatgcacattattgcaatgcgccagcatgtgctggaggagatggctctgtctctttggaggcctgatctttaggagggagatgaatgtttcccaaaccttatcattacagttaaccgacatccatagggtgcaactgtggatggaggcactttgccagacctttttcttatgccccagaatgtactcttttatcctagtcaaatgaacggggtttttaccaaatgtattatcctttgatgaaaaccactggttaatgtgacgtccgagtaatttgccacagtaatcagatttctcatttgtcttggcaaatgctaaaaataggaagggtgtggtaagcactctggaagtagtgtgcacatcttagctttagctctaggagatactgagcgaacccaaagaacaattcaggtgtagctgccatcggctttgagagatcagcccatgcagcggtggcccaggccagacatgggtgcaatatcacgttataggcgggcagaacgtggtatttacccagctcgttgtggtcagacaagtaatcttgtttttccctcctttttttttttttttgtttgtggctgtgttttcttggctttatttcccctttagcacagaactctgaaaaccctcttactgggccagctctaccaaccacaatttataaagtctatcaaaacagtctatgacaataaaacaaacactagtatgaatgtggtgtctgatttgtaaagcgatgcctggtttcaattttggcagccttcctgggctcttcccagccagtcgggctggggcagagcggtgagttcaggcggtgaccaggactgccatgcgtggcaggggaggatgctcaccctagtccgccgtccgttttcactcagtggagagacatcttttatttgccaagtagagattctgggccctgggggatgtgactctacctgccttcagtgtgccaggttgttgatctccactccaggaccccgcctgtagaagtatttacaggtttgatatcgagtgctttaaaggataggaagaagcaaagcgtgggctgctgagggggtaggagaaagaggggggagggaaagagcccaagtccggccagagctcctgtgctctggacaggcggatgcgggagggctgccggacgctttccactcggcccctggtgggcatctaagccactgaccccactctacgaggggtggacaaggggcagccccccgataccagggtcccggggatacgggagagagggatgagggagagaggttcccacacaggcgagagtccttagtccggtctgtggctggagcacaggaagaccttctgatgggaggttagacatggctcattaggagaaagcctatcccatcatccaagcacagtgggccttgatgaacagagacagtctatgattttagagctttattgtagaaaggcagggagaaaggagagaaggcagaaagagagagagggactggccatggccaagaatgagagaagggggaaaggagagagagagaagaagggctagagagtaagaaagtttagagagagcgaggtgaaagcttagagagtaagtgagggagagagtaagagggagagtagagtaagagagtgagaggagagagaataagagagaacgaggaaaggatgaggagagtgagaggagagagagagagaggtggggccaagcagcccctcttatagtgggctgttttatcttgttgttgctaggtgactgggaggagtttagcctgaaggtcagaagcttgggacattgcctacgtgactactagccacgattctcctgtgggggctgtgggggcagtaacttcgacaggagccagggttccaggagacgtgaggaaacgcctaccttcccatgtaggtgaattatcccccgggttcagacctcagctcgactggagaccagcctgtctatgcatagcccattgctccacagcaaagggctattggctgctttgtctgtccgtttatttatttaatctatatgggtgttttgtcttcatgtatgtctatgtgtgtctggtggcctcaaaggccggaagaaggagcaagagcccctagaactggagttctgagcagccctgtgagtgctaggagttgaaccggggacctctggaaggacagccagtgttttgaactgctgagccatctctccagcccctgtgcttgtttttcaaagctagactttaaactgtgaactgtgtgtatgtgtgtgcctgtgtgcacacacatgtgcgcacgaattgtgtctatgtatgcttgccctgcttgtatatacagaggctggtagattcctcactcgctttttttaattaatcattttattcatttacatttcaaatgatatcccgttggctaacaggcaggacttagaagaccacgccttgcagcaagggaggctagacctctgtcttctacctgaactgccatttgcttgtgattcttgatatacaacacctatctacctccccacgcccacatagatacacacatagatacacacatatatggatcaaggattaacacaagcctgaaaggtttaggtggtcaggattttattttcttaagttcacatgtagggaactagagacagcatggcagggagattgaaaagtggatttaagaggaagtgtcaggaatgttgatggctgcctgctgttttcagctagatttcatagattgagaacatttactcaaagccagaatgttcctcattttgagtggttgttttcttttttttgttcctcatggaactctgatcctttaggattctaatgttgattattagaaagaagcctagtttaagaaaagaaagaaggaaagaaagaaagaaagaaagaaagaaagaaggaaggaaggaaggaaaggaaggaaggaaagaaggaaggaaggaagaaagaaggaaagaaagaaagaaaggaagaaagaaagaaaggaaggaaggaggaagcctagagacaggcttgtatatacatctttaatcctagcactcaggagaagcctggtctatatagtgagttccaggacagtcagagctaagtctcaagtaaatagatagaaagataagtgaatagatagatagatagatagatagatagatagatagatagatagatagatgatagaataaaatttttaaaaaaagcctttcccctaaatttcaactgaagtgaaatagaaatcactggaaatcttagacaggttatagctgcctggagactttggagttgttatgtggatgaaatttctcctaggcttcctagttacaaaagaaggatcaagggggaagtttaaattccatttactgcctctttgcttttgtgttcaagaatatgtgtcctatgagagtttctcacaagcccagaaggtttgagtttgggtcactggcattctcaaatcgagatgttagtcatgtagtggttttccagtagaatcccgtcccccctttgccaccgtggttttgagaattgcaaccaacctcagtcatatttagtgtgtataaaagctgtcttcatgggaaatctggagtgagatccacagagatttcctacagagccaaagctttgtacttacttttctcttgctgtgataaaacatcatgaccaaggcaacttacagaagagagggtttgcttgggcttccagatcctgagaagcaggcattcatgatgggctgatttacagccgggaagcttggcagcatgctgcagacatggtagtgtgtaccagatgctgagagctcacagtgtgagtcataagtaacacacacacacacacacacacacacacacacacacacacggaggggtgagcatgcatgatgagaatggcaggaggctttgaagcccatctccagtgaaatacttcctctagcaaggttgtcccttccagaccaccacaaatagtgccaccaagtgttcaaatgcaggagactgtgggggacattcttatttaaaccacagaaccatcactgtcattcactcaacaaaggctgatggtggtgtgtgctcaatctcagggaagaaggcagagccaggagggttgcaattcagaactaaccagtaagtgatgccaggggtgagctttgatctgtgctgtgggtgtcccaggatggaagagaaaattctgagtgggcatcttggaagaaacagagttagaagcattcacccgagaggagggtattcatgacgggctaacttcagaggtttaatggagcttgtgttgctaaggggtgggttggctcgtgaattcgaggagagtggcaacctgtggaatggatgggaatatgtgtctgggggctgtgttttacaatagctgcatcttcagtgaccttggggcccttgcttaagacctcccagtgccttggctagaggttctgccttgatagccagaaggatggaccccaggatgtcttcaaaccagcctaagtgctaagagccacggatggacagaacagcctttttttgtttaataaattaaatatgataaagaaaatggagttggttggtggaagggtggtattagaagctggagagaatcatctatatcagagatgatctgatatggagtgcctgttgagcttgaagttcaaggtctagaggaagcccattctaggaagcatcctggttattaagaggctactccagttcttggtcttggccttttgggaataccaagtggtgatcacagcaatggctgtggtaaacaaaacaaaacaaaacaaaacaaaacaccaatttaaaatgccaagggtaagactcttccagaacacgaactcctctccatatgcccattcagccacacctctggtccaccctctcgagtggacagcttagtcattacgtcaccaagctaggagcctgaggatggtttaactcttgcccaccaactcttccctgactggcggccagctgtggattctgcctcctcacaaaacatccaagcaggatgttacccgatgaataaatggatggattagggttcttgtgtgtgctcttttatcatttccggcccattttgtttagttgttcttccaattgtctctcaaaatgaagtgcaggcatttctcaaaacaggctcccactaacgcttgcccacctgcctgtgtaatcaggaggccgtcttggatacacatggagtttatctgtacaccaggtatatgcacccagattgggcctggctcaccataggtgagcttttcaaggacccgtgacttttatttatgcccccagtggcaggcatgtggtaatacaacttgaagcacaaagttaatgagtgactaacccatatctatcctgaattatgtgtcacgttgtgtatgggcagggttttcatcgctatgatgaaacaccatgatcaaaagcaagttggagaggaaaaggtttctttggcttacatatgagtgttcgtcatggaagggagtcagggcaggaaattagaagtggctagaacctcgaggcaggagctgataggaaaaacacagcagagtgcttcttactccctatgttggcttgctccctatggcttgcttcacttgccttctatagaaaccaagaccacctgcccagggatggtcccacccacacggggctgggcctttgatcactaattaagaaaatgccctacaggtttgcctgtaggtccatcttagggaggcgtttttttctcaattgaggttcccatctcccagatgactctgccttgtgtcaagttgacataaaacaagtcagcacatgcggctagtcacttatcagaagcaagtcatgttgtacactcataagatttgttagggttgtgggtctccagtatagtctgtttccagagggcagctttctctctgtagccgtgagcctgttaggggcttttctctggtggcctctttccattgtcctcctcagtgtctgcagcggctggtctgacatcttggctgccctgggactcctactcatagagtatcacgaacagggctgggagactgtgaaagccatccttttgtgaggaggcggtgtttggtgatgtagaaagctctgctagttagtgtatggctggcattcttgttgctgtggacacagcaaagcaaaggcacgccacactcctccgttgagcccctgcatacccctcctcccctttaaaaatgcgtagcataatagaagacactttaaagttgggcttttacgaagactaataccgctgtcataaggcatttgctaaatcaaagcccaaggagacctttaaccactgcagaagcttcctcatttaaaccatgaaggttaaacaataaaaactaattttctattcccagagtacccattgcccttccaggaaaagcatcactcttctttatgaaaacaagggacgcgtagctcctcgggcgggctctcggtgtagaaagtacatcagcagttgtagaacgtctcttctgctcactcctggaagaaatggtacccatgtggccgtcacggccaagttcttcaccaggagctttcaaagacgtccatggcattggctcagagagcaggaggaggtccgaccctcaggttcagtgggttagaaaccccttctgcctttgccctctccttcttttcctgagctgctggacttcatccctccctcatggggatggtgaggagttgtgttcattctgagagctctcccggggctaaggtgaggggcatctctggtgacagaagagggctctacagtcttagctttggggactcaaggactccacctaaggacctgcgccatcttaactaaggacaaataaccatctctctctgggtatgagctttagggtcagggagagccgagataaggattctaagtcctgctctggcaggggttgtacagcgacacggtagttgctcttccagttcttggaggtgaaaaagctttgtgcctaaagatgactcactgcaggtaccactagggcattctggctaggtacaagaccaaaccaggaacgatacaccttgcaagtcaatggggaaccaaaacagaaacaatattccttgcatgttaagggttctttttgcatttaaggcagttaaaaataagttcctgtttgtcctatgttaagcccttgcaaattaaggtttctatttgtaattaagaataggtttctgttgataagttatttctccgctggtcaaatgagccaattccagccagattagattatattaaagaaaggtttgttgggaagctactcttgggcgagttctctggcccctgggaaggaggccagggaagtcgccattggaagagagagaggagaggggggaactaaagagagaaagtgtgcatgaacagagagaaggggagagagagagagagagagagagagagagagagagagagagagagagagagagaagagagggaggagaacaaaatgtgtggattatatagagaagagcccctaagggaagggcagcccagcccctgggctggaaagttcacggttgggggcagagtatgccagctagggactgagggatgctgggagaacctggaggccaggtctgctttggtgtgtaagataagcatctcagtcccttgacccaggatctggaaccaagcacccatttcttaaatctgatgtaaactgcaaccccgtgtacgtgatgtatactgtaccctcgttccatccctatcattctttctaacaatgtatataatagccaactctcacccctgtgaacaccttacctcttcttaaaaaaaaaaaaaaaggaatttcatgaggccagcaggggctgctctcttgaatcctgagacttagggtgagtcatctggctgacgagttcgtggtgcatcccaaactacagcttgcttgctttaattggacaatcgtggatttggtcttttctcctcaagattctcaggtttagcaaaaggagcagcaggtatcaatggtgcccatgaatgggaagccaggttctggcacccggcaccatcagaagcagctccacacagtactgccggcatctacccacagtgctgccagcatccttgagggaggaggtggcccacaggggaggaagagctatgaagccaggcagtcagctcagttaacagcttattgctttctctacacccaaagacttcagatagcaagtgttccagttttccccttgaccaaaacagtttctaagtcttaagatgtggaaggacagtgggatacgccttgcaaaattcctatctcctaatcgtgtacttggttgctttggcaaccagctcccatcccttgagttatctcattggcatgaataggtctggttgaaaaaggtttatgaataacagaagatgctcctatcccccctctccctccctcccttcctccctccttctctctctctctccctctccctcttcctcctcgtcctcgtcctcctcgtcctcctcgtcctcgtcgtcctcctcctcctcctcctctttcttcttcttctctctgtctctctgtgtctctctgtctctctctctctccctcctcctcctccttctctctctctctctgtctctctctctgtctctctgtctctgtctgtctgtctgtctgtctgtctgtctctccctctatctatcttgcaatatcacagaggcccagtcgtgagggggccttataaaccttaggactgtacttgttcctgaagtcaccaagtgatttcaagaagaggagggacaagttccccttgtacttaagatgctttttcctgccaccatccatgcatctgtctgtggcacaaagactgtgagattaggtaggaagaggcaattgtcttcctgaggagtgatgggatcttgatgctgcagcctgggccgggaggaggagataggatttctgagctatttaccaagtagaagtccacaggacttcccagcaggagtgggaaatggactattcatttccagaaagagccgggagtgtggcattcaagtgctaactggctgatgaatgcactattcttgtaactaggttggagaagaattacatgaagggtatcattaagatgttaaaatgaatgcattacatatgttaacaagtgtatgaaccctgtattatatctggcaagcggggtgttaaatccttgttcaaccagccagatgtccctgcagctgctgtggtattgcagagggaggcagccacctgagacccttgctactgactgctgcgatagtgtctagtgtcgggagcatctggctgtacaaattgcttctcccgtgatttgattgacaggtaccaatggatcacgtgattcctatcacagtccaaatgggatttcagactgataaacccagactccaataacttgaccttttacatggaacctaggcagctgggacatatatttttattatttagaaggatggtatccagattgcagtcaaacaaacataaaaccaatttaatcttatatactcggggtcttgttcctagtagttagttatttggcagtttgtaaaggcggtttagaaattggttggaagtgttgaaatccctagagccagccaaggactttcaagtacaactcagagtttggtatttattcttaccagtgtggcctcccataagtgggcccaacttctcaagatgagcagctatttcctgggtttggaaaaaaaaaaccaacaaaaaaccaaccctcctaaatcatttaaaaggccatgcaggggtctgaagggagctaggtcctaggagactggatgctttcgctatcacactcctgggaaccacactcttttggatgtcctgtttaagaaaagtcgcacaaagtcaagaccacagttacacaattgatcttttgtatgccgtgctccctggaggagagattgtgaaatcccagcattttttcctatgagttaaactacagttgaaattaagaaaaaaaatcaaatcagttgttttcatgtctctgcagatgtactctgacagaaaagatgaaaaaaattaatgtaatctactttgacagagcactcagtgttgaaacttccccattggaaaacctgggactgtcaattgggacaatgtccactaggtggcactgtgtccgaacatttatccttgacttggctgcaattttggggggggatgcccactttattcactttcctcttttccttctgtcttgttccctttccttgttctgttaaaggaagctgttatagttttggcctaaattatgcttatctaaaaatgaatacatctttttgaaaagactacttgttacagtttgaccataaattcgttcattaattcatggtatttcttattagctctcacaaggttaaagattcttgttgtcctggatagtttatacaaatcaagataggtgtgtgtgtgtgtgtgtgtgtgtgtgtgtgtgtgtgtgcgcgcgcgagtgtgtgtgtttcgcaggtagctgtgttctgggaaggcagattgttgatcttctaagatagggaagtcaggtagaaaactgggttttctagagcaaaacttgatagtgggatctaggcaaggggggtggtagggagggaagaggactctgctctgttccacactctaagatctgtccaggcttctgggatgtttattctatgcgtttcatataattctaaaggatactacaagggaaaacttggttggctgaaaacataaggcgttactatgtttcaatgtgtgggatagaaatgtaactctttgagtggacctgactcatgaaaacactcatttagcaatcccgtttctcaaagcatgctgtgggttagagtccaccttacagcatctttggaaaatatcagtgcgatttgagaccaatggctgtgagttggaccagggcgactccaaagtttccactgaattgcagctgtgtcccccagccggaaagcatcaagttctacttagaagacatttatgtgtgcatgtgaaggggtgcacttgtgtatgggtgcgtgtgcgtatgtgtgtggaagccagaggccactttggggtattgttcttcagaagccacacacattggtttactaggacccgtccctcactggcttgaagagtgacgattagcctaggttggctgtccagagaattccaaatatgagcttgtcagtgctggggttatgcactgagcgctgagatgacctactgagtgctggacctacctaccaagtgttggtatgacccactgagggctgggatggcctactgagtgcataggttaactactgtgtgctgggatgacccactgagagtgaggattacgagagtgcaccaatgtctagtattccaggttctcttatttttaaaatccatcaaacaaacccccactggttccggggatctaactcgggtcttcttggttgcactacgccaactgagctatccttcagctaagattacgttttattcgtctcaaaacccaaagacagtttaaaatgatagatttactagaatggattgccctcaaatagccatttctttggggttcggaagattggggtagagacatacatgctgagtattgtgtctgtgtgaccagagctcacagagtcatcataagatccctttttggtattgaaacttcctttctgaatgtctgagaagaattacagttcttgggttctctagagatataacacaaaggcatcacctccctgggtctctaacgagcgctctaattcatcctgggacatgaaccctttcttcccctgacagcaggcattgaaagtgcttctgagaggtgctatttattgaattttcttgtaactaaatgggtctgtggcagctctgacctagaagccactgattaaatgggcaaggaaagtgcgttcacagtggagagggagaaaaagacccctgcccattaatctggggcttcagcctgctgcttggtctgggtctcaagctttaagatcatttcctcatttgcccatgtagaaatcctttcaaaggggatttgtcgatctcagtagagactgcagcagcagctgctagtgtgttagaaattcaagtcagagactccagcccaggcttcctggatctcagacgacctgatcctgcagctggcacctgcctgccctcctttaggtcagcatgcaccaccctcagttttgagtgtcactgccctggccacagtgacatttttcttgatttttttttctatgatgaggtgtgtgtgtctgtgtgcgtgcgtgcgtgcgtgcgtgcgtgcgtgcgtgcgtgcgtgcgtgcgtgcgtgcgtgcgtgcgtgtgtgtgtgtgtgtgtgtgtgtgaatcaagcaaaatcagaaaattccagaaattgggataccattgggaatcccaagaagagaactgtggactagaggtcagcaggggtggggaggaaaaggaaaccaactaagagccattgctttgtctaacgcaagaagccaccatctgcttaacattccctacagtgggcttcaggctgcacagggacccaggggtaggccaggacagaggctgaccttatgtgacctcagtggtatctctaagagttatgaaaaacagaatagattcttatcttctttggggttgtctgaaggcagagagaacaataaagaagaataaaatcttatctctcattgccaagaattgaattcatgtcattttacctacccatttattggtctgactataaggagtataaggctgaaagcctttctgtctacatagggaaagctcttgctacgtgatctattctttagaccttgtggggtagtaacagtcggcaggagtatttatcccattaagtgtgaactgggactccatcttgtgttggtagttccaggtatctgggtttactgggcactcgggctgggtgttcacctatattacctcatctaaccatcctgactggtctgctcttgaagccatgatctgaaccaaggcaagactagagcttcaacaggctctgccttatgggatattttgttagctaacgtctgaattgggtgggcacatggtcacttggtagaggcttcattctgggagcgcaggttaaatatgcagttatctactcctatgttcttatactcaatcgtcatctggcttatgcatctagacttgtttcctgcagtattttaattattggcattctaaaagcttttagactttcatatagtactttaaacacactgacttaaaaaaaaaaaaaaaactactgggagccaggtatcattctcttacttgtgggctgagcctctgcatcataatagaaactcactactgaattccatagaaagaggcccactggagtctgaagagaacaatatattttatatacacttcatttccatttatgtacctgttatatattaattatgctcagttgttttgttttataatttaactttgtttccttttattgcctcaaaggatttgtttggtggtggtggtggtggtggtgatgtgtgtgtgtgtgtgtgtgtgtgtgtgtgtgtgtgtgtgtgtgtgtcggactttttaagcattttgggagctcagatgctaggaatgtgcgatccaggaattctgttgcctctcagcttctggcttcattttaaagcatcctaactgattttgcatctggtagtcctgcgtaaatatatatatatatatatatttttttttttcccgctgctttacacaaagaatgagtttatgaatacagttctcctttatttcaggaactgcaacacattgtggggccacagcgcttctcaggagctccaggtaactatgagtaatttgaatgagtgtttgaagtcctgtatgggtggtagtctttaagctcatgaacttctgtcatccccagctatgatggaaggctcatggttggatgtggcccagcgaggcaagcctgaggcccagccatttgcacacctcaccatcaatgctgccagcatcccatcgggtaagttacatttccacccagcctgagaacattgtttcaatctttcattcttcggccagtggacttactcaaaccttctaaaccatgaggaggaggtaaacccttcagttgaaccctaccttgccaatcctgtcacatcatccctgtattcactctcagggacggaagtgggtgtttgagctcctgccggttggtgggtgtaattgctcacagttcccatccagtttccctctgaagtagacgaatttgatatcaaatggatcccccacttcctactttcttggtggatggctgcagtcaggaagccagagacatccccatttaggaaggctgtgtgggggctagcaggtgacagcagtcctctggaagctgagacattctgtcccctttccttatgcttatcttcccagaataagtatttactttattagaccagagacctagttacttttgaagatgaggacccagagctgtgtgcccgtagctacctcagtgtgctaggtagtcatcacagagccccactgactgctcactccgagctaggcaaagatgataaagattacagagagcatcatgggagagtgatcactgagcctcagtgttagcaccactgtggcctgcatgccacgcacctccagtggctgaggtgtttcagtgtgtgttcattccctctcagcctcactgcaaggtagcagttaccgttcagattgttcagctagtaccacagtgcttcacacagtttgccctttgtttgaggtccctgtggttacaggaggagaagctgacattcctctctacttaattcccagatcggtgccgtgcattatcctagacgcaggcacgtgtgctaggatggctttgtcagaaggcagttctccaagggtcacattacttttgctcgaagtagattagtttggaaaccagtgaccgggctctaatgtctccttgggcctgtgacctgcctgtgaccttgtatgaagtactgcaatctgcgcctcagtcttcataaccagggaggctctgtcctttttgtagggcggctatacatactatgtttcggggtggggagggaccatattacattcagtagatgtgatctaaaaattactatttgaacttaattaagtcattatgtaaattccactttgtttcataaatggcttaaggcagaattttctcctttttttctgagtttaaactttctgagtcttttaaataatacaaatctatcttttaataaatagttttgagccattattatagcataggccatagcgatatttttttcctgatgggagatgccgacggtgagaaatcacctcttgagctgtcaggagattctctaggctgcctgctctgatcctctggatagttacttccatagacagggtttctgtctgcgtgggcctggtggtgcttcactaattttctccgagtggggaaactagtttgcatgttcacaacggcaatcaaattaataccagtgtgcgggctgcgtgtgctgtgactgtaccctgcatttatcttttcagttcactttaaatggcataggataaatattgcctaagagcgtgtgccaaagtcggcttggcaaccgcaagcatgttttagttataaagctccctctgcaggcacctagaatctactcagcgccaaaacccaggcaaaactcctggttctgttccgatagctctttggtttaggatgcagggaaacgagccactctatgcttctgtttaagagaatagagttagttgttctgtttgggccaacagcccctctaaccccttgttctctcaatgctggccagtactgaatgattcagaggaagctggctctcacttgctatttttattttggagcactgttatatatttatttacacaggaggagacagaacctactgtacgtggactgttaccttaggaggttttaacgtttttagagtaaaatgcactcggaagttcttgggggtagggtcagaatatataatttttcttaggaagctgttgcaggctaaatgtttgctgaggtccctttccaacctctagcagctgggagcccagcagagagctgaggaggtcagccagactgggcgaagaggtcctcagcgtgcctcattagcaatagaagtcctggaaggcagggcagccctccgccctccgcacttccgtgttctcgactgttatctttggtgagtgcttttatccactctgtctagctttccagcctttcttctgcgggcttcgtgaactccccaatgcccagtagagtttctctcaccaagatgccccctctcttcgacattttggacgcaaagcttccggttttctagctcacctgtctgtcttctcaccaagctcagctctgctgagcatcaggagtctcttcagtttcgtttgggcagctccttgtcactgaagtcaaccctgttgttgacagcacgcagcaccggacaggccatctttatatgctcgctttccttacggtcagcggtaagcatcccgaggggctgctacttggggaaagtcttcattatggacgaagtgaattcttctgcactatgggaaaagtgggtgtccagaggaagcgccacatcaggtgtcccctgtcagatctccaggacgaaagaaggcttgagaacggggatggagaaaagcagagaggcatattatagcatagaggcttccactggactcgaagtggcacacgatcagggttcctgcctttcctcaccacgactgtgtattgcttttttgtcttccttggcagctcactccaatgtgagttagccaatcccatagaaagaagggacttcacactagtgatttaacttgtctctattaagagacacataaatagcaattgaatgaaatacaggacagagagaagctggggcaactatgggataatgtgagatggcaatatcttgaatttcatgagccttgcccatgggttaggtggctatctaccaggttggaggagttacaatgtcagcgcttatgtagtgagcaagcttttctattctcatcttgactcacttgggaccctagggtcatgtttgtatttggaacatttgactccagggagagctgggataggatctaccatggcaaaggagaacaattgctgcccagagcctgaaggctggtgactgtagcagccctgctgtgaagtctgagaacacacctgtcctctttggaagctggaactattgtttccttggtcatgtaatgatgggttgtcccactgtagaatgaaaactgcctcatctcctccctcccactttttctgttacctgttgttcagtctgctgtagcttgatttggaggtcctcagatcaccagatccaagagaccatagaccatctctggttcatcctctgactctctagagaaagatataggtgttcaagtcttcccaggaccaggccatagtattccttcccataaaccgtagcataggtggtattattgctgctgctgttgttgttgttaataaaaggatctccttggatccaccaaaccaaagagttgtcctttcatgagttggaatctagttcatggggtggtggcttcaatgtcagtctcagggctaaattatattatttaaaaataaactatatttattttaaaataaattatatttatttttaaataaattatatttattttaaaataaattatatttatttttaaataaattataaaattatttatgtattgttgtataaagcaataggtttcataatggcatgattgttcaaatatgtcatgtattttgatcttatttactttccatcgcactcagtcaccaatactgccctttctttttgcatgattgtggtgtgtaagtgtctcctagtttccatacatgagcaagaacttgtagttcttgtcttctttggtctccctgactgacttctgtcatttactatctcaagactaacaagttgaagacaacatggcacccaacatttttttttatgctactgaaacaaattatcctctgctctcattgtctgagacctgtctgtgttttgacttgctgacatcagagaggtggcagtgttagtttggtaaaaactcttcataaaatccctagggaaaagatgtggtttggacctttccagagtcctgtaaactctcacctatcagttatcatgtttgccagtagaataataaatatctgcattggtacacatatggaatagtttgatttattacagaggaatcaccaatttttttttaaaaaattattagatattttcttcatttacatttcaaaaacccagttatacacatcaaggacctgggctatgaacaccattgggcgcacagctgatttagaaggctctgtagaactttgacttctccaaaaacagtagcaaggaagccctttgtcatttcattttgtggaccagaaggggttgtaggagaacatggaacttgggagtgactttacaatgtgtgaatgcaattgcgtgatgctgaggagctgggaagcttggagcttggtggcttctggggatagtcaccgagtcatgtgacccaggctaaggtggggttaccagatagtgacacaattggaggttggtctccgcagagcttctgcaacccagattctcacatccctttacacaccccccaccacaaactaaataaaggttagctatacgaaggatggaaggaaggattctcttcctatacaagttggtttctttccaaggtgaagcgactctggtcattaccctctttcaactaggaatgaattgctcctgtccacggggcttaactttcttctttttatgctcggtagcacctacatggagtcagttttgatccttttctgtgggaataatttgcattctctccctctctccctctctctctgtatctctgtctctgtctcccccccccccataatcatagcaattctctgtattttccccaagctttgctgctttcctggaccatgttgctccatcactagtatcctatagcttaagggcaggatagaggatttttagttttgtgcctttacagtgcctgacagaatgcactaagtacatctgcatgcacccaggcccatatagaaaatgagtatcaaagtaagttattgtgttggaataaggattgttatgttagtgtatgatgctaccccaccagcctgtggaaataatgaggaacttttctcatccaagtagtggattctaaatcctgtgcctttgtttctctctaggttcccataaagtcactctgtcctcttggtaccacgatcgaggctgggccaagatctctaacatgacgttaagcaacggaaaactaagggttaaccaagatggcttctattacctgtacgccaacatttgctttcggcatcatgaaacatcgggaagcgtacctacagactatcttcagctgatggtgtatgtcgttaaaaccagcatcaaaatcccaagttctcataacctgatgaaaggagggagcacgaaaaactggtcgggcaattctgaattccacttttattccataaatgttgggggatttttcaagctccgagctggtgaagaaattagcattcaggtgtccaacccttccctgctggatccggatcaagatgcgacgtactttggggctttcaaagttcaggacatagactgagactcatttcgtggaacattagcatggatgtcctagatgtttggaaacttcttaaaaaatggatgatgtctatacatgtgtaagactactaagagacatggcccacggtgtatgaaactcacagccctctctcttgagcctgtacaggttgtgtatatgtaaagtccataggtgatgttagattcatggtgattacacaacggttttacaattttgtaatgatttcctagaattgaaccagattgggagaggtattccgatgcttatgaaaaacttacacgtgagctatggaagggggtcacagtctctgggtctaacccctggacatgtgccactgagaaccttgaaattaagaggatgccatgtcattgcaaagaaatgatagtgtgaagggttaagttcttttgaattgttacattgcgctgggacctgcaaataagttctttttttctaatgaggagagaaaaatatatgtatttttatataatgtctaaagttatatttcaggtgtaatgttttctgtgcaaagttttgtaaattatatttgtgctatagtatttgattcaaaatatttaaaaatgtctcactgttgacatatttaatgttttaaatgtacagatgtatttaactggtgcactttgtaattcccctgaaggtactcgtagctaagggggcagaatactgtttctggtgaccacatgtagtttatttctttattctttttaacttaatagagtcttcagacttgtcaaaactatgcaagcaaaataaataaataaaaataaaatgaataccttgaataataagtaggatgttggtcaccaggtgcctttcaaatttagaagctaattgactttaggagctgacatagccaaaaaggatacataataggctactgaaatctgtcaggagtatttatgcaattattgaacaggtgtctttttttacaagagctacaaattgtaaattttgtttcttttttttcccatagaaaatgtactatagtttatcagccaaaaaacaatccactttttaatttagtgaaagttattttattatactgtacaataaaagcattgtctctgaatgttaattttttggtacaaaaaataaatttgtacgaaaacctgcctggtgctttttgttcttgttcgctttcgtgtgggtcttgctctgcgatcctgttctttccaatatgataatgtggcttctatctttctccaaaggttactgggagaagtgcagatttaattaaaaactaggaacagattcaattaaattaatgaaccttggaatttgaaaaataatttgcaggggatttgtatgcaaggatgtagccagagagaaaacagacttttcactcaaaaaaggaaaagttttctctcctcaaatcatgagaaaaatatggtgctttgagctggggggaaattggggcttgctttcccttaccgtagtaaaggggggctcactttggcctggacatgtttcctcttggaaatcagtgtggatgagctgtctaaaccacgtcgattactcatgaagggcagagaccagaaaacagtcagcttgggaaggcacagcaagccattctctgagatactcgtcactggaagataaatgttttaggatgataacaacagcctagaatagagggagggatagcagatgttacagagaagaaaccgtaaattttaaacagcggagctatcacggtgggactcgatggtgttggccacatacacggactattttacatctgtcagtaaatctgagtctgaacagtgcaaaacgtgacttgggcactgtgtatcccgacagctgctgcttgtttcaaggaagaatttcgaggagcagccgagtttctgcagcttccgcagacatagaattttgttgcggcctcatgagctacccagcttagagcctgctccagcagtttcggctcgctcatttcatattactttgtgcagcgtcagtgatgtgctagttacagtcccaggcaccatggctacgaaggcaggtctcccagccccaggctcctgttctagcgctggttctgcttatgttagatgtggcaaggagcatgcgctgcttgatccaaatcttgggaatctcagagtctaaaatgaaaccgcaggaaatggaaagaaagtacaatgtgggcacagaatattcactattaatttttactgaggggtagcatgttagttatttttgaactgctgtgattaaaaatctaaagtgaacaccttaggggaagagaggtttattcaggctcaagattttagaggtttcgatcctccatgttggggagatggcggtgacagcggggcggtcaaggagcagaaagcatgcccatactgcaagtggctctgtccctcggtcctctcaggaaacgtccatgctgacatgctgtgccttcctgatcagtccagactagcagaccctcaacatcggctatccatcaagaataaccaacttgcactctcccaaagatgcaggggcaaagtgtcaggatcgcctgcggtgattcgtgggggctgtccaacatgtgaaagcaacatggcttcacatgatgccaagaagaacctccttggcagccctgggggattcagccacagtgtgatgtggaggataatgaacgctacgctatggcacctcaggtcggttgggggaggggagacaatgacttagtgacttatttagaaatcaaccagtgttttaaagtgggtaacggcagggatgggatatagtgagaggcaagaagccacctcgcttccggtcatgcctcagtttgccaggctcggagcagcatcttctaagtgggtttaaaatgcaggcgggaacacacagcacgtccctgcttccttctcttccttctgctttgctttcctgtgcatctctttcttgtgtctgccccctacgactgaaccctcccatcctccgcctgcccagactcccgtgtctcccatcgtcctactttgctttctgttgctatgacggaagccgcaacaaaagcagctagggaggaaagggtttatatggcctacatgtttcaattgcagtccatcggagagggaagtcggggcaggagcagaggcagaatctggaggcagacactgaggcagagtccacagtggagcactgcttactggctagcctgttttctgataccaccctggacctccatcccaggggtggcaccacccacagtgacctggaccttcctgcactaatcattaatcaagagaatgtcccacagacctacccagaggatgatccgatggaggtaaccctccagtggacgttccctcttcccacatatgtctaagtctgtgtcaggttgatacaatctggtcagcatactcatggtccttaggctgttgggtctccttgagatgaacgtatgtccctagagtatgtccctgccccgtcacagctgactcggtgggaggcatgacaaaacagtgtaggaaacctgtgtctagtggaagtaatggatctgagctgctggctccttttacctgcagcatgtcagccctcttaacctgccaagtctggggaaggagagcatgccaagtcccaggttatctgtcttcctgaatcaatttttacaaccacaccaggcccatgcatccaaaaactgacatgaagcgattcttactttagtgtgttagctttctccaaactgtctcgctttttgccattcatttgaaaaggaaaaaaaaaattgcaatggtattttgtctacagctataaaacaagcatccttttttactaataacgcacttatgggaattcttttgttcttttttaactttaaagatttactgtgtgtgagagggaatgagagagagagagagagagagagagagagagagagagagagagagaagacgaatgctctggaaccaaagggggccttctgatcccctggaactagagtcacaggccattgtgagcatctttacatgggtgctgggaagtaaattcagatctctgctaagtcacctctccagccctgtttttattttggtaacttgaaattctattcggggctcggtactacggcatcttaaacaacattccagttcttttgttttaattagagatggcctgagccaggagcgttggcatctgagcacagatgatgggcatcccagatcaagcaaagagcacaaatggcttctcttccagctttactcagaccgtcagtgtatcagatgctgcccgcccacactggggaagacagtcgtgactcagctgatcaattccagaaataccctcacagacacacccagaaatagtgttttcctgtctgtctgggagtcctatagttgttcagtggatctgcctcataaaactaactatcatgcgacattaaggactccgagtcacctgtaacataacttagaagaagtttgctattttagaaacccaaacgcgcttggacaatggcaattttacttctcaacttgatgggggttaccatggaaacaaatctctgatcatgcccctgagagagtatctagattaggtttgttgaagtcagactagacttgaatgtgggcagtacgattccctgggctgagttcatgcccaggtcggcagtacaggagtcattaggagcgtctggtccgtggggatgagatagaacagtgagattccatattaacccaggtttcacggctattagtaccagcatctgtttagctcagagcatgtaactcaggaggaagactggcagaatcatcaaaaatcatccagtcgctgaatgtctacccagacaacagagggcgccatgtgcctgtgagtcctgggctacccagacaccagggggcgccatgtgcctgtgagccttagacagagagataaagaagagcctttgcagggtgaattctcaaagtatccacgaagtcctgccttgaaactatgatgagctctgttgacctctgaatgggtatggctgctataacataacagacaaacttggtgggttagaactgcagaaatgcattcgctttacttctggattaagaggttgaaacaaaggcgtcggcggggccataacttggaaattctgagagccaattcttcacctctctggtttccaaggatccaaggagtttccagtaccagtcttgtttcaaattctgcctctgccccgtcttcacactttccatacctttgatttccagtcctccatctgagctctttattttattttatgtgtgggcaccagcatatcacaggtggagtacagaggtcagaggacaagttcttcggggagctgattttcaactcggtcctcgggcttcacacccgaggcctccacctagtgagccatcttaccagcctcatcttttctttcttataaaggaacagggcgtgacgtttagggcccaccctgacctcatcttcacatacagacttatgcctgcagtggctctttgactgaggaaagtcacattcacgagtcccagaattcataggctgtcgacatgtcttttactgggggcccttccacctactagactctccgaagcatcatgtctaaagtctcagcggctctgttgccagccactctcctctcctcccttttggggccttggcttgagggagggattgggaacgaagagactgtgattatgaaaataacaagcaaaatacagagcgatgcacatttctgtgtctgcaaatttctaaaaatgtggaggcaaaccccaggggaggttcacaaataccagcgtgtatctgtgttggagaggtgggattatgggtgttttcatcctgttgccacgctgttgttacaccgctattgaagtcggcagtaaggggcattaaacatcttttcaacataggaaagagactctggcttttggaacaatctaggttctgagcggtggccctgtgtgcttttgaagtggaatgcccaggggcttgggccgagcactggggagctggaatgtgaaggagccagctttttgagctggaagaagctctgattttgtttacagcctttgacttggattacattcctgattacaggctaaatatacctgtgggagtcgggctcagtcaccactgctgactgcatcactttctcccaagatttgccttccctctgtcttcctgattctaatgaagagattaggaagcaggatgcggttgaagaagggagagcagggccctgcatgcctcaagtgtctgtttaaggggctcagagttaatttttcaaagattactttgacagcttgttttctgccgtcaacagggagtaagcaagacagggacgaagataaattaattgaaatgttttcttagcatgtaactgtggcatggtgatttaatcaggtatgcatctttgtaagggattgttacaagaagctcagagttaaattgtatctttttggatgatacaagagagcttatggagaaagaattctttttttatagtagaaattattttgttgtacccaagttcctatcaacccaaagaagtctaacttggaagattatggtacttacagagcatctactggccttggaacagaggtaagcttatggcccgttagcactgtgagaattcagatgttctatcagtaaagtctgatgaaaggaagtaaactcctcagaattcactaaaggagcatgtagggacatactgatcaattggtggtagatctaagtggggattaatttaggggaattgccttatgtcaatatgggaggctgagaaattccactttcaaactttaaaattttttaaatttaaatgcaccatttatttatttataccccaaagactgcctctgattcctggtccctccctcacagagagcttctcgccataccccctccccttctccgctgagaggatagatttcctcctgggtataccccaaccctggcacattgtctctgccagattagcacatcctctcccactgaagccaaacaagacagccctgttgggttaggataccacagtcaggcttcagctttagggagagcctccactccagttgctgggagtagggggtgggcacatggaaacttagctacatgtgtgctgcatatgagccaggagttttgttccagcccatgtgtatgttctttggttgatggctcagtctctcccaggagtcccaggagagtcccaggagagtcccaggagaactcccaggagtccaggttagttgactttgatggtcttccagtagggttcctatcctcttcaggaccttcagcacttccctcaactcttttataagagtccctaacctctgtccaatgtttggctgtgggtatcttcatctgaagctgctgggcaaagcctctcagaagacagttatgctaggctcctgtctacaagcaacacagagtatcattaataatgtcagggattagcatatgcccgtaggatgggtttcaagttgggccggttattggttggccattccttcattctctactccatctttgtccctgcatttcttttagacagggcaaattttggcttggtgtccttatccttccactgagggtcttgactggctgtgttaggtggccacttcagattcatgtccccactgttaggcatctccactaaggtcacccacattttaaagctggggatgctgatagtactatttagttgaactcacaaggcctcaggattggggtggagggcatagataagagtcctacactctaaagaccaggtaaggtccagagttctgatatcagagggcaggggaggaagcggataccctagctgcaaaatggagagacttttggctctgtgtttgttctgttcagctttcagctgtttggatggtttccccattgtgagaggggaccctcctttcagtctcctttgaaaacactctcccagacatactcaaaataattcctcatcagcggcccacatgtgggcttcactctagtgcacatctaaaaaggaaccattgtaggcttaggctttcctctaaacctactttatttaggtttcttaaacatttcagcctcccttctagcccactgaccagaggtagaggtggggaaaaaatgaaggtttttaggaaaataaggatgtgaacctgtttagaagtagttctttgggggtgattccattctttgttgtcaggacacacaaatcattagcagcagctctgtccagcagaaactgcagggctccactaaatctgcatgagtcagcagaagatgcaagaattagccggaataccacaagacgctgtttggcatgtttttctctatgaactgaagaccagcaaagagttgtctggctagcaagcaaggaccagtgaagcattacgtggtgtagcaatgcaagaaagacctctccaatgtttgcagggttccatttatactcgttccgtacatcacacaccctctcacaagtctgcttcagccacatcctctcatgtgcctgtgcaatgaaagcagaggaactcattgtgtcttgttatttatttgtttgtttgtttatttatttatttatatttactttacaccctgagcccagtcccctccctcctctcttgtcagtcccacccttatatatcgctctccccattgcccctccctttctcgggaagccactcttgggtcccaccccaccctgtgactaggcacatcttcttccactgaggcccaaccaggcagtccagataggggaagaggaaccaatgggaagaaacagagactgaagactaaactacacatttgttacaagtgagtagggagtctagcatactccctggctggcaactcaggctctgtgtgcccccagggtcccaggtcattgtgtcttgtcaatgtttatagtcattgttcttattgttgttgttgttgttgttattattttagacaagatctcactatgtagctctggctgacctagaactctcaatatagatcaggctgacctcaaactttagacctgccagccccagcctcctgcatttaagtcacatatctttgcattcatcctattcatcgtctatagattattaaaatgagccatcttatgactgatatgccttggttttgtagggggctcagggaaagttttgtggtcataggagtccttagaaaatggactcactcagtgtcctggctctactgtatacagatcccgagttaatctagggctgacacatattttaaagtatccatttagtatctttttctgtgagcaaaggagagtgtagggggcactggtggcatcatttttgacaactccatttggctgacgggaacagtctaggtttggctcacacaggtgttcactgggatccacccagagagattaacagccacttttcattaggggaaaacactgcagagaactgtcatctgcctccctcaaatgtggaggactgctgggctgagagtgattgaggagaagcagacgttttactgattcactacatgcaggtcatagatgtgcttaaaatcaccgaagctgctccggccttgttcccatggggtacaaaggctgatcagcaaatacaactgcaggctctcgatggccaggaactggtaagagcagagnnnnnnnnnnnnnnnnnnnntagtctacgaaatcatgagcagctgaagagaggaaagaggctccaacagcaggtggggcctagatggacaggtgcatgtatgacagccaacagccaatctacaaggcttcctgacccggtcacatcaaagaccacagctccatcattctcaaagtcagaagtagagtccatagaaatatttccacagaaaacttctttgcactcaagtagagcaacttgactcattgctttggtgaagggagggactgtgagatctagggaggctaggtcactaagtggacctgccatactgaagggctttgaaactagccctttctggcctattttgtcatccaaggcaccgtgagatgtttcaggggctctgcctagcagatgttagcatctgctttaatagttctggtatctgctgtcgaatttcacgcatgttcatttctgttctcctttcccatagtgggaagatcacgtgacccccgtcttcttctaactggatgtccatatgtggtgacatgtggacaggagaactgagttcatagtcgaagagtctttgtggtccccttactttggtatcactatgagtagattccataaacatagcttcccgtaccttgggagcctgcagtaaatgggaccagggaagcttgggcagcttccctgtttagcttgttgttggtgacttgcattttatcttgagtgctgagagccgtgcctcttggctgtatactcccattagctgtgctatctgtaacacctctgatgtgtggtaaccatggtgacagctgttaagcagtgtttcagaagcttggaggctgctgcagcctacttcaaactggttggagccactgatcttcccgttcgacttgcacagttgtctgccttcaatagtacatccgattgccatatgtcaccaggttttgaacatgtgtcctgtgaagcgccgtggcttgcttatgtacacacagaccattggctacctacattttcccacactccggaaaatcttgttttctagtttccaaaacttctctaaactgtatctccaggaagatttggggtgttccctccttgtcataagtaaaactcttcactgccaaactggtcaccttagagattgagttgtagtgggtaaaacgaacatggtttgtcgggctttgtatcatgggtatgtgatgaggcaaatactgctgatgctcaatagacaggtaggttaagtaggaataaactgcatttgaatttggagtggctacttgtgtgactaaatgtttcctagggagatgcaacattcctatctactaattccagatagggagcccacgtacacgttcagtttggtgagccaaaaagtttatgggtgaggggttacttataggagcagaaacaactcagtgacagctgcgccaccaaagctcgtggtgatcacaaagcctggaaactggagcccacaggcatccgcaggctggagagtgtcctttccaggtgtttaaattgttcaaaacctctttcaggcagcttaactagtttctgctttctccag

SEQ ID NO: 1314 - DNA, 2237 bp, Mus musculus
cccacgtcccggggagccactgccaggacctttgtgaaccggtcggggcgggggccgtggcggagtctgctcggcggtgggtggcccgagaagggagagaacgatcgcggagcagggcgcccgaactccgggcgccgcgccatgcgccgggccagccgagactacggcaagtacctgcgcagctcggaagagatgggcagcggccccggcgtcccacacgaaggtccgctgcaccccgcgccttctgcaccggctccggcgccgccacccgccgcctcccgctccatgttcctggccctcctggggctgggactgggccaggtggtctgcagcatcgctctgttcctgtactttcgagcgcagatggatcctaacagaatatcagaagacagcactcactgcttttatagaatcctgagactccatgaaaacgcaggtttgcaggactcgactctggagagtgaagacacactacctgactcctgcaggaggatgaaacaagcctttcagggggccgtgcagaaggaactgcaacacattgtggggccacagcgcttctcaggagctccagctatgatggaaggctcatggttggatgtggcccagcgaggcaagcctgaggcccagccatttgcacacctcaccatcaatgctgccagcatcccatcgggttcccataaagtcactctgtcctcttggtaccacgatcgaggctgggccaagatctctaacatgacgttaagcaacggaaaactaagggttaaccaagatggcttctattacctgtacgccaacatttgctttcggcatcatgaaacatcgggaagcgtacctacagactatcttcagctgatggtgtatgtcgttaaaaccagcatcaaaatcccaagttctcataacctgatgaaaggagggagcacgaaaaactggtcgggcaattctgaattccacttttattccataaatgttgggggatttttcaagctccgagctggtgaagaaattagcattcaggtgtccaacccttccctgctggatccggatcaagatgcgacgtactttggggctttcaaagttcaggacatagactgagactcatttcgtggaacattagcatggatgtcctagatgtttggaaacttcttaaaaaatggatgatgtctatacatgtgtaagactactaagagacatggcccacggtgtatgaaactcacagccctctctcttgagccctgtacaggttgtgtatatgtaaagtccataggtgatgttagattcatggtgattacacaacggttttacaattttgtaatgatttcctagaattgaaccagattgggagaggtattccgatgcttatgaaaaacttacacgtgagctatggaagggggtcacagtctctggtctaacccctggacatgtgccactgagaaccttgaaattaagaggatgccatgtcattgcatagaaatgatagtgtgaagggttaagttcttttgaattgttacattgcgctgggacctgcaaataagttctttttttctaatgaggagaaaaatatatgtatttttatataatgtctaaagttatatttcaggtgtaatgttttctgtgcaaagttttgtaaattatatttgtgctatagtatttgattcaaaatatttaaaaatgtctcactgttgacatatttaatgttttaaatgtacagatgtatttaactggtgcactttgtaattcccctgaaggtactcgtagctaagggggcagaatactgtttctggtgaccacatgtagtttatttctttattctttttaacttaatagagtcttcagacttgtcaaaactatgcaagcaaaataaataaataaaaataaaatgaataccttgaataataagtaggatgttggtcaccaggtgcctttcaaatttagaagctaattgactttaggagctgacatagccaaaaaggaacataataggctactgaaatctgtcaggagtatttatgcaattattgaacaggtgtctttttttacaagagctacaaattgtaaattttggtttcttttttttcccatagaaaatgtactatagtttatcagccaaaaaacaatccactttttaatttagtgaaagttattttattatactgtacaataaaagcattgtctctgaatgttaattttttggtacaaaaaataaatttgtacgaaaaaaaaaaaaaaaaaaaaaaaaa

SEQ ID NO: 1315 - DNA, 951 bp, Mus musculus
atgcgccgggccagccgagactacggcaagtacctgcgcagctcggaagagatgggcagcggccccggcgtcccacacgaaggtccgctgcaccccgcgccttctgcaccggctccggcgccgccacccgccgcctcccgctccatgttcctggccctcctggggctgggactgggccaggtggtctgcagcatcgctctgttcctgtactttcgagcgcagatggatcctaacagaatatcagaagacagcactcactgcttttatagaatcctgagactccatgaaaacgcaggtttgcaggactcgactctggagagtgaagacacactacctgactcctgcaggaggatgaaacaagcctttcagggggccgtgcagaaggaactgcaacacattgtggggccacagcgcttctcaggagctccagctatgatggaaggctcatggttggatgtggcccagcgaggcaagcctgaggcccagccatttgcacacctcaccatcaatgctgccagcatcccatcgggttcccataaagtcactctgtcctcttggtaccacgatcgaggctgggccaagatctctaacatgacgttaagcaacggaaaactaagggttaaccaagatggcttctattacctgtacgccaacatttgctttcggcatcatgaaacatcgggaagcgtacctacagactatcttcagctgatggtgtatgtcgttaaaaccagcatcaaaatcccaagttctcataacctgatgaaaggagggagcacgaaaaactggtcgggcaattctgaattccacttttattccataaatgttgggggatttttcaagctccgagctggtgaagaaattagcattcaggtgtccaacccttccctgctggatccggatcaagatgcgacgtactttggggctttcaaagttcaggacatagactga

SEQ ID NO: 1316 - DNA, 52754 bp, Homo sapiens
cttatttttaaaaacattccacttctttgttgcagttctctatctcttcatccattttgtttacctttgcctctgttttctttactatatgtaaaagaattatttaaaaattattgtaggctgggcacggtggctcacacctgtaatcccagcactttgggaggccaaggcaggtggaccacctgaggtcaggagttcgagaccagcctgaccaatacggagaaacctcgtctctactaaaaacacaaaattagccgggcgtggtggcacatgactgcaatcccacctacttggtaggctgaggcaggagaattgcttgaatccagaaggtgaaggttgcggtgagccgagatcgcaccattgcacttcagcctgggcaacaagaatgaaactccatttcaaaaaaaaaaaaaaattcttgtctactatttccaatatttgggtcatctgttggtctgtttttaattggatattttttccctcttcattatgaaccatgcatttcagcttcttgtcatgtcatgtgattttgaaaattgtataccaagcattgtatataaaagaactaatgtagatattattttgcagctaaggtgaggacttcaatcagaaactgagctggattgcagctttaagtagtttcagtgcaactcttgtttcaaatatcttgaaggaaatattttttgtgttcttattttgttctctttctctgacaagtttctctcatacactagaagatctctctctaccttcccagcccagttcaccagccactttgccagtactcaacaaaatctgtgggggaagaagaccagtaattggagaaaatagttgggcatttgtagattttaatctgttacatcagctccagtaaaatatctctgcctacagcaaactcaacactacacctatctgtgtttatgcttgacaaatgttccaagggaggaaagggactgttaatctttcttatctagaaaagaatgttcatgtggaattccatccctttagatttttttcattatcagctcatcgataacttttaaaatatatatatatattttttttttctttagtttatctggtagctttgtctagttgttatggttatggtaatgccatggtctactgagatcttccatgtaataaataaagcagtttactgaatggttttaaactctcattgctgggaggaaataatatgctttttctctttgcatctattaggttctattttttcaatgttactacaacatttgccttagagtgtaagctttgtgggcacaacaattatctattttattcagcattatatctcttatgcctaccatagtaccagactcatggttggtatgcagtacatgtttgttgaatgactaaattatgagcatgaacaagggaatagaggtttgaaataaatagtatgatgtacaagaaaattacaagttattcttatgttctaaaactagaactttaagtgcaaggcagtgatggatgttgaggctaaagacagagatgggaaaaaattaagagtttgtaaagagcctggactttatcttaagtgttggtaggctgctgagtggtttcaagaggggaagttatacatccagttgttcgtgataaatggatcaatctggaagatgggtttaagtgagaggagactgctggaaggaggatgaaagggaagccattttagtacttaggcaggaaatgatgagaggctcatttacagacaagaaggaaggaaaaagcactctgggaatatggcagcacaggcttatttcttgacaccctcccactcccatctcaataacacagagagtatgtggggatgggaagtctacctgaggctttaggacctaaggagacagtataggaatagaagagcacgggccaacttctggacaaaattatttacagcaatgagcagacctaagtattagtagatttggggaagtctgaaaacagaattaatcccatagcttcttgggagactataatcacttggccaggtaatcccatgcatcctgacagacatatggaatctacttgaaatttccagccatgagagatccccagtccttcttatgctgccatcctggtgaggaagcatcttccctacccctcacttcatggatgtctaccattgcctaagacccttctaataatctgacatatccagaagcaatggggactgacaccaatggacattggtaggaaaagaagggtcaggtatcacccaaagggtctcaggagcttgaaagagggacttgaatcaaataaactcagcagcttgtttacagagaaagtttggtaaagaaacagaggtgaatttataaatgattgtaagaagaattattgaggaggtacaagaagctattgtgaaagatcaattgaagggaaaaaaggatttcttgaaataaaatttaattttggactttaaaatccaacagatcacctgaataatagaacagaaactgctgaaatattgaacacagatctagatcaaatgaaggaacatattcaggatgaagcataaataaaggccaggcgtggtggctcatgcctggaatctcagctctttgggaggccgaggtaagcagatacttgaggtaaggagttcaagaccagtctgggcaacataggaaaactccatctctagtaaaaatacaaaaattagccaggcatggtggtacatgcctgtaatcccagctactcaggtggctgaggcaggggaattgcttgaaccggggggcagaggttgcagtgagctgagattgcaccactgcactctagccttggtgacagagaaggactctgtctcaaaaaataaataaataaataaataaataaaatgaaactgcaagttaaacaatgtattatagaagacctaatatggcaaaaataagagtttcaaagaagaaacaataaaaaattattttctgaggaaaactgaagtggagacagattcaggaaacatttaggaaatgaatacaataagaccctttgatattatttaattatgttttcagaaacagctacaatctccctaattaatttttgtatttcccaaaagtttatttaaaagctctaatactttagattaattttattttaggaataagtctgagataatattaatgaattaaaaacctgtcaaacagagttgctttctagaaagtaagagataaaattactctaaatatttctagcattgtgcacagaagagataaacagttatggacaggtttacttccttcatacatgaccaagatgtttttcctcttccacctcccatccagttttccgtaatgtctgataatttgccattagaaatgcactcctttaggggtgagagctaaaccaaaccaaccaaataggccctgtttggccaggaggacctcagagaaaccttaaaataataataattaaaaaaacccacctgagttcccaaccatgatgggatggtaggtcagatgcctcattatatccctttctttttgctgtttagacacaacagctgacagcattaatgttaaaacagagatcataagactgacagaatagactgtttatggcaataagataccaaattgtaaacaagagctatggccatgccaggcaagggttaagtcacacactttacacttaacaaataaacgatgttctaattcccacagggtttcttctccctctttctccagcagctaaacaacactagctttgagataagtgatgttgaagcagttgcagctccccagctatcagacaccaaataactgagcccccacctgttacacaagccacagtgacagctttgattggacaagagagtgatttctgtaactttctcctgataagagaccaccaaccatggactacttctggctggttttacagcagatgcacatttgagtgacttcctgtcccttcttcacctaattgtgtacatttaaatgttaaatctccatcccaatggaactgtgggacgcacgtaacatgcatgtttgcttatcatgcatgcttacaccctttcatgaatattcatagctcttcctatgtcctgttgaatatgtatgctttgccaaccccttcagcttaaattcctgtgttactcttccctctgttgaagggcttgctttaggttttttccagtggcaggctgcccttcctgcctgcaggttgtaattccattcttaagaaataaaactcacctttctaaatttattaattgtgtgatttaagttaagggggtaaggcagtatatttccagaagactgccaacataaaattttaattcaattgtccattgacacagtgaatgttaatttgtcatcacatactagttaatttgttagctgaagggaatgtaataagaccaagttgcttgtaaagggtaatgggtaagctggattagattattagggaggccggtcctaggtgagaagtttcattaggttttcagtgagcagcatatgagcctggaccggagatcagaagacgcgggaacagacagaaaaagaagaagagtgatcaaaggagaggtggcaagtacaaaagacaaagcccaccagtttcataaagttgctcaggctgaccccatttccagggtgagatattttcacagacttattacctatgattatacacattttaaaaattgttattagcatgaggggctgcatatatattttataatagccacacttataaattagttgcaactggcttcagatttagcaagtatcttatacagggtcctggcaggaaataggtggcaaatccaaggggtttaactgaaaagactttaatttgaagagttgaggtcagggttaagcaaactaagaagggatggtaaggaacccaggggccagcaaaagtgggttcgctttcccacactgcagtaggttaacgccctccgccacgaaggaatccatatcctaagccccagactccgtgactatgttacctcacatggcaaaacttactttgcatatgtaatcaagttaaggatctggagatgcagagatgatcctggatagtctgggtgggcccaatgtaatcacaagggttcttatcataagagggagatattagctgggcacggtggctcacgcctgtaatcccagcactttgtgaggccgaggtgggtggatcatgaggtcgggagatcgagaccatcctggctaacacggtgaaaccccatctctactaaaaatacaaaaaattagccgggcatggtggcggtcacctgtagtcccagctacttgggaggctgaggcaggagaatggcgtgaacccaggaggaggagcttgcagtgagccgagattgcgccactgcactccagcctgggctacagagcaacactctgtctcaaaaaaaaaaaaaagaaaagaaaagaaaagaaaagagaaagagagagagagattagagttagagtcagagagaagctgtgaggacagaatcagaggtcagagactggagtgatgaggtttggagatgaaggaaccaaggaatttaggtgacttctagaagatggatcctctccggagttcagcaaagtgaaacgtctgtcataataataacgaatgacttcctttttcattttcattcatatagtgaagttttctaaaggctgcatcatgtgcaatattgtaacagagtaagtgcaggactgaatgtgactctatcaggccaattgtagagatgtgaaaaaatgtaaaacagtggcacttttctccctacttttttttgaaaatctgtttttttaaataaaataattttataaaagtattatgaattatttataaaattatattaacattatgttaacatgctaatatggtaaaattttctgcttggagtttgaatacaccaaatatttataaatataactcacacaaataaaacctctttggtgttctcaaaattttgaagaatgtaaaaggtttgaaaattgctgatctagcaaatgactgaacatgaacagctatagtatttgtacctgcccagcagtgcagcaattccttatccttctcatatctgcactttaattttcctttgacaaatatctctccctcctctcagcccatgacatgaggttcacatggggttaacttaattccctggctcaaaggaaaggtattaaattcagacttgtatccaaccattcctgaagctagacttagccctatttttcaataacatgaaccaatcaattttcacatgagtccaaaataattctatgttaatacactaaggtactaggaaatatagtttgagaaatgttgatccaaacattgtgttatttacagtggagtattgacataaactttgaatcttcaaatatgttctggtgtcttggcatctcttaatacctattagcttacaaggctttcactcaactattttataattttgataatgacttaattgattagttgatatattgttaaaataaatatattaatgaatttatgataaataaggcagataaataagacatgcaattaggaagacatgttaaacaaattgttataataatacaatcactctcagcttaggatagctcctggccactttctctctgggtggtttttactctgggagtagtttaaatcattatctagtagtagtttaaagcattatctttgcctaagagctttcgctgactccccacatttgcattgtactaagagttttctctgactccccacataggtctagaccctagtattataagattctcattgtacttgcactttgccttcaaagtactaatcacggttttgttagtgatttgtgtgatgatttgttgaatctttttttttttcccactagggtgtaagccccatgttccatcttgatcaccatgtttctagcccagtgctggcatatagtgggttctcactaatatatctgtagagtaaatgaagaaatgcatgagtgacatgacaggagaatttaaggatgccatgggagcataaaacagagggagccacctgggtgaggagagctgagaaagacttctggagaggcgacatttgagctgagaaaggaaagacaagtgggagagtcctccaggtgtagaagttggagagatgagcgctccagttaggtagtatttgaagctgatgtagaaaaggagtcttgagccagcttgtgaaggactattggagagttttatttttatttttatcttttttttaatttttgagacagaatcttgctttgtctcccaggctggagtgcagtggcatgattgtagcttactgcagcttcgacctcctgggctcaaacaatccacctatctcagccttctgagtaactgggaccagagatgtgcaccaaaatgcctggctaatttgttcattttttgtaaagatagggtctccctatgttccccaggctattctccatctcctgggctccagtgatcctcacgcctcggccacccaaagtgctgggattatagaagtgaaccactgcgcctggcctattgaaggtttttaatcttcagagtttcgactttatcaacaacacttagaagccaccaaagaattgcaggtatggaaatgacatatacttttgcttttagaagaaaatcctgatcagtgtgcacagaattcttcagggggcaagtgtgattcattctgataagatatagcatggcttagactgggagactggcagaggctttgaagatttctttgctcaaattttattcagcaagtatttaccatgcacctactatagcaggcaacatttttaggaaatggtgaatgttacagaggtgaataatacagcaagagtcgttgaacatatggagtttatctattagttggggagtgaatgttgacaaaggaataagtaaatacataggcaagaaagatacattacctgtgaaacagcagcaggtagactgacagtggagtatctaatacagcctatggaagccagaagatagtgggatgacatttttggagtactagtagaaatgtcatatgaagaactctgtaggaatgtaacatacggtcccatatatgaagctcctgggtcaagtatacctgaacataattcagggatttgagggactttcttgtaacctgaggatcaagatgtcaaggaattaaaaacatgtataaaacattgttgtataaaaacccattaaaaagaatggaagacactatagtaaaatcattgtgggtttagttgttataacacattttaaaaatctttgatcccaatcaatatttataagaaagaagaaatatggaattatttcctgagtcaaggagcagggagagaatgaggaagaagaggaggaggaggagggggaggaggagacaataaacctacttcccaaagttaacaaacaaaaagtgggaagaggtcaaagactacaaggagtagaattaacgtcaattgtttctatgtttgagtctgaaaattttttgtcccttctccaccaacctatatattgatacacatataaatgctaaaggcatttttgaatttgaacagatcattttctttgtatggctgcctttaaaaaaaattcaacctggtcactcttcctcaacatttactgaggtctaagtgttcaatttagaacacatgctttaataactcagagacctgtcatttgtcacaaatcttgcctagagaaatactcattagcgaattaggcagaaagaggatgcaaaataaaaaggcacagtagtcccctgatatccatggaagactggttccaggacaccaccaaacccctccccgcaaataccaaaatccatggatgttcaagtttcttaacatatcatggcatagtatttgcatttaacctacacacatcctcttgtacacttgaaattatctttagattatttataatacttaatagaatgtaaatgctatgtaactagttgtgtatcatttaggaaatgatcacaagaaaaaaagtctacagatgttagtccagacacagccatcctttttttttttttcaaatatttttgatctgtggttcattgcatccacagatgtggaacccatggatactgtgggctaactgtattaataaaaaagtggaaacatcctaagtttcatgggtgtttaaattggtcagcaacttccttctgaagaagtatcagaatttgtgagcaatgttaatatttttgttttctcactaagagccacagttctgaatagaggtttttaaaaagccctagcaaggtttctttagcaatgaaactaacatttaactgtatcatcagcttcgtgttacatctctttcctgactgttgggtgagccctcctcggatgcttgcttctggctacacgcccctttacccttttctctgcactgttttcatctttataaagtcagagttggtgtctataggctctctactgccacattcaagacctgcctcgctcaatgtcaccttcaagatgcagaaatagggatttgggaaggggattgtgaaattttcgaagtcttccaaaatactttgagaaactatatttggaagcactttggggggagaggttggacaggaagggtcttcagagatcatcaaatttaactttctaaatcctaaggaggaaaccgagactccaggatgtgaagtcccttctctaccaaactagaatggatgcaggaggaatgtctgaggtgcaatccttatcctttagcaaaggtgtcctctgcgtcttctttaacccatctcttggacctccagaaagacagctgaggatggcaaggggagtctggaaccactggagtagcccccagcctcctccttggagggcccccatgaaggaggcccttcagtgacagagattgagagagagggagggcgaaaggaaggaaggggagccagaggtgggagtggaagaggcagcctcgcctggggctgattggctcccgaggccagggctctccaagcggtttataagagttggggctgccgggcgccctgcccgctcgcccgcgcgccccaggagccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcaggtgagtggccaccttcccaggggatcgcggctgagagcgcccatctccttcccccgcacttggaaactgagtctggcggcagggctgggccacccagagcttgcatattccggaagggaaagtgactccagaagggagagaggaagtgttgagtttggggacaacctggcgcagggctgtcgggcgcaccctgctctctctccgcccacgcaccccagcttctcggtgctctgggggcggactcccctggccggacgatgggtttgaatctcaccccgtcccttcgctgggaaacaacactggcctctcaccttttctggtagtgattgcatactttttctccctgtcatttctcacttgaagttaagaatcaacttctgttcacgtaggaaaaaagatgagcgccttcacttgggcatctacctttcccttcccgcccaccacccggcgggtttcggttcctgcgcctggctgctctgcaggtgtgctggggccacggtgctggagggctgcgcggagcgggaggtcgcggtgctcgtgcccaggtcgcccaatgggtgggcagaatgacacggcgcgaccagagaggcgcgggctcgggatgggggctctgcggctgtggcgctgtcctgtgggggtgaaggaagagggacagccccacgtgcctgctagggatgtgggcggaggaaggaagcgaggtgagtgtgatggcacagtgttactacagtctagcaaataaccaaccttcggaaagatgaagaggttttttgcacgacggctaggaactgcagagagatagtaggaaggaaggggtaaatttgtaatattatgctttctggtggtttatgctcttgtgttttcttggaaattgcagtgcagttggttggattcattcaaatattcttgtctggtgctgtgaactctttctcagaggaagtggggggctgactgtgcatttttttttatgggaaaagaaagttgggtttggactacattcgttttcagattcaaaggtgattactaaaccaaacgggatgcatcaaaacatggcattgcttggattgtatggttttttgacatgtgccaatgtctcgaactccattacttttaatcataggctttttgttaagtattcattatccgctagtttgcattttctagaactagtgtgattacctacttaaagtagaaatgcaatgagccacacttcagaaaatctgcattaaatataatctactcattgagagttttgttgtttctaaaaagacaacttttgagtggtttgcttgcaacacagataacaaatctatatgaaagtgactaaacgtctttctttcattggagtgtgttgcaataagaatggcttacccattttctcatccagcattttgttaataacccccatttagtgcttgtgcatggagtgccagcgttgtgcgtggcaccgtcacctgcgatggaatgagttaagaatcatttattcaacagacagtgtccacttactatgggcatggagccagatagcagagtggcctaataaaaccattaaaattcttagtcaaacaaaagagcaacaatcagaaaagggatcaaagatgcagtagttctccactgtttatcttttctaacaccttcgggatatggcattttcattgccataatagtgaagagagtgtccaatgttgaacgagcagtaggaaatgaaggagttctaggaaccatgaacagcttggcttggcaggagctgtggaaatcggtggcatggctgtgtaggaaagagtgacctgctgggctcttgttagagttgttcagcttttccctaggaattctcggtggtccccgtgggtgaggagtcagggctttcagtgatctcccatcatcctttagcagtcttgatgctgtatggatgatagtgaaacattcagaaccccttttcaaagtaaacgtgtgagttagtaagtctagccagaaaatattcctttgaagaagttaatgtcatcagacttctgggtacggttttcttaaataccatgaaaattcggttcctttgacttgtgcaaaataatttagctattattctgaacccaattttgtattgcattttaaaaaggctatctccttcagtaaagaaaaaatattaggaacaatgtgttcatatgaatataccactagatcgggatgcattttactggatattgtgtctacaattgttacccaaaggagtcctaatcattttgagatacattctgaaatatttacagataaaactgctttggtgtctggaatttgtttcaaaataatttctggttgcttacagatgaaaaaagatttgccatacattggtaatagctgaagcgctgatgcgtgcctaggggttcactctgtaattctttccccttttatgtgtgttagagatcttctttcaaagtcttagctaagagaatagtctccatttgacttgccgctgatttaacattttcacttatatcggctcttttggattggaacttggtaccaaataaatcagtagttttttgattcccactaaagttgtgaatcaactatctgaggtttctaaatgcatttgaatgagaacaaactatctagtaacatgtttgtagtttacagttaaaaatgacgaattagttttattgtttttgtttaaaggtggagaaaagaaggtatgcaagtcctcaaggaaaagcagtttgagtttttaaatgcatttaaaagaatgcccagaatagtgtaaaaattacggtgacggttaaaaagttttgttttcttaaatgtttgaatagataaaattgaatcagcctcctaaatgtttgcagattgcatgtgcctagatgtaaaaaatacatatctactagatccggtgtagcttggcttttcccccaccaccctgccaaagagaaaatagtgtgtggcttctgctatatatttaccacatagtattcatactttggtttacaaagaaaaaaaataaaaaccctttcaaaaagttgctctgtgtgtgtgtgtgcatgtgtatgtgtctttaacatccatataaccatattcaaagcttagggtttagctataaagataaacttttcagaaaactgaagatgttttgcccttttaacttcttccctcgatcccccaatatgcacaaaccaacctccctggttgtttgttacccaggacagcagtcactactgaaaatctgatgtagaggtgtgcactgcctgtttgaaaacacagataacgaagtagcacaaacgtcaagcatcctgcctcatttaaccctacaaatgattaagtttcaaggaagttaaaaaaaatgagacagtgtatttcgtaggcacattatctgacaaatgcattttaacagtccattttaagtcagatattcaagatttacttaatgttttcagacgtgtctaagtacaatgaattcattggttactcagtttactgtgacttttggttgaatttctgtgttcctcaatgaagtgtaagttccatgaagacagggactgcttgctttgcacaccaccttattcatagcatctagcccagtgcctggcatgtctaatttactgcaaagtcttttctaatgatttgcaacactacagatatgcccatttctgattgtaatatgcaaattatcagattagtggctaaaatagtatcatttttcaatcatgcaatcctccaaccagactaatgtgtgctagtaggtaggttgttgggtaggcgatacattcgttcagtcagttcgtgggcatttgctgagggtccagcatcagtctggctccctccctgctctgcagttccttcagcttagaggccctcatttacctgtgtgtgtggctggccttgcaccctgaacctctcctcctccgttttctcctagtctccattttcaggaaaggagagctgcaagggcattggaatgagaaagacatgtggttgtaggttaaaaataaatttctaatgtgtgatccttgagtaaacaaaataaatgagtatattaaaagcaattattccatgcattcttgatttcttttgggaaaaaacagtggatggggttttatacatattttagctataatgctgccttccaaaacagtggttctcaactgcacattgaaagtatttgggaagaggttcaatgattggacacttcccttagggatgttgatgaaattggccagtgaggggtggggtaggaatgagatggtatctgggtgtgggcatttttttaagagaaaggggacaaaatctttgcattgtacttatttgcatcaaatcagtaaccattattaactgtttcagtatctttgtactaattgatgttacttgtgaaacaattttaaaattggtgtcagggaactttggaatcgtttcaatagcagaaaatctatattttaaagcatgacttctcaaactttaatgtgtataagaatcacctgggatctagttaaaatgcatattctcaggcagtatgccaaggtaaagcctgaaattctacatttctagcaagccctcagggagcccacgatgctactcattggactaccctgagtatcaagaatatagggttcgggtgcagtggctcatgcctgtaatcccagcactttgggaggccaaggagggaggattgcttaagcccaagagttcaagacaagcctgggcaacacagcgagaccccatctctaccaagaaaaaaaaaggaagaaattagccaattagccaagcatggtggcctgcacctgtagtcccagctacatggaaggctaaggaaggaggattgcttgagcccagggatttcaaggctgaagtgagctatgattatgccactgcactccagcctgggtgggggtgacaaagcaagaccctgtcttcaaaaaaaaaaaaaaaaggaaaagaaaaagagaaagaaaaataataaaggggactgctgcttctcttagacagctcttagcttgtcagcaggactccagcttaacctagggtccccaggcatttccccactaaggccacattattcctttggctcagcagttttctggtggtgcgtcagttcaggcctttgcatgattcttctttcctgaggtctaaacccagtgacccttcatatcagttgcctggacttttctggtcttgtgggatacacaccggcataagtaagcccttttttttttttttttttttttgcaaagtgtctgattgaaaactttccttgtataaaaattcacatattatgacttgtattaattattctaaagaatataggaaaaatacagattgtacacagttttgcttcacggtggtatctcttccatgatgattataggtagtccttatatgtgcaagactggaataataaaatttgtattagtgagtgtacatttgttaaaaggctgtcatttcattttgagaatctcagatatggataggctctttttagtttatttctaatggttggttaataaactaacacatcattctgattaatttttaaaagagagaaagagacttgtcattaatttgactgagctttgtaatctcacgtagcttttctttttcgcttagtttgtacatgctaataagaaaatgcaggtgaagtaccttgaatatttaacaaacaaagaggacaagttaaattctcattattaaaacagatgatagctaattattgttaccctttacttcacagttgaaaccaccacaaaggcttggaaggagcaggcagacaattttaaagagtagtgattaaagatattctaatgctggacacctattcttaacaggcaatcagctaattactcaatgggtatattttgggtgggacaattccttacattacaggaatcttagcatccctccagcacacgtctgtaatatctgttcatgcagcctccccaccctaacgtgatgacaccaaatatcacctgcatccattcccaaacacccgctgacaggtataccattccagcttgagaaacactgatgagagggtcaacaaaaaagacagatgacacgtctgacttcaagttttgtttggaggtaaaaaagtggatttttctctcccttctttggctgattaaggaaaaaaggccaggccaacatggtggttaaagatgatgttgatttcgcctgttttatataggtttcatgctctgaatttcaaagtgggcctcataatcccatctagcatgttgcatatagttgatttaaagacaaaaagcttcctctgccttcagtgaccacatgtgatttccttggtgcccctcccctctatgaacactttcatgttgttagacaagtttgacaatttcccccatgaatcacgcacatacacttctgtcattgttaaaagcccatcgcaggactaactgtgccttgtcctgtggatgatagtcagttactcgttcaaatgaattagaagtcaacgttttcaccatcttgaggttcattgtattaactattcattgttggggacataaagactcttgcaagtatgaattttttgttcttaagtcacactgtattaaatagcaggatgactagtgataagcactctaacgtccttactgtttctcctcctcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggtaagtccacatcgaggctgataagtcaagggcccttgctgactctaccaatactgaaaattaaaactggctaagtgctgttgactctgctctttttattctaataatttgtaaaagagctacagggaatgctttaaagagattagcagaattattttgaagttggtagtgattgattatggcaatcagggacgttcatgcaaatattcttttctttcttttcttttttcttttaaagaggagggatttaaattcacacttaaattcacaccttaagactaaggtggctgtggcctgtctgtgagtcagtatgctagtttgaattccctgacctaaaaaccatccgctcagttcacaggactttctggtagctgtttcctttctgtttggcttcgtaatggcagggccccttattccacatctgttgatccagggctctgatgagaagcagttgtaactcttggtcctttgctgtcatctgtggtgaagtaggcagagcaggaaacaatgtgagatggagattctgtgtccgtgttctcattttctgggagagctgagtgacaagagaagagttagggacagagaagaccaatgacttctcttacaccgacagccccagttgggaaacactgtaataactgccagttttactttcctggacaaagccacttgagaattctgcagcccaagaattattttactcactgactccaccaaaacccaggtagaacacaaacagtgaccccagtgcaaaacctgtgtgtacgttatatacctgcatgcatgcatccacttctacatcccagcctctgtgttgcaactccctgggtctctggtcattccagagtaactcttgaagttctcaaagcccttacctctaaatttaattctaatgtagtttattttttaaaaatccacatatagtaatataattatttaaaaagaggacatgtgtcagaggtagaggtaggaagatgtagctgttttgtaaagccagctaacaaaggtgaacgtctgtaataccatcagaggtagaggaaggaagatgtagctgttttataaagccagctaatgaaggtaaacgtctgtaacaccctgatagttgagatttgctgtattttatcgaatctaagttaccaattttcagcctactttgttatttcatgcatcactaagaaagaagaaactgttgattaaaaaaattaaacatgatcatcataggttctagaggttctagttgtatcttaattccagagatatcaaaacgttaaaaagttgtgcattatggaatgcatgaagtacctattagtttaatgtgtctataagaaaacacattgcttatgaaaattactttttcattatcattagtgtgtaggtgtttggcttcacgcagaatagatgtatatgtttaaattcagtgatccttaatgttacagtgtaatttttgagcaacagcaacagcaattctgttaatctattcatttttattgttctgttttatatttcattttcattcgtttgcttattgtcccacttgtgaagcttatctcttaaatactgagtaatctgtctttaaacaacctattcacatgcactaggggcaatctgctagttcaaaatggcatttcatattaaggtaattctggttgggcaaaagattgtgccctaatgttctgtttagattgactcatgttgtaactcctcaaaatgatgagataaactttttatttcattggtgtgctggttcttaaaagttaccctttgagttccttatggaagaataagtatggaaaatcagccaagttaattctgaaaataaataatattacgaacaaggacaggcacggtggctcacacttgtaatcccagcactttgggaggccgaggtgggaggatcacgtgagtccaggagtttgagaacatgctgatcaacatagtgagaccttcatctctacaaaaagtaaaaaaaattagctgggcatggcaacctgtgctgtagttccaactgctcaggagactgaggtgggaggactgcttgggcctgggaggtggacgctgcagtgagctgcggttgcaccagtgcactccagcctggcagcctgggtgacatagcaagaccctgctaaaaaaaaaaaaaaaaaaaaagaaaggaagaaaggaaggaaggaaaaagattattaacattatttatgagactgcaagagtggttcaataccaacgggttaaaggaaaaaaatatattatcatcttatagatcctgaaaagtgattgacaaaattttgcactatttctgatgtttaaaatccattagaaaacagaactggatggattcttgatgttattacgaatgtaataactttttatgtttttacataaatgtaaaattttaaataacattttacatttagttttaactaaaagttacctaatgattaaacataagagcatgtttcttaaagtcaggaacatgaccaagatgcccactgtccctacgttatttagcgttgttctgaaggtgccagctaatgtaattacacaagagaatgaaataagaaaatatatatagagaaaagagggcagaatttgcatgtgatataattatatacttaggaaaattcaaaagaagctgaaatgctacaagcaggataaaataaatcagtttgtaaaaattaataagtaataatcactagctgtccttatttcaaataactagaaaacatgagtgaaagatttcactcataatttttaaatgctctaaaaataaacataacaagaaatgtacaaggcttataggaataaaactagaaacctctacagaggcatttaaaatacaattggataatgtaaagacataactatgcacagtcataatttttgaggtataacttgggccaaggacagcagacaaatccatggaagagaacaagcggcttactgtgtgtctctctgtgagtgaatgtatgtgtgtatataatttaatataatacaacattactttaaataagtgaacatattctgaattcttaaaaagcatattgttcatccttttttaaaagttatagtaatttctcttgtcctaagtaaaaataaatcccagattgagagagtacttggtagccaattgttgctcactggcagtagtgtcccttaacacttagtgtggcttcactgaacttttctgccacctcctgcctcatcagaacattatcccacttcgtttgcgatttctaagtgactccttaggtagtatggaaaagcaatttgtatgtaaaggtgttagtgagcaataatggcagaattttcagtattttaggatccttttggagacatgatgcctcattccaaatgagtaacactaataatgagcgattcactacttggcaaaccataaggagaaaattggtggtcaggcaagaataatcaactgcgcttattaagggcatgtagtcttaattatactgataggttattatgactcacaggatgagtagaactttatttcatcaatttcacatttgcttttgttttgttataggatcttagcctttttgcataggtaataatatcagacacaagtaatcctttttaaagaattataaattaaagctgttataccaatgtgtgtttggaggtagaagatgccatttcttccccttagacaggatctttaggaaagagacaagtcttatttataccttatcattagaatcaatcagtgttcattaagtgcacgtaatgtgctaggcaccttgccatgtctttccctatgcccaaggatttacccttctcttactctattcagataattgtttgccaaatgtgttatcctttgatgaggattatcggttaatgtgacattctacacatcttgccaaaataatcagatttctcatttctcttgccaatgctaaaaataggatggatgcattaggcattcttaagtaagtttgtaccttagttttatttctaatgtagatattgagtgaacccttaaaacaaaattacatgtgtggctgcaatcattattgggagatcaacccctccagtggtaacagataccagacataagcacaatatcacattatatgtgtgcgaaaagtggtgtttacccaacatgtctttggtcagacatgtaatgctgtttttttccccatttttgtttgtggctgggttttcttggcttcccccaccccctttagcacagaactctgaaagcctctaagtgatccaaccctaccaaccacaatttataaagtctatcataacagtctatgacaataaagaaaacactagtacaaatatggtgtctgatttataaagtgattcttgtttccagttttggcagcctccctgcttctgccagccggggggtgaggaaggagtgaactcagatccaaacgaggactcccaaaatggcagagaggacactcagcccatagaccccctggccagactgggtggaaagccatctgtttatgcacttactatacattctaagcacttgagctgtgactgcacttgactttagtgtgctggcttgttaatttcacattgggtacctgtttgcagataccttcctgaaacttacttgcaaaggcatttgaaagaataatgtgcaggagaaaggtcaataaacaaattgcacaaatcacattcttctccaaaatgggatgttcagtgcattaaagatgatcccctgggatgtgggaaagaagcatagggactttctgtatatgtattttttaatattagcttttaaaagctgtgctttagtaaatattttggaatgtacaaatatacgagagtgattttatttaatatttaaataaatacatatgtacatttcagagcatgaaaaattttttccctgatggagctgcacagtcagccatttttgaagatcatggagtgaagctgcaagctccatcaggacaagggccacagccatttcgcgcacatctgaatatatcacacttagtttattctcaggaatgaatggagaaaagcatgaacaaatgatcaatgacttattgaactctgtaaactaatattttacatcaacgaactcataaagccattcagaatgttacaagccttgttcttatttatacgatgctgtcttaccagtcctacaattgataattaggaatattatggcctgaggcagtaatgcttcagtacaataataacacaggtttatttttgttagaagttacccccagctggccctctcacatcagtcacattttcatcaggcttctttgttctgcataacctgactgctatgtagaggtgggcttataatgtgaactaaaaacatgattctggctccatatatgagttaaattttataaaactctctaacttccctccaaaatatgaaaagccaatggtattgtaatgactgctgataagttatcttgttgtcatatcctcaacaaaccattccctggagtataagcctttgagtctctaaagacttaactggagaacaggaagtaagaccagggagccataattattaaacaattcattcttacctgaaattcttttttattccctgggaatcaggtacctatttggcctcatcttcagaattcataatgtagaattcagaattcacaatatcctctgatattaagattaatatacccaaagatttgtagcactttgatcctcaatgaagtatttgctgttatttggtatagtctgagctgggtaacaaacagacccatccattcagtgaactaactaagaaactttttccctctcacataacaatccagacgtgagtcatccaggaccagtagggatgctcctctgtcctcagcatgaaccttccatctctgtttctaagttggcttctccatttgctgttatttctagataggggaagggtaaaagaaaactgaagacagtacctggaagtggagacatcacttccagtagcatcatatcggctggaagttactcataaaccacatcttgctgcaagggagactggacaaggtagtctctagctgagcagccatttgtccacaaagcttgaggaagggagttgcctataactaataggcaaaaaggagtggaaggagatgaggggacaatgagcagtctctgacattcactaaaccccatttaggtaggaaggaggactcaccatatataagcaagagttaactctgagaacacataagtctattaaaaattttaatggtcaagattgtattttcaaaaggtcaaaatactttgggattatttagattgcaagagagtgagagaaatttgaaagtagattcaacagcattcatctttttgaggaagtttcaaaggtctgtttagagattgcatctgtgattgtggaataaaccttgattgtcacctgcaccgcttttgctaggttttgtagattaaaaagagcattaattaaaaactagaaagttcaccagattaagtgattgtgttttctacatatgggaaacagatccccttggattgcaatctccattattataaggagctcattcctatttttgaactaatgtaaataagaaatcaatgaaatttaaatagattgtaactgcttgtgaaactgtaatcattgaagttgttatatgccactatttctcatttgcctattagttaaaaaaaggagaggagggattaaaccccattcattgcctctttccctttgtatacaagagtatgtgtccgaagaaagtttctcataaacccacaagggtacttggtttttggagcactcatgttcccaagtcacgatgttagtcatgtagtggttttccaataggatttcatctctgtttgccataatagttttggaaactgcaattcaaccccaatcacatttagcgtttataaaagctgtctttatgggaaagctgaagtaagacccacagagttttcctacaaaaccaaggccatctattggctttagctcaacaataagttattggcttgtactcaatttcaggggagacccagggaagaaggtaggaagcaggagggtttgcaagaggaaaataaccggtgagttatgtcagaggtgggcttttctttgtgttacaagtaccccaggatggaagaaaagatattctgcatgacatctttaaagaaacagagagctggaaggacatgcttgaaagaggagccttcattatgtggcctgggatcttgggctaaccttccagaagtggatgaaactgagggtccttggttggagagcatgacagcaagggatagattggattgttctaccagcagcggcaggagaggtacagcctgtgtaattgaagagcgggatgtgccttagagcagtgtttccaaacctcctggatcttaagactcagttggggcccttgttttaaaaagagaagagaaaagtcctccagatctatcagtggggactctgatttggcagttcaggggtggactctgtgatttcttcaaagcatcctaggaagaggtgagagccactggtggacagggaagccatggtgaatgaagtgactatatttgagaaggagtgtgaagcctgtgtggtatgaaagaggtgggtcccggaaattgtcaagagctgtctgtttctgagatgaccagacaacaaatgcttgctcaaacttttggaagttcagggtgttggggagttccattctcacttagcttctgcatcactaggctgctactcctgtcctcagtctttgcccttcaagaacactaggtagcggcggcggtggtggtggtggtaccagtaaaaataatcatcataatgataaaccctaaggctcatattcatcaaaaagtttgaaagcactcagaactcttctcttcagtgcctgtggctgcttttcatttgatctagtttttcatggtgaatgacaataccattatctccaccaccccaaactggaagtcagaagatggtcttatccttttattcacccactcttcacctctcccccatcctgtgaattctaccgccttacaaaaccttcaagtattgtctctactctgctcactgtgtggtcacatgaacagaggtcatcatcctctcttgcctgcatccttgcatctggccaccccctcctggtctcactgccactggcccatccttcccatagctgagggacttcgaaaatgcacatctgaacaggtcatttcttttcctgcttaaagcatccttcagtagatcgctgtggttgtcaggatgaagtctgagctgctgaacatgtaacaaaaagtcctctgtattctggaaagcctcgttccagcccctgcctcttcaggcttgttaccttgaatgctccatgtcatcgcctccatcgcaacttgtactccacggcctcaccacactatggtgctgaactctcccgacctggccataccctttcgcctctctgcctctctgctgtaatcagcaagtgcagagagggcaaagggcatgtctgtcctgcgaacagtgtcctcagaaacccacaggactcctgactcctagcctccatcagtaaactttgttgaatggatgaatggatgaatggatgaatgaatgatgagtctttgtgcatagtcctttgtatgccactccatgcccttctttgtgtagtcggttttctaattgtcttttaaaatccaactcaggcattacttcctggaggaggagcccacagatgcccgcccacccacctgtgggggtaggtgcccctcctgggcccacacggggcttcttgtaacagcagtaaccacacggacctggggtgaactggctcacttgaatgtgagcttcccaaggacagggtctgtgggatgtttcctttctacatttccagccccagtggcaagcacatagttggtgctcagtgaaagtttaaagaacaagtttaatgaatatgtgagtgacctgtgccctatgtgtgcacacttggtgtgctcaggtggcgagttgtttaatattgccagaagctagccagccatgtgatcaatccataggattcttaaggggctggaggtcactcgcaagctcagtgttttcctgcttctttgagaggagagctcttttcctctttggagcgtgaacacgttagggaccttggggttaggggtgctccttcactggtagccttggcccttttcttcctggcctcatggatctaaagcagctggcctggtatctctgaccccctttgcgtctcattcttagggagaagtctgtgagagcaaagtcttttccagaagagatgaggatttgtcaatgtagaaagcactgccaatggaaggtggcattatttttcaagtggcagaggaaaacagagacatggtaaatagcacaattagcccaagatgccacactgcagttactctgccaaacttttagatgacactttttaaaccagtagtatagtataagacatttgaaaatcgggctctttatgaagactaacattgctgtcataagactactttatgaaaacccaaggggacctttatctgtagcagaagctttctcatttaaaccatgaaggttaaacaataaaaactaattttctattcccagcatacccatcgcactcccaggaaaagcatcagtctgctttatgaaaacaaggacatgctattctttagctctttggtaggtagaggacatgaactgtttgcaaaaacgagtctcttccaattagcagacttcttttggaagaaatgatccaccagtgactgtatttggggtttggggaggaggccaactcacatcttggtaaagtttttcactgagaattttcactgatgggcatgggatggtggccgctgattcagtaggagctggagcaattaggaggctgagtgcagtggtagtggtggtgcggagtgtgtagaattcatgttgacaagagtttggctttgggagaatttgattagtcagtacttttatattaaaaataaagaattatagggatcagaatgttaagttacaaatttaaggtgaggatggcttttaccttcgggatgagtggggtctataccctacctaccttcgctcctcctatctgcctgctgggccactggaccccttgcccacctcatgatttttcccctctcctctggggagggtgaggacctgccctctcacctcccccagtgctcctgtcctctcccttcctggtgtcttatagggctctgctctacggaacctaggctgagaagggcaatccaccatgatcttttataacatgtattcaggcaacagagaactcaatgaatcctgctcttaaagttctttgctttgggtgtttttgcactatgggctcttcataaggaaccaggggtcaccagctccatccaggtgcatatatgtgttcccccacatcctgtggattgcaaggtcagtgtgagctttaggggagggaggaaagcgagaggctggggcagcgatactaaagcctatctcattagctattgcacaacacccagtggccactctttctgtgccttgttagccaagaatgccgtggaaataagagcgttgcaattaaggatgagctattgatgaaacactggctaaggcagctttccaagggagcagtgtgtgcaaaagtctgcatgtacaggagggcagagttcttgcaggtggaactaagagtaatttcatgaggctggaacctatggcatcccagagcctccttccaggtgatgaggtttgggagtacaggggaagaatattaggggatttcggagtggtaaccagactaagtgaaaaactaatgtttttctctgtactctcataacctgtctgacaccaaatatgtggcgtttgccctcacacaaagcagttctccaactcttcaggcactaattggatgttctgcaattcaattatgatactaactattgggaggtaacacagccccaacaggttaaaggctcagccccacaagactgtcccacttcagatgccattcacaagtgctaggttgttgcctgtatttctgaccaaccagctacaaatcgggggttcccatgacctcctactcaggttcggtaatattcttgaatggctcacagaactcaggaaagcacttgacttactatgaccagcttattataaaggatacaatcaggatccacccaatggaagagatgcttagggccaggtatggggatggagagggtcgtggagcctccttgcctctcagggcatgccactccctcagcacctggcatgttcacctgctaggaaggcagtggttaccctggctcaagcccactgttgagagtttttatggaggcttcattacatagacatagtttattaaatcattggccattggtggttgatgtcaaccgggaggtcaggaagtcaaggggtgtgatatggtttggctctgtgtctccacccaaatcttacctccaattgtaattcccataatccccaagtgtcaagggtgggaccaggtagaggtaattggatcatggggggtggttcccccatgctgttctcatggtagtgaatctcatgagatctgatggttttataagcatctggcatttcccctgcttgcactcactccgtcctgccaccctgtgatgaaggtgcctgcttctcctttgccttccaccaagactgtaggtttcctgaggcttccccagccatgcggaaccgtaagccaattaaacctctttcatttataaattacccagtcttggccagttctttatagcagtgtgaaaacagactaatacaggctgggactgaaagatccaatcttctaatcacatgaccggtccctctggaaaccagatcccattctccaagggtcacatcattagcataaactcaggtaaggttggaaggggctgattttgaataacaaaggatgcttctgtgacacctgtcacgcgggaaattccaaaggctttaggagctcagtgctaggaacctgggatgaagacgaattgcatatttcttattatattacaatattacacaggcccagttatgcagggccttctaagccctggtaaggaacgtggacttgaacctgaagtctggaagcagcccccagaggattttaagaagggacatgtactttaggatgcactctaacctcagtggatcactttgaggagggcaggagacaggaagaggaggtaggaagctattatgctagtcctaatgagaaatgatgaaaacttgaaggaaggcagtggtacccaggttggagaggagggaatggatttcccagctatttacaaggtggaaatctgcaggacttctctgcaggaattggaaactggctattcattttcagaaataacccatgtgtggcattcatgtgctaactcggctgatgaatgcactattcttgtaactaggttggagaagaattacatgaagggtatcattaagatgttaaaatgaatgcattacatatgttaacaagtgtatgaaccctgtattatatctggcaaacggggtgttaaatccttgttcaaccagccagatgtctctgcagctgctgctggtattgcagagggaggcagccacctgagaccccagctataagctggtgccagtgatttccaaagcatctggctgtacaaattccttcttctgtgctctgattgacaggtaccacatggatcacacaattcacatcacaatgcacaggtgagattttcagtctgataagcccagactccagcaacttgaccttttcagaatatctttgcagctgagaatgttctcagttggagctgaaatctatttattattattattattaatttattttttttgagatggagtctcattctgttgcccaggctggagtgcagtggtgtgatctcggctcactgtaacctctgcctcccgggctcaagcgatctcgtgccttagcctcccgagtacctgggattactggcaactgccaccatgcccagataattttgaaaatatttttagtagagacgaggttttgctgtattggccaggctggtcttgaactcctggcctgaggttgatccacttgcctcagcctccgaaagtgctgggattacaggtgtgagccactgcaccaggcctatttatattactttgtaagttgaaaaaaaaaacactgtagtaaaacaatcttaaaaacaacttaataacattctctcctgaattggaatgttatcaaagtcttgtttggggcagttattcagctgaatttacaaagaggggcgtatcctttgctgtaaatgtttaaattgcctgaagcaaaattcccataactacttaaaggagttgaaaatactcctaagtgtttatacttattcttacacagtaccatctctcctgagtggccctagtttactgagattgagccagctctgagacatctccctcctccttaagtttggcaaatatcctaaaacgtttgaaaagatgtttaaaagatctgaaggaagctggtctcaatggaccagagacaaagtctgcacagccaggctcctgggaattgcacttcttggatgttgagttcaggagaggcagtactagagaccacagttacacaatcacattgatcttttgtgtactttgtttcctggagaagaaattgtgtaatcccagcatttttttatgagttaaatagaagttgaaatttaaaaaaaaaaatcacattggttgttttcctgtctgtttaaatgtactctgacagcaaagatgaaaagttaatgcagtctaaatagaaaaataccacaatgagaagattttaaaaaaatattgtgaaatatcctcatctctattgtttttagacgttggggtttcaaatctgcaaaggctgactgcggcgttgtcaggattgtcaatgttggacagcgtccactaggtggcagtatctcagaaggtttcttttatccttgaatgggcagagatttctttggttgctctctttggtagttcggtttcctttttttgtcttgttttgaagggttaaatgaagctatcataatttacttatctaaaattgcacttatctaaaaatgcataaattcattgcaaggcctacttgttacagcgtgaccataaatgagtttattcattcatgtgaattttcttggtaacttattattaatgatcctagcgtgtaacagatgatgaatatgccgtatcctgagaaggtagatcacaaatcctcctgggaagctggacatgggtgctcattagccaagagaagaaaataggggcgtcctttgcccagcttcctcagcctggtaactgtttctggcttctgctccaggctgttcgctgagaggtttgttgaagttacctgcacttctctacgcaaatctacaggcattctgatggcgtaggtaacatgtggttgtgttggatgtttattcagagtgttaactaactggtttttgttaatttacagctggcttaaaataagataaaatgtacatacattttttaaaagatctctttcatgtgaataatttgttcagaagaaaggagtcgggatattcttttgtagtattttcccaaaattagattatcagaactttctgaattcaaagaaaccggcagtgccgtctgaatgataagattttggaataaagaactatagaaattttaaaacactctaattaatctgacagatgtagaggactaatgtggatgaaaagaaatgtaaatgcaaagcttagaaaataaatggaattgtcaattggggtgaagtttgggttcgtcttcagaaggactcctataatcctgaaaatgaaaaatattagggggctatcaaaaggtctgtgtttggcatgtgcatagcaaggtctctgatctttgagaagatggcaacatggaatggctccagctttgtggagtggactcgatagggtcatgtttggagatgcaatgtcccttatccatgtcctgcaggtcttagtcttgggggttcatcagccaagccataaacatgggttggccagttctcagccagttgttttctgaagcccctgggaattctgagatcatattttctgatgtcccggctcctttttgtcagatcccaggatccccagcagccagatgccagtcaaggtgagccaccttttcagagttactgcttcagggagggagtcacgctagggattcctgggtgggctagtggtattttgtcccagctttcaggagtgtattttatgacgatggcttgtaaaaggatatgggcatacagatccagagaccaaagttcaagtctcagctttattaggtgaagccttattctctctctgcctccatttctcagtctgaaaaatgaggttagtagtagttatagttttccaggctctgattctaacaaaagtcaaatatggtaacagggaaaatactttgctgtctacaaatgtaagaggttattaaattttcaatacgtggaatatatatgcaagtcatgagactatagtaaacccttaactaaattgagatgtcaccaaacaactattcatgggaacacttaattagtaacaatgcttctcaatacctgctacatattcttatcatctgggagcatctttaaaaaactacccagtcactatcagactaattgggttcattatcctggctgaggttggggtcagggtatgggtatcttctaaactgcctaggtgtctctgctgcgcagccaggtccctcactggaatgcatcaagtactgcctacaaaacttcagttacaatctcaaggccagaagacaccctaaaagtctagtcttagaagaatgttatttttatgattgatatctgtgcacataaataacaatggttttagagctcaaaaagctggggtgcagatacagatattgggaatactttctttgtaccttgaggtacatgtctatagacagtcatgcgctctctttttgactctgaaacttacctataaggtttctgaggggaattgcaatccttcaacacccaaaaggtataaaatgagagcagcattacctcttgggtctctagctagagttttaattcatcctgggtcatgaagccttttgttcttttttttttttttttttttttaaagcagacattgaaagtgcatctgagaggtgctgctggttactgaattttcctgaaacaaaatgggtccgtagcaactctgacctagaagtttctgattaaatgggaaagaaaagttcatagttcattcccgggtagaagaggacaaactttccctgtccgttgcatcggtggcttgagtctgctgcttctttggcctggatatcaagctcccagaaaatctccagtctgtgcctctgtgaatctttgaggatgtgaaagggattgtcattctcagatgaggccccaggccagcaacaccagctcactggtgctgaatgcaaattctcaggccccaccccaaatctactggatcagaaactctggggctggtcccagcagcctgttttaacacgccctccaggaggtggtggtgcaatgcatacatgctcaagtttgaggaccactgagctaggacaaaggcacttttcttgtttttctttttctttcttttattttcttttttttagacggggtcttgctctgtcacctaggctggagtgcagtggcacgtcacagctcacttcagcctctacctcctgggctcaagcaatcctcctgcctcagcctcctgaagagcacaggtggatgtcgccacacccagctaattttaaaaaattaatttttatagagatgaggtctccttatgttgcccaagctggtctcaaactcctaggctcaagtgatcctcccaccttgacctcttaaagtactaggattacaagcatgagccatcatgcctggcctggctttcttgattataagtgtgtttgtatagaaaatcacaaaacaggcatttgtaggtatatgctagacttagttctgcttccttctccccttccccatctctcctctgatggaaaggcagatcagagctagagggaaaatgaggggtagcgttcaatctcagaattactctgtcaccaaggttcctcttccaatcttttaagagccagtaatcaagtaaagatatactgtgtatatataaccatataaagatatacacaatgtttagagatacgctgcatatccagctttgctggcaccaaagtgaagaagagatgaacagaggaaggtctattccctaaggccacccatccacctgcctgacaagaactgggaaataagaaactgctatcaaggcatgtccctgttacatgtcagacccctccacacactcccacacttccgcagcacttggcacctgctgcagcaagaaaaatgcccaaaagccaactaaacaagcagtagcatttgaaggataaggggcccaatggctgggaaactgctgatgtgagaaagaccgcacagttacactcacatttgcagcaggtagtagagcgccatgagcagcttaataatgaaattttcctatagccttaagggagaaaataaaaacctgcagaaagaaagaaagaaaaagatgcactgtgttatctataagtctgttgtgaaggcaggggagacaaaactaggaaattccagaaattaggcaccattgagaacccggaggtcttgaggaaatcttggaagactggaggttgacatgagtggggaagaaaacgaggcctgggaagggccactcaacccaaaaggggctaccatgtgcctaaatacccgccctgcacacggcactcccagagctgtgcagtgtagtgccccgggtctaggcaacagcagaaagtggctttgagtgagtcctagggtttctttctaagagtcagccgcactgtgactagaacttcagaacaggtcagtgaagacagctgtgctatctcctccaacggtcattaaaaacaacgtagattcttatctctctctcagaagtttggaagcagaaagaagaataaatgttatctccagaatccttccagctaataacagttgaaattatgttattgcctctatctatctatctatctatctatctatctatctatctatctatcatctatctatctatctatctatctatctatctatctatctgtctatctcaaagccctcctctctagacacttaaagaacttaagctgcatggcctatctttcaaacaccgtggggagaatggttagcatgaatagttattccagtaacaggggaaattaggaatctctccagagtggttttttttcagtatccttataatagatatctcttttgttttttgtttttgtttttgttttgagatggagtctaactctgtcacccaggctggattacagtggtgcgatctcagctcactacaacctcccccgcaacctcccggttcaagcgattcgcctgcctcagcctcttgagtagctgggattataggtacccacaaccacacctggctaatttttgtatttttagtagatacggggttccactgtgttggcccagctgatcttgaactcctgacctcaagtgatccgcccatgccagcctcccaaagtgctgggatgatgggtatataatagacatctaaatttaccaggcactctgctaagtgcctacacacattatctcctttagtcttcacaagcaccctgtgatggggtgctgttaatatcctccgtttatgcaggaacttgaaccaaggtgaaagcctgagctttcatcccctccaccttactcttgccctaagatgtgacattttagtgtcagctaatgtctggatacaggtgggcatgtggttacctatttcatcctttattctcagggttcaaattgagatatgcaattacctatactctttatgttttttcttttttctggcttgtgcttctaatcctctatttgtggccatattttaagttaattgttggtactctaaaggctcttagacttccatatagtgctttaagtacactgtaactttaaagtaaaaaattaaccactgggagctaagcatcgttctctttcctgtgggctgagctttagtattataacagaaattcactaatgaaatagacatgaaaagagccttccagaagatttaagagggtcatatattctgtgtagttgttattttcctagttaacttcatctccatttgtgtacctgctacagatttttaattatgttcaattacgccatggtttataatctacatcgtcttttacttcctcttaccgtccaaagtattttgtttgaagttgggtatgatctcaaacacatcaacaccaattcttttgggggaacttccattgatagccacctaatacatataggaatttcactgccaatgttactatggcacctttggaaggaaaagagggttaatttgttgcatatgtaacagccctgaattcttattgctttacagaaagaatgattttataaataaaattatttttcctttttatttcaggaattacaacatatcgttggatcacagcacatcagagcagagaaaggtaagcatggatccatacatctgtatgaaatcccacagggtcactactattttggctataataatatggtttctctcatctccagcgatggtggatggctcatggttagatctggccaagaggagcaagcttgaagctcagccttttgctcatctcactattaatgccaccgacatcccatctggtaagctctatctgcatccagcctgaaaaatattttaagagtcatttatcagcccatttcaatactgaaacctatttttagtctgtcactgaatttttgagagcccttacttcaaagccaaaggaaagaccattcatcctcaggtgatgattcacatcctggaaactgtgattctcaaaaatgtcagaatggacatcatcaccctattcattttcagatcatcagaatggatgcttattttaaatgactgccagctgaaagcctgtaacctggaaggacaatcctttgttatgctcatctgtactttcccaagctaaagttgacacagccctgctgctgacctcggaggtgaatgaattcatcaggtagtcacatactcagctatctcctgcagaggtccagggaggacactttagacccccgttaagatctttaagagacagtaaccctctagaaaatgagatctcctcccccttctccaagggcttatcattttctctgagtaaatgcttagcttgatggactagagacctgattatcttgaaaatgaagaaacccggagctctctgcctacagctactgtaatacaccagttattccatcatacaacccccactggttacttcaccatgggctagatagctatcaaaaagataacagaactttatgatacagtgacaattgaacattcttgttatcatcatgccactaatggaacacttgaagatcttaaagggggatcttcaggtgtcctccctggcactctactggagatggctgagtctgtgactacccgatgaactcttccacctgtcaatcaggtgttttccccttcctcaatacctctcatccttactgcaatcctgcaaggtagggattatcacgcaaattttgcagacagggaaactgaatgatacataggttgtcatttgttcccagtcatgatgatgataggattagaagtagaattcccgtcccgttgattgctaagtccgtgctttccatgctctctattatcacataagcaggccacaaggtacttgtggtcagttggcttggccagagggaaagaattcaaagcccttatgtttctcttttcctgtgagaagtagattcatgtgacgtctaataacaggggtgctaaaatctgactgcctgggtttgaggctccattgtcctggctctgtgaccttgtacaatttattgcaatcacatatgcttcagcttcatcatgtctaaaatggggatgttgatagcatctgcctcaaggggtagctatgaagatgaaatgaggtagactgctaacattcttgtgtggaagaacggccatagtaagcacttgggagtgtgatttgttatttttgagttcaattaaataattatacatattccacctttttcctacaaataatttaaggcaagtttttctcggagttaaagaaagaaagttcaagttttgctaagttatttggaaaactttgttacggcatggacaagggggaatttttcctgaccgaagacacagaaagggagaaaccaattctttggcttttagaggattttccaaatgacctctcctgtcccagacacttgcttcataaataatttgtctcactgtgtgtctatgcatgtcttgtggtggagctacactaattttctctgagtggaaaactgttttgcatgttagcaaaggcaatcaaataaatatggatgcatctgtattaatttctctgagtggaaaactattttgcatgttagcaaaggcagtcaaattaatactaatgcatcagctgtgtgtgctattaatgttccctacatttatcttttcagttcactttaaatggcatatgataaatattgcattagaccgtttgccaaagtctgtttggcaatagcaagcatgttttagttataaaactctctctgcaggcacctagcatcaaatcattgccaaaaacacaaggcaaaactcctggttattttctgacagttattgagtttgtgactgagtgagatgagttagtgtatacttctgtttaagaaaatagaatttgtggctctggctgggcccacaactccttgagtccatttattacccagttttggccagtactggaggtttcagaggaagtggctttaaatttgcatgttcattttggggctctgttttatacttacttacacaagtaaaatcagaatctgccttatatggactgataccacttgcattttcaaaatatcttagatgaaatgcgttgggaagtatttagtgaggtcagaatacatggctttctttaggaggatactcaggctaaatatttgcagagacctcttctgcggtacttagcagcagggactgaagtgtagggcaggggaggctgggaaagctggcaggctggagtcaggggttgtcagtgtgcctcagtgatgaaaatccaggtttccatgtgaggcctgctgtgtgatcactgcatatttttctcatgtttttacctggtattatctgcttctgagtcctctcttcacactgactggctctcctccttttcccccatacgtgccatgcatattccattctttgctcagtttccttcactgacaataccctcccttttctcagcccatccaagtctgacccaaggccccactgtcctctggcttctctgccccttcctgagctgagctctcctgcttgccatgaatttctgtagctgtctcttggcagttgcttgtaactgaatgtcaaccatgtgctatgcaacatgcagaagtgaaaatgcatattttatatgctcattttctattttctctactattagtggtgagtgccattaaggcacagttggttgatgtaattcttaattacgggcagactgcctgttcctaaaaacaccacgtagatattgtgtgactgatcaaaagcatgaaccagtgaatgtatgagtaagtcaatgcacaaaaatagagagatgtttagtaggaaataagggcacttcttccacatgacttacctaacaatgggaatggtaatcggtcaaggttcctctcttctcctgcctctctatttcatattctttccttgccttcctaggccatatcttgctctaacgccagctgatccatcccattgagagggtagacttctcttctgttaagagataactataagaaaaatcattgattgaacaacaaattgactgcaagagtgggataagaatgaaggcagcatgggataacttgagatgggaaacatcttgaatttcatggattttgtcaatggattagaggaattgcttttactagtgttcatgaaggtgtgatgatcatgctcactcacttggggccagatgatggtatttatatctggggtgctttaatctgggatgacctgaaataagacctccgatgaaaaagaagggtgtttattgtggtgagcccaggaggcaagagggcctgtgatgaccccgctgcagataggttgtggagttcaggaaatatcctgtttctggacagagggattggaaccattgaattcttggtcttctcatgatggattgccccaccgttggatggcccttgctgcagtttttctcccaagtggttgaaagaactgcctgtttggttcctacagcctagttttgaggctcccagatcatatcccaggctcccagttctttagagataaaattgtagaacattctctatcttgtgggcctctagagaaggatgtagatgttcaaggcccaccaaaccagactaggctgggaaggtaactagtgtgtgtttccttttttttgtttgttttgtttgtttgttttttgagacagagtcttgctctgtctcccaggctggagtgccgtagcgcgatcttggctcactgcaacctccacctcctggattcaagtaattctcctgcctcagtctcctgagtagctgggattacgggcgcctgccaccgcgcccagctaattttttgtatttttagtagagatggggtttcaccatgttgaccaggctggtctcgaactcccgacctcatgatccacccacctcagcctcccaaagtgctgggattacaggcgtgagccaccgtgcccagccatgtgtttctttctcgatgaggctctcataaggattcactctaatcagagagctgtcagttttgatggatctctggaatccactataagtcttcatctctgggctaatttatctccctcagcatctcagggcctgacctaagttgtggttgggtgtgacaggcagcagtgaacttcttgtggctgcaggaactctctcaactccagtctgagactcaactctgctttgttttgctgatttcaaactgctgaccaccttagtttagtataagtatttacaaaatcctctggaagaaaaatgtatttttgtactttccacagtattacaactttcccaccattagttaccagcttttccagttgaacaatagtgtccacatcaatacaaatctttgattaattgggtttatcacagaggtattgccaatttttaatgacccaggaaaatacaccaaaggacctgaaatatgaaaaggattggacacactgctggtttagaaggttctttagaaatttttactgctctgaagctgtagcaagaggaccaggtgtcacctcatttcaggggtgagtagggctaaatgagaattctggtcagtcaggagaagctttacagacctttggtcagaaggattgtgtgaagttgttaagctagggagtgcaatgctaagaatatgttctttttgagcttctctggagttagcttttcagttgtgcaagctaaggtgggagacacttgggctactggaggtgaagaaaatagattatgagaattgagtttagacgtctgacctttcagccaaagttactgtgacccagtttttcatctcctactttccctcttcatgagttaaaagagaaggttgagacttgtgacatgtggaaattgtcttcctatcctagtttcttgctttcctgtctcagttgcctttggcttatctcttccttcaacctggaatgacctttctgctcctgtctgtgtggctgaatcccatttctcttaagttctcaggcttagcagcaactccacaaaggcattctttacccttctgggtggaaagttgttcttgtctctccgtcctttgagctcccatgggagttactgaaccttgcctattgttactcatgccttacttctgctctgaacacatatcgtacttacccctggtgcactatagacgccttgagggcaggaaaaatgagtttttgtcttcgtagcctctactgtgcctaacagaatgcaccaagtacatctgaatgtattctccccttctagaaaagaaatgccaataagttattctccctttgaaataatgactgctatactattttttctccctaacctcatagaattgtgaagacgtccttctcatttaaggactgactttcaaatcttatgcctctcttctccacaggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacgggttgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgccttgtgattttgtacttcaccttcatgtctcttttgctctgtgatcctattattttcaatatggtaatgtggcttctatctctttccaaaggttactgggagaaatgcagatttaattaaaaattagaagcagattcaattaaattaatgatccttggaatctgaaaaataatttgcaaggaatttgtatgcaaggatatatccagatagaaaatggagtcttcttcacttaaaaaagccaaaatttatattatgttgatattgtgagaaaaatatggtgctttgtataagttcataatgtcttaaagaataactgtgcatgttgtgcacacgtaccctagaacttaaagtataataaaaaaaatagtaagaaaatgcacgcacacaaaaaagaataactgacctggaggaacacctgacattttataccttactgtggtaaggaagaattaacagtgtcctggactcttgttctcatggaaatttatacaggaaagctgtctgacccaggttggttacttatgtgggagagatataagaaaataagcagcttgggaaggcactgtacaccataatctaaggcacttttcatttatggataaatgtttttagatggctgtgacaggatagaaggagagaagaaacagcagatgttacaaagaagaaattgtaaaattcaaacagcagagctacaatggtggaactcaatcattggccaaaatagacctactatttaaaaactgtcagtacgtctaaggtcaattggtataaaatatgacttctgtgtttcatgtcccaattgctgagccttagtttaaggaaaaaataattttgataggcaatcagagagtttctccactctccattggcactgtcttattatgtagagtgcctcattagctactgttgctctcataatactattctgttataggactaacaggttcatatgcccactgcacagtaacagtccaagtacactgagacagcaagatttgtggcagaggaagagtttaatgatctcagggcaccaagtgagaggatggaaggagactcagattcatctcccccgaggagttctgggctgaggtttttaaggggattagggagagcgaggggttagaaaattggggtcattgagtggctggggtaagagggatgaaatcctcaggatgtggaagctgcattccttggtgagggagcttctcatggggtcctcttcagatcagctggtgtcagtagttttgctgatatgcaggacctgaaagaatgtctcaaagggaaaacttaacattttgtgatgttcaagctgttatctatggagcatttaaagcgaactataatcttagagtctacatgattctaagacaataggcaaatagctatgaggaaggggtcggagagcaagctgacctagtgatggatgctgagtgtgttgcaagcttgctttatttttgttttcccccctctttgcttccctgataaatgttataaagtttatagggacagtttcaaatctgtcatttccaaaggtgaatgacattcatccatttgtttgttccatattatttcttgagtaccatctatgtgctaggcactgtgccaggcatgtggatgctatggcactctccctgcccttgaggagtttccattctagttgggagccagcctagcaagggtgtgtgtggtcagccctagggtgtggacatacacagcaggctgtgggagcagagaggaggctatggaacccatcttgggagccacagaaagtctgaaaatgatatcagactggataggaagtggggttgaaaaaagctttgaaagtggatatagaatatccgttaccatttttaacttagaggtaactgaatgtgcagtctctcaaagatgaactaaaaatccaaggtccaggaatgaaaaaaaaaacaccccaggatctagtgaggtaagacatggtggcaccagccaaactggagaactaacatggtagagggcctgcaaagccaagggacagcctgtattgaagaccccaggccgggcgcggtggctaacgcctgtagtcccagcactttgggatgctgaggtggctgaatcaggaggtcaggagtttcagaccagcctggccaacatggtgaaaccccatctctactaaaaatacaaaacgttagctgggtgtagtggcaggcgcctataatcccagctacttgggaggctgaggcaggagaattgcttgaacccaggaggcagaaattgcagagagccgagattgcaccactgcactccagcccgggcgacagaatgagactctgtctcaaaaaaaaaaaaaaaaaaaagaagacctcaataatggagcctacctgtaatgtgaattttatgtacattagcatcatagcaggtcagagatgttttagagctttgctggaatgaatctatgacttaatgaaaagtgagtataaattggactatgccttgaaggaggcaatggtagcaagtggatatgccaggaggtatggaaaagacttttctagtcatgctcaaggcttgccaggctgagttgtagggtctaaaatgcaggatgcaaaataccctactttcctcttcacatgctacttttttacttctgtttttcttctcactcatcccttttacccttttgtgtgtgtttgaactcttcccttttttcttttcctgttccccccaatgcctggctcttgcctcagatgacaatttcatttctgtggtgggcctcggggaataaggaggctgctgcatctaatggagatggaaccaggtcatgtcaacactcagtgacagctaagtgtgttgaggtgtgacaaaatcatgtcaggaaaccaacacatatgatggcaaactcaattgtttgctcattttaatgacttcatttcaatcttattcctaacacatgccaaatctgaaggaaggaaagagtgtcaaagttgaagccatctgtcttcttgaattgacttgcaactccaccagaccatgcacccttgcacctttcaaagcgccatgtgtgcaccaatttttgtttagtgtacctgttttcccctctttgcctatttccttttctctattcatcttcattaggccatcctagaaaaaaatatctggagcagatgatctatttccccagtgactctgggggggaagctgagcacctcatgtatatcctttccctctgggtctgattattggtttggcttgagctagtgccatcaggttatacttgtacattttgggagcataaccttgactcaaattgcacttctacgtttagcctggccaaacatgggcttgcttcacttttggctttgttaatcgattcttcagcttccttgctatgaaattgaaatatgtttcccagtagctgcatttataaatgctaattagttattgattcacattattatgatttagccttgtgtcactttctacaataaaaagtgtatacacagtgagtgttagatttcagctataaagcagaaatctatccttttgattaataacacttctatgatacttctactcttctattcctgtaatttaaaatgtttatttcctaatcatctaccatcacctcccctctcctctggtgactgatttcctttgcaggggcttgtcattattgcaccttgaccagtgctctggctgtttctagtggcagtctcttgatattatcagatgtggacaagttataacaacattattcatattgctactggctttcaatgtctgtaaagaaaccatgtagagtcttctgttttgaaaattcttagacgtgtgtcttccagttggcaaaggagtgagctagaagttactccattagcagcacccaggggatcagaggtggtttcagaggcaagaagtttttctaaaaaggttgatagttacttcagtctgcctaaagagggtcctagaatcatgggatgtcactctgttgggcaaatgccaatttcttccctttcctatggattctgcagacacttcgttttctcagaagtgtgatctcagcaacctcaggttggtggaacaaaacgcctcatgagatgtgaacatcttttgaaagaaagattgcagatttaggtgtcagccagacccaggcctggagtctgatctccactgcctggtaccctgggcaggtggccatcatttagattcagtttcctgccttgtgaagcaggagtcaccctgcctgagctgagtcataaggattggcgcaaaacgggctcaacaaataggagccaccgtcaccatcctcctagcccatttgctatatccttgcacaaagtttacgctttttttctctagatgctgggcagggcccacattaagcaaattactgtgctctgcattgtggtaccagaatagatactgtattaattccctacagctgcctagataacaaatgaccacaaactggctggcctaaaacaacagaaatatattttctcacagttctggaggctagaagtccaaaatcaagctgtgagtgggaccatacccccctgaagactcttgggaggaatgcttccttgcttcttccaggtcatggtggttgctggcacccccgtgtgttcttttccttgcagctgcatcactccagcctctgcctctgtcttcacatggcttctctcctgtgtctcttcacatgattcttcctccctgtgtgtttttttgtgtttgtgtgttctctgtgtctccaaatctctctcttcttatgaggacaccagcgactggatttagggcccattcatcttaccttgattaagtctgcacctgttcagatggacataaattttgggggaacgctattcaacccagtatagatacaaggaacttagagttcaggggtgaaataaatatttaaaagccaagtcataaacaaactggaatgaaataaatgccacaatagaagcacaagcaatgaactattgaactcacctaactcagtgagggtttgctttcattgaaatatgagtgaaaccatattttgatgacatttgaatagctacaatgtgctgttgtgggctgcgtgttttcaagagattatttcggggttgggacaaggctcatatgcactcctatttacctccactccttagaagatcctccctacacacacacacacacacacacacacacacacacacacacacacacacatgcacacacaattcacccacgctacactaggacatccgggctctgcagatgactgctacctggatttatacttgtttcttccttctaatggcgaatgtgattttgctcaaggattagagtttaaccagtttgaaatagttcatctctttaataaatacggaataagatggagaaaacgttactccccggagctccagagtgcagaggaaggtggaccagctagatggagctttccccagggggatctgcagggctggagatttagcatggtgttctgcctgcatgccagggggccacacgacgatcatgtgggtgatggcaggaggcacagttgggctgagaggacagaaccatattggtgactctgaagtctttggtaaagtgaccagctttatgagtttgttgtggttgcattcctggtgggaacccagtggaaaggcagagtttgactggcgctacaagatacagaatggagcaggctacagaagcaggagcagagagaagcacaaggccatggcccgacctcaggtgtggagatgctggtgccttgaggcggggtccttgaaccttctctgggcagggaggccttcttttgttagttagtgtgctccggagatactgaatcatagtgtattggtataggctgggaagtccccttcctgcaagctggaggcccaggaaagccagtggtgtagttctagttcaaacccaaatgcctgggaactaggagagctgatggtgtaagtccaggtctgaatctgaaggcctgagaaccaggagtgctgatgtctaagggcaggagaaaatgaatatcccagttcaagttgagagagcaagttagctcttcctctattttgttctattcagactttcaatggattgggtgatgcccacccactctgtggaggatgggtcttctgcactcaggccactgattccaattctaatctcttccagaaagcccttcacagacacacccagaaatcacgttttgccagctatctgggcatccctcagcccagttaagttgacacctaaagttaactgtcatgctgcactgaggacacttgggttaggtataaagtggcttgttcaaatttagaaggaaagcatcttaaaccctaatagatgaaagaggaaaagtccgcacacaactctaggggaaacccaataatacaccaaactttaaaaaaatttctaaatgaagaattaagtcatgaaataggggataagaatttgtgtaagtttgcctaaatagacaaggttcagagagacattatctatagcagcaggggaaaaaaggacccccagagagcatcagatacatacagcaggtgcaggacaggtgcagcaccttccacttccctttgttctgcagaatcaccaacacaggtggcacttactccaaaaggcagatcttatcttgagttcaggcacaagtcaatagcacagaagcagtgatgagtgtctggtccataagaaagagataagtgtgcaacttgggggagagagtctgtcagttcaggtctaagggcaattaacatggaaacgattttagtgtgtggtcaagatctcaaaaacaggaattcagctctggaagaagactaacagaatccctagaagtgggtcagatcgcaggtggctgggggtacaggcagtgccccctttcaagacaccagggagctgtaggtgtgggaggaaactccaggtgcccatgatccccgggtagaatgggccagagaggaagataggctcccctgtagggtagattcagaaagcagctatgaaatctcatccctgaaactgtgaaagactgttaccttctgtattagtttgctagggctgctgtaactaataatgacaaacttggtgacctaaaacaacagaaatgtattcttgtgcagttctggagccagaacttctgaaatcaaggtatcggcagggtcaggctccctcttggaggatctgggaagaatccctctttgcctcttgcagcatctggtggctctaggagtttctgtggctacttcactctaatctctgcctctatcttcatgtggccttcttcccttctttctgtgtcttttctgtttttgcttttttttttttttgagatagggtctcactatgtcacccaggctggagtgcagtggcacagtctcggctcactgcagcctcctcctcccaggttcaagcgattctcattcaagcctcagccacccgagtagctgggattacaggcatgcaccactacgcctggctaatttttgtatttttagtagaggcgaggttttgcctgttgtccagcctggtcttgaactcctggcctcatgttatctgcccacctagacctcctaaagtcctgggattataggcatgagccactgcgcccagcctgtttttgcttcttataagggtgttacaataggtagctagtcagacatgagtagtgcaggagaacaacccccaaccaggaatgtcaggccaccattagatgatggtcaggtggttgtcaaactctctaaaataattggttgcggccggcaccagggaacagcagtctcccaatagatagaaacagctgaaactggtgatcagcagcttcccagtaagctctctaagagttgacctagtgggctcacacgtgagcactaagaggcaaaatggtggcgtttaataggcatgtgactttcctctaggaactctcaactggtaagggaatgactcatcaagtgagcatgcgtacagctttagtaaacacactgcacatgcagcccctcccaagtgctacttccctctgttctacaaaatcaccaacacaggtggcacatactccaaaaggcgtatcttatcctgagttcaggcacaagtcaatagcatagaagcagtgaggagtgtctggtccatgggaaagagataagtgtgtaacttgagggtgagattctgttggttcaggcgtaatggcaattaacatggaaacgattttcgtgtatggtcaaggtctcagaaacagggattcagccctggaagaagactagcagaatccctcgaagtgggtcagatctcaggtggctgggggtacaggtagtgccactgcacatgtggacagcgcaccccaagaatcaagggagaaagaatgcaagatcccagaagtatgccaaggtataaaaccccaagtcaaatgtcaaactgcgcatttgatctctcaagttgcccacttggccctcctccaagtatactttccttcctttctctcctgctctaaagctttttttttttttgagatggagtctcgctccgtcacccaggctggagtgcagtggcgcatctcggcaagctccgcctcccgggttcacgccattctcctgcctcagcctcccaggtagctgggactacaggcgcccaacactacccagctaattttttgtatttttttagtagggacggggtaaagctttttaataaactttcattcctgctctaaaacttgccttggtctctccttatgctttatgcccctcagtcaaattcttcctgaggaggcaagaattgagattgctgcagacctgtacagattcaccactggtaacaagggcactagtcattggattgaggttctgccctgttaatccaggaggttctcatttaaagatccttaacttaattacatctgcaatgacccttttcttaaataaggccatcttcacaggttctaggcttt

SEQ ID NO: 1317 - DNA, 2226 bp, Homo sapiens
ctcgacccacgcgtccgcgcgccccaggagccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccccgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacgggttgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtacctttttttttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgaaaaaaaaaacaaaaaaaaaaa

SEQ ID NO: 1318 - DNA, 954 bp, Homo sapiens
atgcgccgcgccagcagagactacaccaagtacctgcgtggctcggaggagatgggcggcggccccggagccccgcacgagggccccctgcacgccccgccgccgcctgcgccgcaccagccccccgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattga

SEQ ID NO: 1319 - DNA, 67832 bp, Mus musculus
  misc_feature (26053)..(26112): "n" at positions 26053 thru 26112  can be any base
  misc_feature (28892)..(29324): "n" at positions 28892 thru 29324  can be any base
  misc_feature (30179)..(30757): "n" at positions 30179 thru 30757  can be any base
  misc_feature (32761)..(32780): "n" at positions 32761 thru 32780  can be any base
  misc_feature (43840)..(43859): "n" at positions 43840 thru 43859  can be any base
  misc_feature (57867)..(57886): "n" at positions 57867 thru 57886  can be any base
  misc_feature (60656)..(60675): "n" at positions 60656 thru 60675  can be any base
  misc_feature (61916)..(61935): "n" at positions 61916 thru 61935  can be any base
gtgagatgagcatacataagcgtctgcctgctcggctggttctgaggtccgaaggggctccactccggggcatgggtctccatggagctgtaccctgccgtgaccactttctatgcccgcaaagcttcctgccaccctctgctacaagcaggatggttttgcttgcttacccaaatgccatcccattttatactaatgagacccttttaattgttttatactttaacatgtctttgcatagtattttccatatatatgcttatgtaagtatatgtctctgtgtgtgtgtgtcctctagctggatagctgaatagaaggagactacccggcttctagatatttgtgaatctcccaaatgactgtttcctcatctttccaacataggagagttttgtggtcctgaggaagttttggaaaagcagccaacctgggaaggaggtgatgtgcttagcattttccaaaaagatacaaaagcaggcatggcctaaaataacacggaactagaaagaaagatatcctgtgagcctggcctctgccaatcactagcatgaatgaatgcatttatttctcagtaacggtgatctaagaagaacatcagatagtagctgctaccctcttgaatttgtggggcagtgctgatgggaagtcaagatgaaagagtcatacagacatcttagtgacaaggcctgcctcggtgggggagtggggaaatcacgaccgtgttcacctactctgtggtttacacgccatgcatggccttcagtgctgggcagtgagaagcctctgctttagtgtgagcagagggctgcattcccaaacaagcctgtttgttattgttgattcttctgaagacaggagatcctaatttggctgagttagtccaatcaggaagaccctttctgctttaacctttacaaaaaagtaatctcatgcaagccagtctttaaacaaagaaaatttagtagtgtgtgagtgtgtgtgtgcattgtgtgtgcactggtcaagaattttcttaattgccaatgatgcaggagggcccagaccactgtgggtagagccatccgttaggcaggtgagcctggaccttataagaaaagtagctcagcaagccagtgggcagtgtcccttgtggtcctgtttccaggctcctgcttaagtgtcagtcttgacttccctccatgatgatctatcaccaataaggttaaatgaattcatttctctccaagttgcttttgggcagagatttttcatagcaacaaaaagctaactaggcgagcatacgtgtgtgtgcactgcacttgcaaggagagtcatgtgcgcatgtgtgaaaggcagggtagctttgcagttggttttctcctttcctttcacctttatatgggttctgggaattgaacccagatctctaggtttgcacagcaaatgctttgagctgagccagcttgctgccccgtcatggtttttcttggtgcttgtctttctgctcccaccttacctgctgttctgatttctgttgagagctctcggtctgtttcagagaatggaggcttggcgtgattcatgaattgtgactaagctgataattgtgtaagctgataattcctacttttatcttctaacaacttatttcctgaatgcttaatccggtgcaggctgccttgttaagtattctacatgctgaaaagttataaaatgctcagaacaaaggacgggcactgggggctggtgagatggctcagtgagtaagagcacccgactgctcttccaaaggtccggagttcaaatcccagaaaccacatggtggctcacaaccatccgtatcgagatctgactccctcttctggagtgtctgaagatagctacagtgtacttacatataaccaataaataaatcttaaaaaaaaaaaagaatctttaaaataaaaaaaaaaaaggacgggcactattataaattgtgatccttttacaaataaggaaactgtggttgcgaaggggttaaataacagcttacagtccagtggcttttccgtgctgagcaacagcttcagacccagccctcagacccacccactgctattcctccttggtaaaactgccttacttctcattccttccagaagttgtcaaaaggagcgtagcagtgagatcctactttagctgcaaatgagagtccctgcacttccaaaaccaggttctcctaactcctatcacgcactggtgccaggattcaccctgccttgttgcggtctgtcagtcatctcagccttggagcctctgccttcccctctcagaagcaaattacttatcagctcagagctgctacttctcttggggcagccaggccaggggctttaggttggttgtgaagacactgaattaaacaaacttccctgaatcctcaagctgagagaccacaactgcctgaggtgaaccaggcctcaagtgaatttggagtaattcatttctctcttttccaaaatgacaaaacggcccgtgcgcatggactagacacatggagttttctcaggttgcataacaggctggcctcccgggccaaaaaagacacgcttggtttcacatatacctctgttcaagcttctagaacatcctcctttctgatttatgtgggtttggcactgacttccagcacttgaactaaaaatgtctgatttccacctcccttaggcagcggatgagctgcagagtcaaatccattgcagaagctgtagttccaagaagaaaagaaaagccgccttatgtaaacaaagccttttaatttgttggttttattaggcagcccatgtactgactttcttcaaggaaactatgggatgctactatttttaaggggagcaccttaagggttattctagtaaatggatgttttttggagcctatgaagtcctgaagaagcccaggttttaggggaaaggtgagagaaaggaccatggtaagtgacagtgggggcagggaggaagggacagggaattccaataaaaactgggtgcttacactgagctggaggctttaacagaaagttccagacagacacacaattggataggagagagagagagagagagagagagagagagagagggagggagagagagagagagagcacgccttactagcatcacagggcaccaacagttcttacacgtgcctgattttgtaaaaatatatttaaggttaaaagacaaattacatgaatccggaagcaaacttggatccccgggtttggctgcaagcgcctttacccattcaaccctcgtccttacctatgattacgttctttttcttccccatcttgtattattgggaagtgaacccctgtgtcactttgttcctatttcagtagatatttctagaaaacacttctaaaacataattctgatactgcgtttcagctaaaataacagtttctcccaagtatccagggtgcagtccggattcagtttccagtttgtttgtttttccctaagtgttacagttttgcttgcggggtggtgagttccaaatagttgaaccaggctccaaacaaacattgtgtcaggttactaaatctcacagccctccactgctgtgcggcttccacatcttccatccctgcccccaccttctccccacccaccctctgcacccctctgtcccctctacccctctgccccttcagtttatttgttgaagacattgcgtcatcttccatattgattacatgcctgtaatgtgttataatgtgaattgaaatcaaaggattgaagagattctggtgttccttttgggtccagcattcttcccacgtgatggtgtatccatccatcagacagcatgtgagtcacctggctgttttcatttagtgatgctggcccccttgaggatcagtgcatagacccacttattcattaggggttggaaagcaggtgttacagtaggcattgtctccgaatggaaaacaaattgtgtcttttttcttctgaattgattatcctacccagaagtctatttgggttaggaaagacaagttatctcattgtgttttcccattttctacacaacagttggatcacaggcactatccaaggaataagaaccaggttttgatttggtaactctatggtctcagtgatatgaaggcatttactcttgttctggtccactgtggcttaggtgatggatgttcatggtccgatccagggagagaggaagcttgagtcagggtctcctctggatctgttgcacatacagctacagccccagtatcttttttgtttgtttgtttatttgtttttgttctttgggttttgttttgttttggtttggtttttggtttttcgagacagggtttctctgtgtagccctggctatcctggaactcactctgtagaccaagctggcctcgaactcagaaatccgcctgcctctgcctcccgagtgctgggatttaaaggcgtgcgtcttccatatcctccatccctgcccccaccttctccccatccaccctctgcacccctctgtcccctctacccctctgcccctttcagtttatttgttgaagacattgcatcatcttccatattgattacatgcccagctcagccccagtatcttaaagagtcagcttccttgcgatgccaggaaagttctcaaccttcctggacattttctgccccaggcctggactcacaaattcagttccttaataggaagtcatagttgcagactgcgactgagcactgaaggtgcgtgttgcttatgggttgggatttgtttctaggtcttttttggtgggcagaaatacatacttgaatgtatatgcttctatctgtacatataaatatcatatttgtatctttctatatgtgtatttgtgtcagtgtggactttgtaatgtgttttaattttaatataaacacatatgtgcatgcatgcatcttgcgctcactcaactggccaggaagaaccacgctgcaacaggatccttctgcacacgtttattcagtcctgtttcttcttgtttatatctctcccgaaccctgggcctctcactcttttatactctcagttcccatccacgcacagcaggccacgtcacctcaccaggtacgcagcttcagctaatcagggcagcaggggcatatctccatcaaaatggattcaccagtatcctggtgcacctgtgcagctctcaagatgtttgtggcttataggaggaagtcaggtgcaagtcatacgacttagctacagtccctggcacctttgggactgctgccacacccgctcctcacatatgcatatttattaacatataagttcttctggatacttcttatccatatttgtgctagtttcatgtatattgctatagtaaaatacctggacaaagagcaacccaaggaaaaagggtttattttagcttacaactccaggctgcaatctgtctccttggagaagacatagcaacaggaccccaagacagctagtcacattgtacactcagaagcaaaaagaaatgaatacatacacactccccttatatagtttaagactccctgactaagaaatggtgctacccacagtgagctgggtcctccaacgttagtcagctcagttaagacaatcccccatcgatatgactacaggtcaacccagtgtagacagtcgctctctgagactgctcacaggtgatctcatgttgtatcaagcccatactcgaagctaaccacaataccttttcctgctgtatttgggtcttaatgattctcttcagtcgtaaccgtgtatctcctttcagccatgtcaagactgcctttgtcgtacccaaggagctaaagggatctgcaaccctataggtggaacaacattatgaactaaccagtaccccggagctcttgactctagctgcatatgtatcaaaagatggcctagtcggccatcactggaaagagaggcccattggacacacaaactgtatatgccccagtacaggggaacgccagggccaaaaagaatgggaatgggtgggtagggaagtgggggggagggtatgggggacttttgggatagcattggaaatgtaattgaggaaaatatgtaataaaaaatattaaaaaaaaaaaaagaatcaaccaaaaaaaaaaaaaaaaaaaaagactgcctttgtctcaacaccacccggaacacatctcataatcactcttttcctcataatacattcaaacatcacagtaatacaccaatgtggcattgaaaagagagtgagcttgtgtttttctaaactttctttccccttactttattttagtcattctcaagctgtatcccagttgtatctaccatctgattaccgaattagagactggagagatggtagatccatcagagggtaggagtgcttgccacccgagcaccggtggaaaagcctagaatcccagtgctgcgggaggcagagacaggagacgctgaagtcttttctttttggtttttgtttgtttgattgatttttgttatcagcttagccctggattcagtgagaaaccctgtctcaaggaagtaaataaagtgacaggagaataggagatcctccaatgtcccccttggctgtcacaggcacttggcacacacatgtgcatgtatgtgcacacactaatacagtatacacacacacacatcccaagcatagaatcacttagaacatttccttttgacgtgactataccaacaatttgttgctatacacactcatttctttctttcctattatttttaagggtttgcattttaaatttaatgcgtattttatagtaatgtaaaatctggaatgctagaccgtttctctggccctgaaggcctcacctttcttctttccccttcctcaaagctcagctgtctttatatagcctgcccttacagttttgtttcaataagtttgtttgtgtgtgtgcacgcatcctcctctcagatgaatgggttcgtgtggttcgcatgggctagctgctgctttgtcttacggttgcctgggcttcgctgaggagggctgcagcagctccatggtcatggatgtttgcacttctcaggccgctgcaattacacacttcacacccagccaacagtgtgatcgacagcctgctctccgcaacctggccaatggcatggtggtcatagcagttggatcagcaaatagcagtctggatttcttactgcgacgaaacagtatgcttttaaccgatgccatcttggtcttaggggtggagccccagcagatatggattaagctgtgtgtgtgtgattcttggtgaaaacagagccagaacccattaatactatgcttctaaatactgactgtccactcgtctatggagcagagtccccatggctgataggatatgcaagcaggtgaatgctagctgtgcccggcatcaagaaaggtttattattattattattattattattattattgtctgacataatgaagggaaccgttgggctttgtagtcatagatcatataccctataaattattatccctccctcaagtagacttagtagaaatgagagagacgctagagagatgactaagaagtcaagagcacatattacttttgcagaggacccgagtttagttcccacatctggaggctcacagctgcctataattcctgctccagaggatctgatactctcttctgggcttcaccagcacctgcacacatgtgcacctacctacacacaggcacacacgcatacacataatttgtaagatataaatccaaggatattaatgtgaagaagaggaggaggaggaggaggtggtggcagaggagaggctttggtgtggcctggcagtcatgccactgtagacctgagcaccacgcttagaatttgagtccggatgagaagaaaggcggaggggaaggtcactgctgagttccaggtgtccttcctggaggctggctgggccactggcagggtacatgcccagaaggtgcgtttgaaactcactggactgtgaatttagtcagctgctctgtaccagcccagcccccatctgccctgccagacttggacctgaaggaaatgcctggttgaggtgtgatcttgggtatatacactacagctctttgcagcccctgtggcctggaattggacacagtttttcagggcgcagtccctggcattgagagattccagccctttaaccacacttccgtgtggggctaggctagcactcctctacatgctcttattcatgtagcaaaggtttggcttccttgtccctgatctttctgtaagccttgggggtttgtggtggttatcgttcacctctgctgtcttcgtcatggccgactcctctggctttgtttctttgggattgaaatttttgatctctttaagtgcaacatggggttaatggagtttcccttttctttctttaaaggtttgggggtttttttgttttttttatgttagtgcagaagagggcaccagattccctggagctgcatacacaggtggatttgagccaacttgggtgctaggaaccgaactcaggccttctggacgagcagcaagaatcctggtccgctgagctctctctcaagacccaagctccacttttcttaccctccactaaatgtattgaggatttttcttcatgctcttaagttctaagtaattaccacctgtgtctgaaatcactgtggataagttccgcgtgctcgtgagttttcagagacttcgggggttccagtttgtatgcttgagttcttatctcattgcactgtggtaactcacggtattggtctttgtttcacttgagggatgcagtgtgaggtcagtcgctgcgtaaagaggcaggcctacaaattgctgtgcaacccaaactggcctcaagttctggatcctcctgtctcagcctcccaaatgctagcatgacaggcatctgccactatgcctggtttaagatatcattttcggaggcgacttatgggaacacgagttataccctaagtcatgcgttagaagcttttgatcagttttcacctgtaaatttgtgttaaaaaaaaaaaaagaagaagaatcctctgctcacagggtgctatattcttaaagtagcagttagcttgggttggttagctgccctggttgccaggcagcaaagcagcaaggagttgagttaacatccaatcagcttcatcctgcctgggtccaagatgaaaatacctactgaggcctggttactttggtgtggtccataaaatgttcccaggccacgggaagacatggcagcttcttcattgatgcaaacaaggctggtttatagaagttaactattatatagtccctgctctattagcctataaaacccaggcccaggtccccttgatcatcctggctgtttaatgatggatatttctcctttaccattatctaagaatggaattgatgaatgtccttaagaagaacaggagtcctggcccatgtccctgtgcccagtatcaatccaggtccttgcttgcttgaccatgtgtgtgtcacatgtctcattacttcccagagctgtgcttctccaccactcatgtgggggcatactctaacttgcatgaggctcagctgagttatcctcaaaatgtatatattatctaatttattatttttgtgtgtacatgatgtagtagtgtccggtacatgccatggtgggtgtgtgaaggtcagaggacgacttgtgagagttgggtctctcctttaccacgagggttccagggatcaaactcgggtcatctggcttggcagtgagtgcctttacccactgagccatctcactgaccgtgagactcagattttaaaggtgtaggtaggtagaagatattctaccgtgaggaagtggaatttgagagtgacctcagtgacccttgaccctttccacctccagaaggggcttggacaggatgaggacaaagaaattatttggaggtgtctaaaattctcccttcttctccatcagtgtgaaagacaggcgccgcagccatgaccacccacgtcactttggaagatgccctgtccaacgtggacctgctggaggaactgcccctcccagaccagcagccatgtatcgagcccccgccatcctccatcatgtaccaggtaatagaaatagcggggtcagtggagagacctggattccagaggtcctgtaaaaggacctgccctgaagtacagggaggaggggtctgtgtcgagaaggtgaaaggtcaggagctgatggagtcctcgtgcactctaggatcccggtggaaggaatagattaactaacaaatgtgtgccagaaccgcttccctgccctagggagtgtttgttgatctgttctgaccccgaattcctgctggcctgttcctgctattgcaccacccggattatggcatccctgatctcatgaattaaatatcgcagcttaggagcctctagagtctgcctgggtaattacttttccttcatgtgcgtgacaagagctcacataagcccgcatggcaacccgaggctcagggaagtgggtcacagttgtttgctttggccctagatcagatcttttgataaaccaccatcccattacatacagctatgactctggcaggcccagtaaggagcgtatccatgcagctagaggccccttggcccaagccccttgtctgggtgtgtcaggctgaatgtcatgttgagaataaatgtgttagtttggaaattggggcaacattgggcctttttgctaagtcttaaatggtgaactatgaataaatataattaattttttttcatttcattcaataattacatatatcagtcacatacttggagattcatttcctaaatttgacttataagtagcttttaacagagatcacaatttcaactatataagcatattttaattttagtgatatgtagagagattttcattataaacaaaatggaaaagtgtaacatagaaatttcttatcccagcatacccttctcagtgttcatgaacattttgttaagtatatatgataaatagttattctttttactaaaatagaaattcattttacatgcatatatatatatacttctaattcatctttttcttaacatttattgtggaaccagctgtggtgactcacagctgtaatcccagcattcaggagactgaaggaagagggttgctgtgagtctggaccagcctgagctacagagaggacttctgtctcaaaaaaaaaaaaaatcacagggagaaaatcttctcctgtggccattactcgggcatcagtgcagtaaaaccaccttatggttaggcggctcgtggtcccttccagcctgttgtacacactgacatctatttcggcttttgctgggtgtttccatcttcccaggctgttgttgtaaaaagtgcatccgtggcctgactcgtgcattgacacctgtgcaccctcaggcacgcatgtctcagtgactgcataggcgccctgcacaccttgacttttagcagctgtttggacttgcttagttagctggaagtatggtttccttgtgcttagatagtttgtttgtttgtttgttttttaattcatgatgacatgcatataaagtcagtgcatttatcccatgaataaataggcaaagtctatcagtaaagccttattaactggaatctaaaagtgccaatttggaattaaatggttacttctgaggcttggttgcgtgaaaccagttaccgatgagaagcaggtactgcctgtctgcccttagctgaccagggggtaatatttaaagccaccgggcagtaggtttccacagaaagcttgcgggtttttgttggcagctgtttgttccctagacacccagccagccttgatgtgttttccaacaaccaaatgtccctcctgtcctctacctccacaggctaactttgacacgaacttcgaggacaggaatgcatttgtcacgggcattgcaaggtacattgagcaggcaacggtccactccagcatggtaagtctccatgacccacatgtgcagctgccccgcagaagcaggaggaaccatgggcagcttcccacaccagacctgtgcttagctcccccgtatgctctgccatagtcaggggacctttttccatcctgaaaaaaaagttcctcctaaaaatgacagtgatgtggctttgcaagatattatttattgacgcaaggaagccgctggcctaaatcattcataaatggaactagttgttttccattcctcttagggtctgaccctaaaagggcagaattctcttcttcccttttatcctcatagacatttgtagagttctagactcctcatctgtgggcccctgcaccatttccctggacctttctcactgtgcgggatgtgttctacaaacccaactcatttgttatgcattgtgtgcctgctgtgagctgattttagagttagtgtggggccagtctcagttctcggtgaatcaagtgcgaaagagacaaggcaaccaaacgccttttctatgcaggcatttcatggtcattgtctcatttaatgctcacacagaccctgtgaggtaggtcattggcagccccaatatctcagctggccaacattgaagcctctcaactgttaagaaattgactcgggggtctcactgctgaatggtggttagttctaaacttaggactctggtgacaaagcttggcctttgaaatatttattgcaggcaaatataaaactgtataaatgttccacattgtgataaaggtttgaaggtcagcttttcaaggggccttgagaaggccagaggaagctaggtgggggaagccactttttagtacagcctcgtaaggaggtaatgatagcatatgttgtacacactgctctttgaaatgtaggcagggcaatctgctgtgtgatagcatcagagcctcataataaccctggggcttgcaaagggatcattatacctattgtagagatgagaagactgaggtctggagaaattaataagcgggttgctcatggtcctacagctagtaagtccttgcatgaacctgggaacggtcctgacctctttctgtggttctctccatcccatggaaggttgaagcagtcagagatgagatggggagggggctaggtgaccatcagcatgagcaaagacagaattttcagactgcccaaaattggggtgtgtctatgtgtggtactgtacgtagcattgatggagatgaggtctagacatggagatcattttgccgtagcaaaataccatgagtaaacggcttaaacaatgggtgtttgctttccacggccctggaggatgcaattcctggaccagctgtcgacagggctgctttctcctgatgtttccctggctactcaggctcattcctcccaaactcctgggtgtcagatgtctctgtgtgttacccaagtttcctctctttataaggatgacagattgagtgagagtctgccctcatgatctcctctgagcttcagtcacctttcaaatgggcccacctagaaacagagtcacagtctcaagcctgtaacagagacgactttcattcatttcctcaaagtgcagaaaggaggctggagacgaagctcagctgtttgagtgcctgtctagaacacacaaagccctggcttgtatgaaccaaatctccagcaccaaataaactgggtatagtctggcaaatgcttgtaatctcaactgtggggaggtggaggcaggaggatcaaaagttcaggatcactttctcagctacataggaagcttgaggcaagcttggaatagagaccctatcactaaagggagccgaactcaggttcagccatgcttgatctgtaattactcttggaatgagctataaagaggaatgaatggaacagatacactggacgagagtctcaaaatgattgttactggaagcatgaaagggtgggggcgaggatttcagggaacagctgtaatgatcgtatacacgagagaaaccgaaggtcaactccagctgccataatgattctttggggtcggggaagcagaaccagactgaggtctctctgagataccaggtcacaggctcaggcaggcaaatctaaaggaccggctggctctaaacgtgattctgtttgttatctgctgctgctgtggcaaattgcataaactcactgcttagtaggtagattgcttacctggcattcacaaagcccgaagtttggcccctaacacccacatacaccaggcatagtgggaaatgttgtaaccctagcacctgagaagtagagacaggaagatcagaagttcaaggtcatccacagcgtcagaaatatatctctatctctctaaatatacacacacatatatgtatatatacaatatactatattatacatataatttacatatataaaagatggccaataactcaaggttcccaaggccacatccagagctctttccaccacgccatcttgacctctgtattctgggcttgttatgtaacaactatggctgaactgtctagagggcagagtgcacatcttggttctcagttctgtttctggcacagagcctgggatctaaagatgcttgctgcagcctttttttttttttaactgaatgaaattatgcgtgctgagggcactcggggtggggggtgggggctgagaatagccacgtgttccttacattactgccagttcctcttttagacacgtgtgcccaaactgaagagaaagcaggcagcccatgggttgctctcggttgtttccctcagggacagcatgttactgacttcttaattaagaatggaagctgttgctgttgagcagattcacaataagtagcaaactccaagttaaattggattctgcctttaaaatgtattataaagtgaatatgataaatagatttaaattttaaagttcatttttccctaaatatattttcaaggagagaaagcataatgctaattcttgtctcctaatattctttggagtatgctttccataactgaaaactgcttaaaatatatatgtctatatttttaatcatcttcacaatgttatacaactgtcaccaccatctaatgtcattgccccatacagacaccctagaatttttagcagtcaacccaggtcctctccccacgtgtttccatcaactacaatctgtccgtaaggctgtacctcttgtgggtattttgtccaaaggaatcggagaatatgtggcctttcttctggctttcactgaagttcttattagatcagctattctaagatataaggtgcccgtgacttacctgggaactttgctggaatataggttcgtattcaggggctcagacatccttatcagcaagcgcccaggtgatgctgctcttgcctgccatggcccacatcctgggtggtcccgatgagagcctggagaagtccatggccctagtgttttatgtccctgatgactgctttgccgtttcagaatgaaatgctggaggagggccacgactatgcagtcatgctgtacacctggcgcagctgctcccgggccatcccgcaggtgagaccatccttgcccttcagagaggcctcactgcttctgcagtgctcctccaacctgaacccaaaccagagggctgaggtccccaggtggcgggaagcaaatctgggcctctgacccaaagtgcttcccatagtgctgctgacaaggtccacgcccagggtcttaacagtttccctcccggcacatatagggcacagtattttatttcaaaggcagtcgatgtctcttgtcacccaggctgtcacaaaggatctaaagtagcaagcgtgacattgtctcacttcatctaaaccctgtgcttcagatggttctgggtctttttattggcatgaccatattttataaattcatatcgtttccacaaaaccgtattgttctcattttttacactgtcttggacttgttgaaaatacagatgattttattatcattgacatttttgcataattagtggattccgttgtaacaaagtcagcaaactatatgcacatcaagtaaacagaggagcccttctctgttccttttagccctcatatttaggggcaactattattaaattttttgtacttttcacattttctgagcctggttttgtttttcttaaacagttgattgtcttaatttttatttatttatttatttatttatttattctctctcacgggaaggtatatatgtatcgtggcatgcatgcgtcagtcagaggataatctaaagaaactggttttcccccattcagacagtcaggcttgaaagcaagtgccttttcccacagaactgtcatctgggcagccttggaattttgtttttctggagaaagagaccaaactggagctatggctcagtggtaaagcatagaggatgagtgttaaacatactcaaggtcttggtgcccgggggcctggattccttcccagcagtattagatagatagatagatagatggatagatggatagatggatagatagataggtaaaattaaatataatatgtgtcaaattatacttaactgttctgtggcctttttgcctcttaggtgtggtgataccttttcatagtcactacagagatccaccttagcccttctaatgtttgtaatggtatatgtgtacgaatatatatggttgtatcactttgtccattgaatgacccactggcagttatctagccattgataatcataaaacattatccttgtccagtgtatgtggtactcacgtgtaatctcagcacctagaaggaggaggcaggaggaactttagtttcaagccagcatgggctacataatgattcactaaagaaaaaaaatgcattggctcactctcacacccagccagcctattagcaggcgtggcacatgtgtgttcacagaacatatggcatgtgatactaaggtacatgctgactaaaagcaccagacagaggaaatgggtccctggatgactcagcttaggttacccatcattaacttggatatggctggggagactggttcatggtcgtgtgcatcgggataagaggagagcacatgcatggacatacgaatgtagccaactgtaaaggcgggcacaggccggcagagaaaggagcagggccccatgttgggatcagctggcccctttaccacagccagtctccagggagcacttgtggggcctgtcagtcttctacagctccctcttgctacagtgaccctaaccattttcacccacgacacgatgccacatgtgctccactggtgagccatgctcctgaggtggcagctgggagcccagatgatgaagccgcctttcgatttcacaggtgaagtgcaatgagcagcccaatcgggtcgagatctacgagaagacggtggaggtgctggagccagaggtcaccaagctcatgaagttcatgtactttcaggtgagtggggtgtgggcgggtccacagcagaaggctcaggtgagtggtgtgtgggcgggtccacagcagaaggctcacgaagtcccccacccttccacatctagactttggtgccatgtcattttgtttctgtccagctagtatttttgagagccacctacacccctgtgggtgagccaagccaacaggtgtccccgcctccacagaggatgtgtcctagtgagtttgtgtatgcttggagtgcagagtgacgaaaatacacactagtttttaggacaaggtaaaggcctgagtaaaatacaatttacaacagttgtaggttgcagagtatttacgagtagttgccgctttagggacaatggcatggagctacgaactgggtgacaagaggtcctgcaaagccccaaggcctggagggatcagtgtgttcaagaaatgaaggacagtgagctataaaacagtgaaagcaaggaagaggcccaaggggaggcttggggtgggaggacggggacccatgagatgggcactgtgagcctggagctttggattgggtgatgtgggttgacctgagcttttaggaaatctggccactaggtaggaaatgcttgggagatggaggtgggaagaggctgggatggaggagtgcagaggagcaggagaccagtcgggagctctggaagagtcatttttagaggaggaagaacagggagagggccaagggccttcacagtgagggagataacgtgtaaggacagaaggcgtgggcagccagtcacttcctggggactcactggcaactgtgagggtggtagagaacacctcaaagctggtctgtaccccacacacagcatatacaacccacacccttacatatgtcccatgcatagagcattgacactggccaggctctactgtgtctaggccagagctaggactatactggggaagtgcctcagcctgggtcaggagcaatgctaggtcaaaacccagcactgctgtttcctaactgtgtgtgactcattttatacacatgtgtacacacacatacacgtgcacattcacacatacacggatacaggcacccgcacacaccagtacagggaaatgaagcctgcctctcagggtggtggaaaagataaactcggtctctctataggagcacgggagggccctatgacagcttaaagtgtttcacagctgttgttactgtcatagatggcctgacttcccagagcctaaagtctcttttgggaagcagatccaagagagataaatgaagagcttcccctaaagaggtgcacatggaagaaaggaaggctgggatgattcactgccatgtgcctcgcactgtggccactggctaagcatagaaacagtagcagttaacagtgaaactccccagcaacatgaggctcactctaagcactcagcagccaccgcggccatccacattagttactctaatgccaaataaagcatcaccaggaatctcaaggaagggcaggcgtactaggctcacagtttaaaggtacagtccatcccagcggtataagcgtgttggcaggagcatgaggagtggtcaggttgtgcccaggtcaggaagtagggggaggtggaagctggtctcagctcactttctcctgttgactcagtctgggctccaaggacatggggtcatgccataccacatatacattcaggggaagccttccccgttcagttagacctttccagaaacatacttcctggacacacccagggtatgtttccatcaagttgaaagttgagagtaatcattacaccattgtgagcattgttggtggcgaacaattccatcatggcagaaagcctaactggactggctgtggcctgctggtccttgatgagacgagctggcagttgggcaaggtaggccttggagtggaagggagctcacatctgcacacagatcctcttttccacacgcttccctccctgtgttcattcctcttccaactcctcctcctcctcttccttcttctcctcctcctcttccttcttctcctcttcctctttctcttcttcttcctccccctctattgttcgatatccctccattactacttttgcttcttcttgcttttgaactactctcctcccccatgcccaacacacacacacacacacacacacacacacacacacacgtgacagattttttttgacatcgtatttaccaggtagagtgacagcccagcatgctctagtgtcttcacagagttgggtattcatcatgtaatctgttctagaatgttttcacccctccgaaaaaaatctcctgaaccatcacctcatactacccaacaccctctcccttcagccttaggcaaccactaaatgactttttatctccgtggatttcctgtttggacatttccctacaaatgaagttatacaggacatgatgtttcatgcctggcctcttgcagccggcagggtgtgtttgattgtcgtctgtactgtagcaggtgacagaacctaattggttggttggttggttggttggttggttggttgatttaatgacggaatgccatgtcactgtgcacacacatacaccgtatttcattcatccatttaccaggtgataggtgagggtgtttttcccttcgggtctgttagggataaaaactggacacctgcaagagcttctctatcattgcaggctctttgtttctcttgggttgtgagctggttagggtttggtcaactagacaggagctggagtcatatggagaaaattgattgactgatgagaattctctattgactgacctgtaggcaagtctgtgcaggcatttgcttgaatgattggtgtgggagaacccaattcactgtgggctgttccggggcatgtggtcctagattaaataagaagcagactgctcaatctgtggaccctccgtggtctctgcttcagttcctgcctctgtgttcttgtctgagttcctgtcccaacttccttcagggtagactgcaagctgtgaaatgtaagaaatcttttcttccccaagttgctttgagtcacagtgttgtttaatcacagcagtagacagcaaacgaggaaaagcaggtccctgtgagtggagtgctgggtcacttagtgaatgcaccctaggtgtgcaagtttcctgactgcccctgcagtctgctgtcagctccgcattattattgaggccacaatacaggctatactacacacacatgcgccctcatgagagcctctaagagccacagcccctacagtattgacttggctcttctgtatgcttactccagctgaggccagcctcatgcttccttaggcctcccacagcttcagggcctttgcaggatggctcatgcttccttccttcccttgtcccggtccttctccttctctttcaaattatttccctacaaggtcatttcttggtgacttcagtctttctccctagaggaacagttttgtgagcccttcccaacctccatcccttcttcatttcctgccatatcaagtatgaaattctgctgcaaagaatttattttgttttctatgaatcaattggcatatatgatccttaggacagttttggttttttccttcttgttttgatttctgcttgacctcagcccttacagtggtttcgtggttatatagtatagtatagtatagtatagtatagtatagtagtgtatatagagtatagtagtatatatagtatataggatggatagatagatagatagatagatagatagatagatagatagatagtaggtgctcactaatcagttgcttattgaatgcaccactgtctctcctggcatttcacacactggggccatggcgctttttagcaaatgtgttttagactaattcataaagtaaactcacttggaacaggttctagcacgctgtcacgattagctttagaaacggggacatctcagagaaagactgcctggcacagcagatgagtccttacactgttcctctgtctccagcgcaaggccatcgagcgcttctgtagcgaggtgaagcggctgtgtcacgctgagcgcaggaaggactttgtctctgaggcctacctgctgacgctgggcaagttcatcaacatgttcgcggtcttggacgagctaaagaacatgaagtgcagtgtcaagaatgaccactctgcctacaagaggtcagaagccctccctgctccctggactcttttcactgtcttattccctagtaatagaatagccttcctcaaaccaagctgttgtgacagggtgatctgaggaaggcatttccgagctggggcttcagaagagttattgctggccaggcttgatgtcccaagatggcatctggtcctcacctcccccatctaggggggcagagcaatttctgccatacctacctcatggcaggaagattatcataaggcattgcatggtcgttttctgtgagaaacagaagccagtgtttatgtcccagatctgcaaagtcaggcatacattaccccagttaccccagtggccgcatttggctggatctcttaccagctctccccccggacctgcctctccatggtctcctttctcagataggcccctgcaatggcttcctgccagcccatagcaaaaccccagctttccagaaaaaagttcctccttcctcatgcattcagaaagtcccagccaagattgctatcaatccagcttgctaatccctctgtcagacactgagtcaggtggaggtgatctgagtggatgacagaattaggggaccatgtcatcgttgaaaaaaagggctggagttgggaggtggttgttcatctccaggagccaggatgtagccacccaatgacagggagcactacaaaatatcagctccccagggagttgggtaaggctcagatgagcacctatgtctgtctatacctcctggaagggttgctcatatgactggcacactattcctatcccgccatacttcccttggatttcaagtcagctacagaaaggaagagggcagatgttaaacctgggttgcccaatagttagagcccatctcaaggtcaactcaagatatcacagatggccaccagcacagcatccttccccatatacggcccgccacttccatcaggaccacagccagcatctgtgtcctaaaccaggcaggcgtgttgttcccgttctcacgagttattgtgacgtgagctgtgtcaggctgggttaagttgggacacagttgagcccagcctgtgttctccgtttccctccctccatctgtcatcccatgttgccgtgcaatgctgtgcgtaagaatgttgagggaaagacacaaatcttttctactcggaaagctacggcaggagaatcatcggctaggcctagcagcacaggactgaaatccttggtagctttcatcagttcaagtgagttcgaggccagcctaataaacttagcagaaaccctatctcaaaaatgaaaaatagtaacaaggttgggaacatagctcagagatcaatatgcacagcatgaacaataccctgggtccagtccccagtgctacaaaccaacccaaaaataggatgctgagattttcctgtaatgaacagagcacatgaaaagaaaaaatgaagcttcctgcctgtgattcagttcttctgggctcactgtgcagttcccctggagctcaaggacactgcccccactccctgtctcatcatccctccctggtttccgttaaataccctgagataccagtgggctttttttgtttgtggtttcatgccctttaatacccagcagctgtcaggagggcgtaaatggcctgagagaaaggactgccaaacacattttccattgaccttgggaacacctgcagtgttcagagccagtgacattagcacggtgtctcttgttggctgaggcgtgggaacagattccccggcaccctgttattgcttccttctctgtgtttcagagcagcacagttcctaaggaagatggcggacccccagtccatccaggaatctcagaacctgtccatgttcctggccaatcacaacaggatcacccaggtgagaacaaggcccatgtgggtcctgtctggcatcccacggaagcaatcctagggccctgaggctcagaggactccaaggaacgagacataagctcagtccacatttgtctccactgcccttcatgggagtaaagttacacccagtgacctccccccccaaccccttttagttctctggaagcttcccacacagggctgtgggtcccacatcagtttctaggttgagaacaagcctgaccataggtccattatcagacttcgggcaaagtcagagattcagtttactcatccataaagtgggcatattattttgagactattatgagaatgtatctcataagactagcttggaaagttaatgaagtggagacaaaaagccccccagaatgtgaccaagagcctgggaagggcacagttacctccaccagtttgccaggttgtatccactcggcctctcctcttgcatttgtggctgtcatagctggacctatctctctgacagttcagtaacaacaagagtgtctgcaggacccaggccaacacaagagggattgtgatgctgctcccaagacatcccaaaggcctggccgtagtagggccttctttgtcactagagaaggatatggagtctcaggcccctgctctctgtagagagttcccccagtgctatccaagagtatcctgcaggcctcgtttgcctccatggggagaaagggacagagagaaaccaaccttccgtaactgttgatgctcctggatcctaccaggaaagagatacctacctattgtcactccctccctgggtgggtcttctccctgcctttgtctgaagaaacctcatagagacccttgaaacaattactgcagggcctatctgtaaagctgggctgcccaagagtacataactcagcccttagaactggctgtctgccattaggctcctgtgtgagaggtgaacagggacaaccagctaatgcctagcatccaaggggagtcaggtgtcagcccctgctggcaggaacgctccctcctcctgggacctcagtaggtagggatcaaagtgctcacttattcagcccagctctgggccttctgggtggtgcaggaagatgtttgctccgcctgaccagtgggtggcgctgttgtttagtgtcttcaccagcaactggaagtgatcccgggctatgaggagctgctggcagacattgtcaacatctgtgttgattactatgagaataagatgtacctgacgcccagtgaaaagcacatgttgctcaaggtaagacttcccctcctgacacagcttcctgccaggcgtgcgtgcgtgcgtgagtgtataggtgtgtgcatacgagtgtgggtgtctttaaaggccagaagtgtcagataacctagacctagagttatgggcgattgtgagctgcccagcatgggtgctgggaaccaaatctgagtcctctacaagtgcagtaactgctcttaaccaccgagacatcgctccagccaaatcttttttttctgacgtgctgtctctcactgggatccagggctcacccattaggcctggagagccgaccagcaagctcagagattggcttgcctctccctctccatcataggggttacacacgtgctccaccatgccaggttttacatgggtgctagagaatgaactccggtcttagacttgtgcctcaagcacacgtgactgactgggccattagcccacaatgttggagactggacgtgatattgggcttctttgagggcatgccatggtggaactatttcgtgtccccaaatagaaacaccagtattcagtcatggggcctctaaagagctaatccaattctgttccaagaggcctatctttaaataactaggaggttacatttcaacctctttttatttattaatttatgcatttctttttttgagacattctctctgtagcccaggctggccttggattctcagtaccccatcctcagcctcccaaacgtttgggttacaagtgtaggctaccacatccatcaggtttcaccctcttaaagtcatggccctgtgactttggggcttaaatgcttgccagagttcagggaaacgaaacatattgaaaccatagcccagggcagcatggcttttgtgactcgctcactccagcttccttgggctgtcagaaaccagcaaaggctgccccagctttaaccgcctttcctccctagtccaaacatgggtggtacagcagttatgcccaagtctcatgctccgcaggctgccttacgatactccatctcaaagcaggtttagatgacttcaggttctgggccttcctctcttatcagccttgaatgtctgcatagacctgctcctccccacccccacacaccaccatcaccaacacacacacacacacacacacacacacacacacacacacacacacgnnnnnnnnnnnnnnnnnnnnnnnnnnnnnnnnnnnnnnnnnnnnnnnnnnnnnnnnnnnntccctgcggctgctcttttacctaaagtgactagcaggtgggctgacagtatcagggagtatcagcatcttcgggtggagatctgctctttaacaatggccttcacattgttgcttttctggagaactttgtggtcacttatcattattccagtgcctgcctctcaacacctctgggaaacaacaaggtcctttctctctcggaggatctataaatccacacttggatggagatcctaggctaagccctttgcagatcgtctcaacaacatgtgtgtgtgtgtctgtggttccagcaagctctctagccagcctctctatgtctctgattcctcatctttagaatcgaggccacccttcttaaaccctaaccacagccgctgccccagagtaactgctgtaataatatactaaattcctcgttgaaattaggcacgtgttttctgttttaatttggaaatgtgtgtgattttgaaatagcacgtgtgtctctacaagatgccagtgaatttgtgcacgctcacatgcgtgtgcacgcatgcatcacagcccccatgtttgttagctgctctggaggtgtgatgaggatgttacacgtggcccctttctcattctaggtgatgggctttggtctctatctgatggacggaaatgtcagtaacatttacaaactggatgccaagaagagaatcaaccttagcaaaattgataagttttttaaggttagtaattggtgctggggccaagcaggggcacagaattactggggcctagatccctggtggaaggaaaggatggcattggccagaaagctgtggagatggtcacaggcatctaaagattctcagggaaaaggaagataaagcgcaggccccagctgctctcactaaagcaaggttactgcccacatgtgagtgatgctcaacctcaggactcgctgggattccacgggaggccttgtaagtcttcttgcatgtccctttcccctttcctaaaatctttcctctaaaggcatagttgcatcctagaagtcaaaacctatgtgaattttcattacactctacagctcatggagacagaagaaaagagtagaatttttaaaaagatttcacttttatctgatgtataggggtgttgtgtctggggatgtgtctgcaccatgtatgcagtgcccacagagaccagaagagggcattggataccctggaattgtagttgcaggtggttgtgagcactatgtgggtacctagcatcaaaccctgcctcactgaaagagcagcgagtacttttaactgctgagcctcttctccagccctgaaacactggattctaagtggcttcatgtttgccctttaggcacgatagctcacagcattctgtttaagcgtaccctctcaagcacctctgagggctgaccattgggccccaaaactctctaagagaaactcgcaggtaaatgttaagcctttggtgtttgaacaaagagatgtccgtctggaactgaaccctcgttctgacatggctgtaatgttggatcctgcagatgtgagatctgccctaggggatagtgtgtcgtgacagatactaagtgaggcttaaggagatgtgtgagtcacagaggtcttgtggcttgatttcttagcttttctacagatctgcccagggtgaaaacaggccccatgttgggaaactgctatgtctgccttcaggcaggaggaaggaaggtagaaccaggcctggctccactgcctcctagtgcctttgagaaagtcatgaactagacctcccggagctgagggttctgatcctggcttttgctctatctggtctgatttcctgaagagactaagttccctatgtgtcaatctctgtgtgagtaccgagggagggaggcaggactgactcagtctagttatatatggattgagaccatggatggttgggtgactaggttttatagtacttagaattaagcccagggtctcacccatgagaattaaggcctctatcattaggtatatcccaactttttttttttaactttattttaaggcagagtctcactataatgcgcatgatgcctatgaacataagatcctcttgccttcgtgtcatgaatatctgggagtgcaggcctatgcagccaggctttgctgagatagtatttgtaaagctgctggttctgtacccactgcaggagagacagatgtagggagacagtagcctcccttcctcgtgtcctcggctgtctgcactttaggtatcaggtggacagtctcagatgccaccgcaggcaatagctcactgccattggctcctagtcatgtttggagcagcagaaatcttctgagctggtgaaaggaccctgtatgaggaagctagccatctggtcctttgtttcatctagtcacctatgtgaccctggatcagtcactttgctctctggtgtcaattgcttgaagtacacagttggtcggaggcagaggaaggggcctgtgtgctggttgggattcctctgggcgccaggaccccatggctaccccattaggaatccttcaagctaccggccccaggtgcacactgaagccttccaccccgacggtacagcagccccggcctgcgcgagccatctcacatgctctgtttgcttcctttgcagcagctgcaggtggtaccccttttcggcgacatgcagatagagctggccagatacattaagaccagtgctcactatgaagagaacaagtccaagtgagtgcctgccgtaatgtctcttggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctcaggttttgtgactatgcagtaagtacgtggttaacggtgtggcttggatggttccagctgtgtcctgggttggtaacttgcccctatgtcatctaaataaaccatggttctagggaatctatgttaaggcctgggggaaagttagtggctctcaggggggtgttgggggtggggcgttttttccacggctccagcctttgtccctctgatctcagattcagatttccatctgtagtacctacaactaagagacaactaatggcctattcatgtgattggtccttgccactctctggccagtgtctttcttagtttcacagcgctgacaagtaaacccgaggtctttcccatgctgggcaagtacacttctactgaactatagcctctttttactttttatttggggtcattactcattaagtaaactcagtctgtagcctaggctaaccttgactttgtgatcctcttgctgcagcctgtcttaatagctgggattaaaaagatacccgcagagcctgggtaaggcacaaacacctatactcccagcagttggaagctggaggtaggaggatccggagctcaaggccagcctcagctatattagaaccctgtccccccaaaaactaagatacctgcaaaggggtccttgacctataaccgatatatatctggagccccagagatgaatccttgggaaaattcatgtctggcagtcttagagaaagaggctgggtgggcagatatcagcttctcagacagagtcagaagtttgagcaacagtgtccctctataaacagctcaaagtgaaaagctagaggcgtctaagccagaggaaggttcattcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaggaaggaaggaaggaaggaagtaaggaaggaaggaaggaaggaaggaaggaaggagtggtggggaagagcttccgaccacacctctcagaatgatagaaagccacccaccatgggtacatccatgctaccaggtccttgttgggaaagacagagaggttgcctcccttggctttgctcgactgtgattctgtccttttgtggccacagagaggctgtgatcttggctctcgccttctcacttacctggtgagtatcgtgcactggtgtccagaaacacctatggtaaaaatctggagaaggcagagacaggactcttctttctagccatggtgcctacagagcaggctctggggtgtaggcagccactttaccgtttggtttcacccagaggagccagctatgttgtctgaggaccaggagcagcctgtcccacgaaggtgcctggagccatgacccatgcacaaatcctgtggtttttctcctccccaggtggacatgcactcagagcagcatcagcccccagtacaacatctgtgagcagatggttcagatccgggatgatcacatccgcttcatctctgagctggctcgctacagcaacagcgaggtgagttctgtggctggtccagggtccgcagctgtacagagaggctgggcaagagagggcatcatggagtagggagaacgcgctgccagaggtaagaatgtgccttgttggaagtgtgggctcagagtcagactaggatggatgctcagtatctctgtgcctcaattctttcacctgcaaaaagggccataatgctagtaatgccggaggagggtgggcgtgggcagggagtcagtgatggagagagaaggtattgttaacagatgcagaggtaatcatataggaaagagagtttccttccggctttcttcttgggggtatttgtacttttagtaaatagccactatttaagaaaaatatgggtctaaaatagctaggtaggaggaactacttttaatgttctatcacacagtagagggcctgtgtttgatgataattatgatcctccataggaagaatgccatcaggggtgataggtacaccagggagcccgtctaatcatcacatgttgtaaacatgtattgcatgtctacactgtgtcccatagagatctgcagttgctgtgccaatcaaaaataattcagacgtttttttaaatggaggtaatgacagtgtttacattgaaaggttcactgagataattaatggggtgcctggcatatgtgtcgtgtctggaataaatgtcactaagtattcatcagctgcacaggactcatcccatgtcaccttcaatggctagagacagcgttctgaatactgctcctaacactgtttaaacacgcatagctgtgtcatatgatctttgcaaaaataatgtaaatggaatccgagaagggtaaaaaggccataaagggctgtggagatggctcagtgggtaaacattgccatgcaagcgtgaggacaatggagagaggatctccagagctaacacaaggccagtggtagcacgcgtctgcgacctcagagctcctacagcaacatagggtgctgtggaccagacagcccagtgaactatgttgctgcagtgtcaagcaacaaagagagcctgtaccacaggaaacagagtgtgaaaaccgacaccgcagtggtccgcatgtgcaagcaccataaagatctctcccaatactaaagattgggctttgagcttttgcttttttttaatagaccatatcaattatataatattaattcatagccttaagggaaaaattagataaacaaaaccaatcccatagaatcctaccatcccagaactaactttgattatcatgtgtctttgtgggcaccttcccagagatgcctttctcacagagacgtaatatgcgctgtttaatctgacataggtccctaatctgagcgtccatagtgtggaagaggccacgtttgctcannnnnnnnnnnnnnnnnnnnatttattagttcacaattccaggttagtagtctatcactttgaggcaatcacaaggtaagagcttgaggcggctgctcatgtcaggtccacagttaggcatggagagaaatgagtgcatgccctcttgcttctgctcagttcaatttcccactcaaacacaattcaggacctcctgtttagggaatggtgccacccactgtagacaggatcttctcacatccagttaacttacccatggacatacctacaggctgactcgatgtagacaatctctcattgagacatcaattctacattgtaccaagttggcaacgagagctaaacatcacaccataaatagttggtttcctgtgtatagggggtaatgacaaaatcatacactacagatacgacatttttttcaaaatatttctcatctaacattgcatgagttcattggctatagactacctcagacacctagggccaaaggaacacctttctatgtgcatatgtggtgcagttttttatgagtttcagtagtagcattgaacaaaacactataaactctgattttaaaaagtaatgagcctttgcccatagagaaaaatcaaaattcccatgagcctcttgccacagtgtttttatcggcagagagtgttgtttgatctccatttctgtctaaagataggtaattttggatgaatcattaagattaaatgagggttgcagccttgtgacttctgtttgaaggaagtgttctaaacatgtctgccatggctttcctgcagatagagcactacatggcacagtggttctcaactgtgggtcacaacccgtttgggatcaaatgatttttttcatggggtcgcctaagaccatcaggaaacatagatatttacatcacaattcatatcagtattaaaattacagttatagagtagcaacaaaaataattttatagttggtggtcaccacaacatgaggaactgtattaaggttgggaaccactggcataacacatcagccctgtttgaaactgttaattaaaagcacaaaactgtgggcatcttgacactgcttaagctgcagggaagatgtttgcttgcaacccaaaaagggagagggctctgctcagctgggagcatgcaggtgtctgctagggatggagatgttgctgcaagcattaatttgggaaattacaggaagtgatgatgcaaatttgcaaagatactgtccatcattgatgacaactttcatatattcatgtacacatacatacatatccatgtacatataccgtgtggctacatacatgtatatgatgtggaatgttacacatacagacatttgtgccagatctttttaattggggcattgtagtagtaggtgagctgtgacaccattttggtggtctgcgattagcactgtatgcggagttgactatgaagccaggattcctgtgacgtcacagtgctgggcgaaggtcattgcatgcatacatattcatgtttcatttccctgcaaagatgctatcctggcagttactggtgcgcacttcctactgtgaatacggtggagatagggttaaaccctttgctgaagggctaagtggggatctctatgacacttcctgtggccttcatcatgacacctatcaaagccgagtttacctagcaagggagcataacaaacacacagttcttgcagggaatcacaggaggactgcttatgagcctcaggcacatggcccatgaggtgagtgtgaagttctgtgtcccccaggtggtgacaggctcagggctggacagccagaagtcggatgaagagtaccgggagctttttgacctggccctgcgaggcctgcagcttctatccaagtggagtgcccatgtcatggaggtggtaagtgtcctgaggtgccaggcctcacactggcctgactcacaaggcatccatgggcatctgcctctagttggcactctgtctttcaacataaaaatccatataccatacttacccaactgaaacctgcatttaatatatttacagaagtatatgaccttaaattaatagtttcatcacttaaacaacaaaaatatcacatgtgggacccagcaccaacattaattggctcacaacctcttgtaaccccagcacagtagatagtttgcgtctggcttctgtgacacccacactcacgtgcacttccccacagacatatagaaacataaataatattaaaagtaaatctcataaatgaacccacatctggggctggagagatgactcagccgttaaggctaggctcacaaccaaaagcccacatctgtcaccctgcccgtttagccttcggtattctgactctatgcatcccagttttagagattcaccatatatagactcatagagctcgtgtggtgttttgtgtctggagtttcttacattgtgttttcagggtccagccccatcctgcacgagtcagtatgtttaccccacatcccattagtgctccctggtgttgctagactgctttgtttaccactcctcagttgatgggtgttggctgtttcttctccctccagtactcttggaagctggttcaccccacagacaagttctgcaacaaggactgcccgggcaccgcggaagagtacgagagagccacgcgctacaattataccagcgaggagaagtttgcctttgtggaggtgggtgtgggaataccttgctctccccacctactcccggacggctgctccccgtggtttctggagttattttgatccccaaactgtattatctttttaacttgctgccctttatctaatttttttttaccaatctaggttgttctctgtcaaaagctactaggaaatgatgagggatcgagctaatttgaaatgcccctaaggaagaacagctgctagttcctggggtagtaagagccgcttttagtaggagtgtggccattggttgcttccccgtgctccagtggatgacctcatggccatgggcagcgctgactgtactcactgagttaaaacatgataaatagatgaatacatgaatgtttatgaaaggaggatatgaaaccggaggggaagtccctgagggaggacggggggggggggggggggtaagcatagatatgatcaagacataatgtgtccgaatcagagtttctattgctgcgacgaaataccatgaccaaaaagcaagtagggaagaaatgggtttatttggcttatacttccatattgcttttctttattggaggaagtcaggacaggaactcaaaacagggcagaatcctggagacaagagctggtacagaagccatggtgggtgccgcttactggcttgctgcccctggcttgctcagcctgtttccttgtagagagagcccaggtccaccagctcggggatggccccacccacaatggactgggccctcccaaatcagtctctgagaaaagacctacagctggatctcagggaggcatttcctcaactgaggctccttcctctctgatgactctagcttgtgtcaagttgacacaaaccagccagtagtacataatgtatacatgtatgacattttctaagaataaattttaaaaatatatatggtgagggctggcaaggtggctcagtgggtgagagcactggctacacagccttggggacctgagttcagatcccagcaccagtcacagaacagatcaggatcctacccttaaccctggtgctgtggggatggacatagaagaatagctgggccacacactcggttctctttggctttgtttgttctgtggttggttttgttgacataggatctcattaagttgctcttgaactcacttgctaaccaaggcaggtcttgggactatagacttgttctgtcaagcctggctgaattttagctttctaccggagtactcacacaatacatgttccttcaatggccacaaaaagggggatttcacactctccaagtctccctgagagtctcgctgttttgtgctctcacaggtcttggcagtggccatcttgagaatgatcttggtcattctgatggccatatgggtgactatcattaaccctggcattctcatttcccagagtctaatgttaccaagtattttttcatgtacttattggccattcttctatcagtttgtataagctatttttgaagtctttgctcgtttttaaaggttgttttctgccttctcattattgaactgtgagaattctttccaaaatgtcaccacaaaaccctcaccatgtatgtgatggaaacagcttctcaacttcatgattttgcctcttttttccccttgacaatgccttttgaggaaagctcattttatattttgccagagtcgaatttattcatcttattattttacagtatgccaatgaggactctaagaaatccttacatggtctcaagtcgcaaagacttttccctctggtcttccagccttgcccactctgtatttggaattattctgagcccttctttattggtctcagtgttttaatgatggggttgtctgtgtgagacactgtgcatgtgagtgtcttaggaagccagagacatcggagagccttgagctggagtggtaagggcaatggtaagctgcccaacatgggtgtttggaattgaacttgggtctgtaaaagcagttagtgctcttaactgctgcaccaactccctactccctgtctggatgctttttaatttcacctctggccagaagcccagctctttgaatgcctctcttattagttctcttcacaataccttactgcagccaaacagtctactctttggcttctggggatgtcctcaccatctgacaaggtttcttaccctaattgctagaggtgtgcttgtttgtttgtttgtttgtttgttctgtttctttaatgcttttcagaaagaaacaagcctcacgtgtaagcatgccccccattccgccatttcttcctgttcaacagaaggcttccgtttctcatggacatgcatagcagggctttcttggccattgggccttctgtgcttcgggctggtgcatgcagtcagacacgtcactgtgtgggtgtgagagtgtggccactgtgtgaaggccgattcatcatgtccccaattcgtcacccatgtcccctctgtcctcacaagtcagggtgtcaccactcgagaccgactcaggaggcaagtttactgctggtaaagatggactagagagactgtgtctcctacctgagcccatcattcctatccccactgcgccgagtcagcatccccaccagccagtctcaagtggtaacacgacacacgctcccctcccctcctctgcacaggtagaaacagaggtgtcctcgggacagcttcaggagaagattccagtgtagagctcagatagctgtcagccacatgggggttgaaacagtgatctggtttggtctagttcatgtcagagagatctccaaaaggcacaggagtaccacccagaatgtggttcaaggaccagctgtgatttgtcatccatcagcagtgagattagagcatgggtcagggtgacagtgaccaacttcgtgaagcacagccatgcttttgtggcaggatactagtatcattttctaagtattacttatttctggttgacacgtggtggctataaatatacctgaggtccactgtgacatgtcagtgctttggatgcagtctgtaaaggtcagatcagctcatctgcacatctgtcactttgaattataattatgagcattcaaaaccctctctgagtgactgtttgaaatacgcagctacgtgtgtagtgcagcttccccaccggggcatagcacaggaaattgtctctcctacccaactgcacatgaactaccccgtctccatactgccactgtatccttccgggttttctctctcgctagcccgtgtgtgtgtgtgtgtgtgtgtgtgtgtgtgtgtatgtgtatggtgtatgcatgtatgtggggtatatgtgtatggtgtgtgtgtgtgtgtgtgtgtgtgtgtgtgtgtgtgtgtgtgtatgtgtatggtgtatgtgtgtatgtggagtatatgtgtatgatgtgtgatacatttatgtgcctgtggaggccagagctcaattccatgtgtcattcctcaggagctgtccaccttaggtatttttctccagttaggtgaggctacctgcattaagccccaagaatctaacttgtactgaattatgagcacagcaccgtactcagctttttacctgtgggttcgggagtttgaacttggttctcatacttgtagcacaaacacctcaccaaccgagccatctctccctccactccattttgggttttttggtttttttgtttgtttgtttttttgttttttggtttttttttaattctaagctttgtggtataatgcacctgatgtgatgtggtgaatgtcctccagttctgtccatgttgctgcacatggcatatttcttctttctggctgcatagccttgcattgtgtgcatctaccatggtttgtctctccactcactgtcaaggtccaccccagtagattctgtcctggctgttgtggctggtggtccagttatggttgggttcatttcttcaacctagtggtttcattgtcctcagtcacacccagaagtaagatggctgaatcatgtgatacctgtatttctagcatctcaggaaacaccgtcctgtttccatacggcagaagtaattggcatgaccacccacagtgcactggagttcccctttagcatgactacttaatcacgctaaagtagagctctgctctgtgtgcttttggtaccatttcttacctggcagatttagaggccctggcctcattctctggggtatctatctccagtaccctctctgggcaacatggcaaagcgtggtgagcagatggcttgctaagtgacagctaggctaacccttgccctgtgcccaccaggtgattgccatgatcaagggtttgcaggtgctcatgggaaggatggagagtgtcttcaaccaggccatccgcaacactatctacgcagccctgcaggatttcgcccaggtgacgctgcgggagccgttgcggcaagcagttcgaaagaaaaagaatgtccttatcaggtgggtccttggatggcctcactcgggaccctgcaggactgatgatggggcttgaaggagattgtaaaatggggtcgtggtatcctcagtcgttgagtgatggaatgagataatccatgtgtagacttcagcacacatcgtgtgtagcgagtaggctatgaatattaactggtactaaaatggagttagtgatgctaatgagatgttgctctagctcctcctgttctccctactcccaggtcctgttgtcttaccccctgcatagctcaaagctgagttcttaagtaatgaatggtcaccaaagccatggcagccacttgttaaaagcaccttaacactgttacagcatccgtgagtgagtgggtccaggaatgaatgagcatcccagacactcagcgctgtatgtaatgcaggaggtgctgacaccttgttagggctggaaacagccttgtagacacctaagtggaacctccgtttttccttccccagcgttctgcaagcaattcgaaagaccatctgtgactgggagggaggccgagagccccccaatgacccatgcttaagaggggagaaggaccccaaaggtggctttgacatcaaggtgccccgccgtgctgtgggtccatccagcacacaggtgagcggtttcccggcagcctggctcctctgactccaggccaatcggaccagcaagggcaacatgcttagccgtggggttagtgggatccttgtgaggaagggcggggcttagcagctgctctgggcttttcctgaagtcttgttttgatagaaaaagggaagaccactggcctaagattcaggagacctgggttctagtcctagacacctgtgtgaccttgggcatgttacacaatctctctgtgcctcagttgtctggtctgaccggtgctggtagcaccatatccacctacccagcgatctcctaggcctgtaaagttcgcatattacagtgcaggagagatctgacatggagtccacacacatcactctgtgtgttgtaagaacccagcccctggtaggaaacttggaagttctgccccgacctgctcaatgttccggggcaagtaccttaacccctctcggctctgattatcatcggagaacaaaaactttggatgagatttttaccaacacttaacttttctaatatttccatccattttccaaagacagcccacaggcttggcaagcctcctccccttagagaaaggctggttgtcagaaacactccgggttcccagccagagcttctgcagtaagatgctgtctgtgtttatccagagcagtcttaaaattacacagggtgggtagggtgagggaagaagggtgaaccacgaaattaaattctcactgctggtttaggaaaaggtatttcctgatctactttctgtcaaatttgaaaagagatgagtttgactgtaacccctgggggtcttgcaggctccagaagccccagtctggaagctcctccttacagggcctttcaagcctgtctctgctctgaagtaggccatctgaggccctttcttacccacccttctgtgtgtgtccgcgtctgggcagggctggggctgtgcaggggcaggtgagtgtttggcagggttatcaccccttagctctgcagtattcgatgaccaatgttcacagactgtcttctgcttgtgagacagcccaaagaagcctccgtagacagctctgaaacatttgagggtcagagagcttcctaactctgagtgccctggtgtggctgaatggctctcatgcattttgctaagttctaagaggttggtgcagacagaagaaggactgtggggagggggagaggctatagacagaggacagaagagagagggcatctcgtggacaatctgagagctgcaggttgatcaccaaaagctaagccccactccttgatgccactgggataggttgattgcacagacatttagttgactcctagacagcctcggagctggaagagtcctgagagataaactcacccctccccctatcacagatggagaaactgaggtccagaaaggggaagtgacttgtccaagtcacagggtgagtgccaggtagaggtgggacaagaaccccggtctcctgatacccaccccagggctccatcgcagccttcagaatgcaggaaatgtaggcatctcatagagctgggcagcacactgtcctggtagattaaatgccctgctaaattattacagttggctaaagcattgactctgttcagaataaaccctatttgctagtagttagaattagatgtgaatctagtcaccatggccccctttctttggggactcaaaggccatcatcattagcactgttctttgatggtcagagggaggaaatcggcaacagtggttatcccctccccacagaagggaccctgcctagggtagcctggcatgccgatctgtgactgccaggcccacggtgggtgagacgctaggtcgtccagaagcagcagagtgtagcgtgcttgttgggaggccggagtgtgtcacatgtggcccctgcagttgtggcagctttcccactgtatacaatacctctcgcttttctctctctctctttctctctctccctcctccctgtctctcctaccctcccattccctcttccttctctcctatctatgtcttaggcctgccagtggtccccgagggctttgtttcaccccactggtggcacacagggccgaagaggctgccgatccctggtataacaccgcctggttgggttggtttgggtgcctactgcgggaagcagcaggaacagactagcctggctcctcaaggccattcccagccctcagattcaaagacaaatggagagggggggaaaactagaatagcagaaagaacaaccctactgcacttgggccctttgcatgtagggcactctgtaagcaggcgttaagtgtctaatcagctcctttgtaagtatggatttctacccagaatctctggaagactgtgcaatgcattccaggccaccagagggcaccagcattcactggcaggttcaaaaccgcaggatcagaaacaaagtggttggggggggggggggacctgttttgagctttgtccattgctaactcctcccggtgttagaactgaaagagattgggttgagaacttatctggtccaattcttcctgcgagaaaaggcaactggagcccagagtggaggctttgttgtctaaggtcacacagcaagtcaatggcagtgcctggctttgaacctggctcttttgattcctggttcagtgccccatccatgctgttaccatggtcatctgggaaatcagagagtgacatggatgcccaacacccttggctaagcagggccggcaggaggacccttcactacctgccattgtctggtcacctagggggtgccgtgggtcctaggcagagagctttgcaaagctggtcagtctccctctcgggagacgaggggaggggtggggagctcaaagatggaatgcttgcctggcatgggctgggtcccagaacagcagggggatgggggaagaagaggtttccgtagttctaaagtctctgcctaaatcagtgcttccttaagataggtctctttacaagcagaaaaaagccacaaggaaggtggggaggaaggcaagttctcccttgacatggggagccaccctgaccctctcctttctttttcaagctgtacatggtgcgcaccatgcttgagtcactcatcgcagacaagagcggctccaagaagacgctcagaagcagcctggatggccctatcgtccttgccatagaggacttccacaagcagtccttctttttcacacacctgcttaacatcagcggtgagnnnnnnnnnnnnnnnnnnnncagtttgatctggctggaagctgtagatggagtcattttgctcccaaaggcaaaagaattattttaaagaaaaaaaaaaaaaaaaaagaaaaaagaaaagaaaaggtaaatgaaaagaaaacaagacaagacctttctgtcagcttgaggaggcaggaaaggccaggctctgttacactcattctgactcaaatgaatttggtagacatccattgctagttaggaatcacaccagagatacacgactatgagcccagcatgcactggctcagacgtttgttggtaagcagcagctataaactctgttgaattgtcttagagggtttcatttctgtgaggagataccatgaccatagcaactcttataaaggaaacatttaattggggctagcttacagttcagaggtctagcccattattgtcacagcaggaagactaggcacatgccctcatatcaaggcaacccaataggaggaaaagggccccaaaccaggcaaaagagtcaaagatcagagatagtccttgttcccactttttggagtcccacaggaacaccaaactacacaactataatatatattcaaaagacctaggccagacctatatagactccctgattattggttcagtctctgagctgttatgagccctggttagttgattctgtgggccgtgtttttgtggtgtccttaacccctccttcctcctcctcttccagaggatctccaaagtctgcctaatgtttggctgtgtatctctgcatctacttctatcagttgctggatgtagtctctgatgacagttattctaggctccaatctacgaatatagcagaatatcattacaaatcattttgttgaccttttttaaaaaaatgtttggttctatcctgggtctctgggctctccagcctctggttcctggccctccaggcagtgtcaggcgtgggctccctctcatggcatgagcctcaagttgggcagtcattggttggccacgcgcacagagtctgtgctacctttaccccagcatcttgcaggcaggacagattgtaggtctaaggttttgtggttgggttggtatccctcaactggaagccttacctggttacagatagcaggcccagactccatatgccccatcactaggagtctttgctagggtccccctcgtagattccaaggagttggaattacactattgcactaggtctctacctcaccctcaaagtgcacctccccccaattccagtcatctctcccaatactttctccttctatcccccaatctgattcctcctgttcccatccccactcacccccagttcacccatgaaatctattctttttccccctcccagagagagtcttgcatcccttcctttcctgatctctctacgttatttagcctctcagggtctctgggtcatatcatgattagcttttactttacagctattatctacttataagtggcaatgtaccatgtttttctttctgagtctgggttacctcactcaaagtgattttttttctagttctacccatttgcctaaaaagttcatggtgtcatttttttaacatctgagtaatactccattgtataactgtaccacattttgtttatccattgttgggttgagggtttatccattctaggttgtttccagtctctgactattgggaataaagctgatataaacatagttgagcaagtgtctttgtagtaggataaagagttctttgggaatatgcccaagagtaataatatagctgggtcctgaggtagatcaagtcccagttttctgagaaaccgccatattgattttcaaaatggctgtacaagtttgcacccccaccagcagtggaggagtgttccccttgctccatccatatccttgctgccaagagctgtcacctgtgttgttgattttaggcatgctgacaggtgtaagatggaatctcaaagtcgctttgatttgcatttctatgggggccattttcattcaaactaccatgggtactcattgctccaagctggggaagcttccaggctgcactttagtcccatgccctcctctccctcagaggttgtatggagcaggacagagagaaataggaacccagtgacatggaagtctcaatgtacctgtttaaaaaaaaaaaaaaaaaaaggagtagaggcatctcggttagggaatgacctaagctgggctttctagacctcccaacagtaagggagccagaattaccacacacaggagataagggagccacacttccttgaaagtaagcattgccaggcggtggtggcacacgcctttaatcctagcacttgggaggcagaggcaggcggatttctgagttcaaggccagcctggtctacaaagtgagttccaggacagccaaggctacacagagaaaccctgtctgggggggtgggggggtgggggagggaagaaacaaaaaaacaaaagaaaagaaagtgaacattgataagcgtgttctaaaagcactgtgtgatataaaatcacactttagggatcgctgtagggattttgtagagatttagtagaaatggtaggacggcaaatggtataaaaacttaccagcccttcccacgtaacttgctctgtctcagaagctgacagatgccattccctgtaatcggtactaagctggcttcatgcacaaggcagcaggatccgggaagggctgtatacctagcagtgacagccaataggtagcaaacactgcgatgtgtgagcgctctctgttaagtcaaggctctccctgtgcttccagaggctcttcagcagtgctgtgacctctcccagctctggttccgagaattcttcctggagttgaccatgggccggcgaatccagttcccgattgagatgtccatgccctggattctaacggaccatattctggaaaccaaagaaccttccatgatggagtaagagatgggattgggccaaccaggaagttcctggggtggaatgggagggtggcttgcctctgagctctgtgctttacagaggaaactactgagtagagattaggcaaagtgttccactccaaggtcatttgcctcagccccacagattgacttagaaaggccctaaccccacctgcccttcctgactttgtctacctcttaacagctctgcttagaaaatcaccttgtctaggaaccaagaagtaatctcctaggccaaaatttttaagccagggggtccatcagcatcattgattctgatatctgtgtgcaaatttgaaagcaagttcttcctacttggaggcacggggaacacagagagggagggagcttgtcttcaactccaagccatctgcctcatcactcacacctctttttcccagccagtgtaatttgtcctccgtgactctgtgttccttcccaggtatgtcctctaccccttggatctgtacaacgacagcgcctactatgccctcaccaaattcaaaaagcagttcctgtatgacgagatcgaagccgaggcaagtggcatgcttcctccattcctgcagtctcccaagatgctgggcttatccaatacttaatgattatcagatgggggtagtgtgtcagaggcacttatccagggaacaaaattcatgattgctggggctgtcaaacataatactgtacagtagcctgctcctttctctcctcatcccttgtctgggctacaccatgaggggcttcaaggaccttcatgtatatatacacttcggcttgcaaatggtgccatctagaaccactccaaaggcaggtcacgatctccagaaaagaccatggggcctctggaggcatcaggaatatttggacaagaattcagagttggttctagaaagggaacatggggtttaaatgaacactcctaagttgaccctgtagactccttatctctagaaggtacattgagcatcaagaggttcagaggcccaagcaggaggcctcagttaccgggatatgaagccagcaccatgggttgaagccagcaccgtgcacagcacccactgtgggttctgctctatgtaatatagtgggtgtcagatacaagtacagaaacttttaaataaagggttcgtcttacaaagctgagggcttaataggaagaaatcaaagatggacctcctcctttggctctgcctcctgccctgctgatgccggagcctgatctctttcaagtcccacgttggccaccttctgctccccattcatggatagaagcgacgtctctggtgcttgatgtggggtgtgcccttgtcttcccacagacttcatagtctcctatgaatgccgtgagacaccgcagggcaagactttgtacattaaaaaaccagagggatttaaggaaagctggaagaaagggacgtttctgtctctaagagcatgctccaaattaactctacagagcaagaaaaatcaaatacaaggaggagacaagaaagtctttgggtccacaggctgctagaggtagtcacaacatcagagggtggcctttcatttgtgttccctgaccaaacagtggggagcaatggggagactggttcctgggctcctctgaagccattgagggcaaagggctgacttccgtgcctgtgaatggccacaggtgctttcttcttcttcccctttctgtcagggctgttatgttgccccagaatgcacgtcagtgaaccctgccctggtgccctccccgctgcccatctgtaattaatccagacaggacccgctgactgcctgcttttccccaccaggtaaacctgtgttttgatcagtttgtctacaagctggctgaccagatcttcgcctactacaaagccatggccggcaggtaaggggagtctaggcagtgagcagcgtcctttctttagcctcgcaccttgttcagcctttaaggaaaaatgaagcgatttccacgggctcaggcagtgagacatgttgtgaaggagaatagatggatggcatacaactacactacagttgcatagaagggcagaaactaagcaaaatgaaggacgttcatgaaggaagactgagattctgggactatgtggtagataggcctcggctagtcgaggctatcttaaggaaacagtgtccagggagttaagtaaaaggaggtgagggataggtccagagtgcaggcaaagggaacttcttgtctaagccggagtggggcaggtacaaaattaatagcttgcctgcctgcatcaggctggtgagaagcctgaggtacttcagtgcagtggccactagagggcgagctgttccacctggcatcgttgtaaacacttgatcctggggaggcatctgccaccacaaaatggtttcagaagcacaggggtggcttgacttgacttttaaccttaacgttttaaaaatgtaaatccatggagtgcgtatttaaggtgtgttgagttggagacatgtcaggtttatagacttgtcagtattactgaaagatactgatttaaccccacccccctcccctcatcctcaatggattcctgggttttcaaaccctgcaatggtcctagtcataaaggaaaatacatttatgtaaaagtattgcagttctcgctggaagttgaggtgggccagccagccatcccaaggtgatccccacccccaggggcttctcctccctacccccttggaagtgattggcttcatttgactttgacaaacttgacacatttcaaataggagtcgacgtgcactgcacataaaatgccacgaacatgggatcctaaccgataaacagaacgcacaaaggtacatccatctctaagaagtcacttaataggtgtgagcagatcaggtaggaagcggttaacgacgggggagagagcatttctaagagcattctgagcctgaatatgctgatacttttctgtgtaaacaaacatgggcatgtcacatcctggcgacgctccatacttagtttataaaatctcatcttaggagctagagagatggttcagtggttaagagatcttgatagtcttcagaggactcaagtttaattcccagtaaaagaaaggggaattgaagttcatctttaaagatatatgtccccagctgggttagcagcacacacctttaaccccagcactcggtaggcagaagcagacctgtgagtttgaggccaggccagcctggtctacagagctagttccaggacaaccagggctgttacaccgagaaaccctgtctcaatatatatacacatacatatacccatttgaaaaaaagctctcaacaactttccctgcaaagtgggtgctcttcaaaaggatggaaattgagagaaactggggaattcagagaaagaaagcactagaagggagagtaaccctggctgatccatctgaggtaaaacactgcctcgagtgggagccacctgtggcaccctcagtattcagcagccatattttaatgagggaaagaaatggctgacattttaacaatatgtttcatttcattcaacaaactgaagccactaacatatcagcgtggcatcagtgtaaatactattaaagacatctctgctttctcctagatctcctaaatctattacgcacatgacagcggatgccccctttgaggcgttcagtaggcaccatggttggtggctacagctttggactgtgccattttgaatgtccctttcccacttaaaacctttcaatggcttccagtccatgcagacgtcccaactctctacaagggtctgtggtctcacaagatcaggcctgtagactaacatgatgtaacctgttttggcaaactcttcttttctttaccccgattacgtcctgtttagtcgaacagaccacacttactgtgtgtgggataaatttacctcagccttacgttacctctgcccaaagaaaccacgtacaaatacttcccataatgcctacctccaaatgatttaggttattgctttccagtactagggatactctaccacctatgtctcaatatggaggacagaaataatacacgtgatttataggattggtgtgacattaaaaatagttgtatatgtatgcccttgtgggcgtgtgtgtacactcatgtgcgtgaatgtatgtgtgtgtatgtgtttgtacctgtgagtgtggtgtgtatatatgagtctatgtgtatgtgtacatgtctgtatgcatgtgtatgtgttgcctggtgaatgataaaagctatgcacatgtttcctattaaaaaccatttttccctagattgctcacatttatcagtgtctctttattggaaagtctgtaccttgaggacagacagcaaggaccttcgtttcccctacaccgaaaattttcactgggaaacactaagaatacactcagttgtttttgttatcaattaaggaaagagtatccaccctgggttgcccatcctttactgagaaactctctttcacatactgagcttctgcatccagaaagaagcttggggaacggtatctacagcgacctcaattctggttgagatatttaaggtcatgtgtcccaggaggaccggttgagaagtcatttgccaccctgtttaatgcacctctgtcccacgtctctcttccagtgtcctgctggataaacgttttagagctgagtgtaagaactatggggtgatcataccgtacccgccatccaaccgctacgagacactgctgaagcagagacatgtccaggtatggtgggagaaagccatgacggtgggaacagactctgtggagatagtgtggacttacgtatgtgcccgaagtgtctgcaccaggcatgacagcctcagagtcctacaaacagtactgagtgtccttgggtgcaagttctagacttcctggctcctctgcagctagcctgagaaggactgagcaattccagggcctgacatcctggagtggccttttcctcaccagcactgtcacacagaaacaggtagacccacccctgaagtaaatgagaagagctcaaccccatttaaatgtagcacttcaagctacacctggggtagaaactgtgttgtagaaattttttatcccaatccggagtttctatcccaccttggtcattcagttcccagataaaaggcacacagcttttattatttacaataagccttaaacagcacaagagctgggcagatatctactaagttattacttattatgttttatttgggctgctcttaactcccaacaggccagctctcagggccatgttttcatgactcacccaacacatggtggcttctttccctcctcccttcttttccctcttgtggttctctgccccaaccaggtctctccaaacctatctacctctaatctctagaccttctggtatagaatttaacattacgatctatagcagtggaccaaacctcaacaaaactggtttgtttttatccagtggttttccttaacatttgaccccagatgtagggaaaatgctgccgggaacaagaacacagatcctggttttaaaatgctaatcttagctagaaaggcatagcggtaccaccacagaccctaaacccgccctgcaggtggctggtcagcagaacagcctgtgtgctgttacatctgtgtggttgttgtgtggtcctaggtctctgtgaaggagcagagctgaggccaagaggatattgagctgagcaggaaagaatcaatattgaattctcaggacatccattgccagtgtctagtcgcaagagaggaaaaaacaaggctcactagatgagcaccagaagttgcagtgcagccagaattagccacaggatccccttatgggaccttagttggttagtaggaaatttatcctaagataaataatacctaagagtaatcatgcagtgcctagcaaagcatcgtgcacacagcaggtactccatatatggctattgctgtcttcatagcatctgcaatagtacctatgtggatcccagtggaaattatcttaagctatattttccaccctttaataagcctttcatatgcttgcttttaaaaaccactgccatgaaggcataaagtaggccatcgctaaagtggctacagctccctagggactgtgaacaggaagacacagaaggagcctcaaggctgaatctagggtgtcaacagaagcgttcatcagaggtcagagcttgccccaagcctctgcccacagcctgaatgagttgtatttgacctcagcgggttttatctaaatcagtggttctcaactttcctaatgctgtgaccctttagtaagtccctcatgttgtcatgacccccccaccataaaattatttgatcctattttataactgcatttttgctactagtatgaatcataatgtaaatacctgagatataaccgcaagggggttgcgacccacaggttgagagccatgcatgtaacaccttcgagtagtatagtgcaaaactctctccaggctagccagactcatggtgatgagcatttcattgtactgagggcatttttctctttgtcccacaagcatgcatgcccattacacatacaccatatatgcatataatatgccaaagataaaagattaaatagaattaccattgccaagagattatgtgatgctatctatattctacatacaggcattcccttgccacaataatgctttctataattttagttcagtttgctaccagtgcatcgtatttagttgtcagatatctgtgtagatattacgtaactttctcccacctctgcccttcagctgttggggagatcaattgacttgaacagactcatcacccagcggatctctgctgccatgtacaagtccttggaccaggccatcagccgctttgagagtgaagacctgacctccattgtggtaagaaacggagacccttgtaggctctgctcttggatgcctcagatggatgcccagttggaaatagttgttagctcttctggcctagtttaagagtagcaaggggtttcctttacatctgaccagagagactgggatgaaaggtcattaatggaatgggaataattttaccgttccttatggaccggcagccaggtaagcagagtggaggagagtctccagaagatcggaggtacccatcccccaggttgggccgtgtccttaggatataccaggtgggtcaagcaggcagagtcctaagaggctagaggaagcattacaaggtcacttgaagggcatgtgggaggtgagagcccagaagggttctacagtgggttgtttgttctgcttggtctctatcttgaaaggctggatggttttgagcactgccccgtgtcttcattttgtactatgccccttagagttttcagccagctctgttgcccggtcaggagtaaacctgcaccttccagaaaacagcagctggacttgctccctctcagtcttctttctaagaggtggcaggcatcaagtgcattgaactaggacaccagagtcctacagactcatcctcccagtctgtccctagctctgaccgtgactagctctgtcatcttgggcaagttatatatcttcaccaagcctgtttcctacctctaaagtgaaggacaccttagagtccacttcagagagtcattagaaggacatagtaagaactcatctggaaagaatttggaatgggtctttgtagttgataaatgcttaataagtgatagcttactttttcaagagaagaagggagcgagaaaggactagagggctgcagtgttctcctgggatacgggaatatctgcagcatctgtaagcaggacgtgaaccaaccactcacctgagtcttgcatcacttacaagaaactgtaaaatagctcacattcctgaaatcactcgcctgcctttagcttgggaaatagagttttgtacgcattaaaatgtcctcggtgcttatctctcaaggggtgggagtttgagtttcttctcttttgtttatctgtgtattctggcttcccactaatgagcatatctggaggggggggggcaggtatccacgacctctccccactccctggaagacactgagtgttctcttggctagaacacaatgaaaactcgaagtgtgagcccttgtttaatcagctgagacactgacccccacccagaacatcttctccccggggagcctagggaggaccccctggggagatgctctcctgtgggcaggcttggttcctgtggcctaggcggggcagcctctgcctcctggcagtggcagaaacgaactgaggaatgtgcctttcccatccaccttcaagactgctctaaaatgtgtgagtcaccgcgtgtgacttggggagccagtcacctcgtcgtgcaagtgtgccaagcagggagtcctgcagactggcagcccatgggctgtttggcttctggtgtactcgaaatcttgagtcaacttggaatctttggaagcattcaagaaagactgcaggagctgggacagcaccagactagcactcccagatggcagcaattgctgggcggactacagactcaggtcaacaggtccagctcccctagtcatccgcagagcccccacaagcccacctgactggcagcccactggcccctgctgtatttaattctcagatgcccgctggagtctctctgagctctcagaactgtggtcgctctggtggggctggcctctccttctcctccttcccgctctttggagactggttctttgaaattgcctacctggctgtcttattttcccattttgcttttgtgccccagttcccacatcagcagagttgagtaccagctccttttgtccacccttgcatcaactaacccacgttcatggaacttgaaatcatagaatcacagacctctttccccggctctcgttgtcttccccaaaacagggtaccgcgtgcagcgtgctaaaagggctcaatgatcttagaaatgagctcgttagcgttgccatcagtgttcgtttaccatattgcccgtcctcagcagatgggaacggagctgcagcagaaccagctcagccccgagagacagaagcagagagctctctatctctatccttcgttcacttctttggtgcagagactgactgccactctgtggttgaaacccaggttttagcattctttaggaacatctaggatctgccatccttagcccaccgtagcatggcaacagttgggataagtgtcaaagcaccaggcccagtgctgtgctaatgatagagtcccccacccgccacccatcccctaagactcccctttccaagccatctagttttccatctggggcctgcctggccccgttgctgttagcatttgcaattgcaacctgcactcccagcttacagctatgcaggatgagtttcagagtatccaagctgcagtgttggaagtatgagctgagtccttgaccccaccaaagtagacttgtcaggtgggggaggaggggcccgtggctgatgagacaggagccaaatctttgtgggtagtgacccactgagctccctgggaaagctggtcccgaccatgccagtgtggttttgaatgccatcccaagcacttgttcttgtgtgaccttgggcacatggccttctgatcgtctcccctcggtaacaggaagagcggcaccacggtgtaaaaactggcctcaccaaagcatggccagagtggccttcgatgccccaggacttgagctttttcccctcctacgtagattgtgattctttttggataataatgattgagaggttgcagagcagcatgaagggaacccaattagaagggtgtcattatcactttatttcccagcaaacacagcaccccactctgtgccgacccacaccctgagctcacccctgcctcaatgatcagagcctctgccacacacaggttcctggtcactggggtggagtgcagactataggggtctcagtgacaatgttgccaaaatctggaaatatcctacttcagctgactagttaaccctaagtaggcggtatctcctatatgacactttctgtaagacagagaaatgacctctaccgagatgcagtcacagtattacttaggacactcacactaggacaggcttttcccttaccaattaagaaatcagaaaaagacagccattgcagtacattgagctccatagagacagcgccagggcaagcgcgagccggacaggcactgggcgactctgtgcctctcggaggaaaatcaactaaacatgggcaaaggagatcctaagaagccaagaggcaaaatgtcctcatatgcattctttgtgcaaacttgccgggaggagcacaagaagaagcacccggatgcttctgtcaacttctcagagttctccaagaagtgctcagagaggtggaagaccatgtctgctaaagaaaaggggaaatgtgaagatatggcaaaggctgacaaggctcgttatgaaagggaaatgaaaacctacatcccccccccccaagaggagaccaaaaagaagttcaaggaccccaatgcacccaagaggcctccttcggccttcttcttgttctgttctgagtaccaccccaaaatcaaaggcgagcatcctggcttatgcgttggtgatgttgcaaagaaactaggagagctgtggaacaacactgcaggggatgacaagcagccctatgagaagaaagctgccaagctgaaggagaagtacgagaaggatattgctgcctacagggctaaaggaaaacctgatgcagcgaaagagggggtggtcaaggctgaaaagagcaagaaaaagaaggaaaaggaagatgaggaagaagatgaggaagaagaggaagatgaagaagaagatgatgatgaataagttggttctagcacagttttttttttcttgtctataaagcatttaacccccctgtacacaactcactccttttaaagaaaaaaattgaaatgtaaggctgtgtaagatnnnnnnnnnnnnnnnnnnnntacggtgggaaagagatgaagacactcacttgatccgtggaggaggcaagtcaccaactcccacagccagcccccacttccatatggtttggtttattctgatttccccgcctaagcttcctcctgtgtgattcccactgggttccagatgctctgctgtctagctgctccaggcttcctgcagacaaggggaaagatggtgagatttccctgggaaaacatgctgcctggtgctatcagaacaaaaaccaggctgcctgtgaactccaccctcattagtttgaataaaacccaggcgtttctgccttgtggggtttccaaacggcaggaaaaggagaaatcaaagagagccagctgtataggtcttaaaacactttctggtagggagccaagacttcgggtgagctcaagaaagtgaagcaggttcaatggtggctactacaagggtagggttgactgggtaagacggagtgcagctaccccctaccaaatattctcattgactctcctccctacaaatgccagtgtcatcactccattttatgctcgaggactcaaatgcaaaacacaatagaagcttggcaggttcatcactggcttttctcagttcttctggggggtccaggattcctccttgctccctgggccctcataactgcctcagtctaccagaaacgttacctcacccctccttgtctggagagattgaggacttctgttatccttccataactttcttctgctgtccaaggaaggagtatctccaacctctctgtccttagtcttattcagcgagaactttcaaccatttaatcaatacaattcacaaaagcaccatctatctctgtcttcagcaccatcatcatgcccaggccttggacactgggtagcatagcataaatgttcctcttgtgtctcatgactcagtttcccttagcctcttctactcacctctgatcaaaggcttgtcttgtacttgatagcaacagggaacctacctagaacagcagtaggcatcaaagagaagagcagagaggggtagatagctggtatagactatgggatgcaggaagcagagtctgtggagaagaagatggagaaaggatggacagaagcaaacaagaaaggaaaagattcaggtgtggaatcacatgccttttagtcctagcacttgggggccaaaggcaaggtgatgtccatagttggttataagccagccaaggcttcatagtgacaccctgcctcaaaaatagatagatagatagatagatagatagatagatagatagataggcaggcagatggatagatagatagatagatagatagatagatagatagataggcaggcaggcggatggatggatagatagatagatagatagatagatagatagatagatagataggtagataggtagaaaaaaacaagtaaataaataaatggggggaacatagtgagggcaacactgatgttcatatttctttctcttggggatacatctcagccaagaatacaagcaatagagagcaacaatctaggttgttagaaattagtaagagttttaaatcagaaaacatttttatatattttgataatattttttccactccctcagcacctcccagatcttccccacacctctctacccacccaacttcatgttctttctacaacaataactacaactagaaccaaaagccaaaacaagcaaacaataaaatgaaaactttcaagacaaaaagagaatccattttgcgatggcctcctgggaaggagacctaccctggagtgtgtttgatatccccagtgacactccatttaattttttctttaaaaatttaaagatgattttctctttgccaaaggctatcttgcaaatagtttcttggttaggggtggaaacccatgtccatctccccttctcagtgctgggatcccatctgacttgaacttgtgtgtgctgccacagtctctgtatgcgtgtcagttctactgtgtcttgaagacacaatttcccttggcattatccatcaacactggcctttattctaccaactcttctacatagatctctgagccttgaggttaagagcttcgaggacttcccatttaggactgaggactcatagtttctcaccctctgcacattgtcctggtcactgttttaattcccacctacaccaagaaaaagcttctctaataaggactgaggaaaggccctagtccatttggtatagcagtatgtcattaggagtcatttattgctatgttactttaacatacttaacagtattgggttttcctccaaggcccatgaccttcccagtcccaggttcttgaccacttttgcagtgacaggtatgggtttcatttcatagagtgagccttaaatccaatcaaaattagctagtcattcccttaatgtttatgccaatattacaccagtgcctcttccaggaaagtcactgttacagattgcagggcttgttgctgggtgatatttctcgtcatggtaacatgtagatacttaccagcatcatgaaggatggtcagtagggggtgaggcgtctagctgggcacaagcttatcttctttaggagtaagtgttgtcttcagcgacaaggcgttaccatcaggttgtggagagcgatcaatagccttggcagtagagtgtaatatttagtggggtccatgggtcctctttggccaaagactgaacaggtgtgaccattacttggcactagaggttttatttgtgggctaggnnnnnnnnnnnnnnnnnnnnaaaaagaaggaaaaggaagatgaggaagaagatgaggaagaagaggaagatgaagaagaagatgatgatgaataagttggttctagcacagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtctgggggctgtaaattggcatggaaatttaaagcaggttcttgttggtgcacagcacaaattagttatatatggggacagtagtttgtttttttttttcttttggttttatttttgggttttatttttttcatcttcagttgtctctgatgcagcttatacgaagataattgttgttctgttaactgaataccactctgtaattgcaaaaaaaaaaaaattgcggctgttttgttgacattctgaatgcttctaagtaaatacaatttttttaattaaaaaaaaaaagaaatcagaaagatacaaacatgctttctacccaaagggctgcagatggggcttgcccacactcagcggtctctttcatggctgcatgtagcttctccaccctctcttgtgtgttgggctttttttttttttccttcctatttcaacagtgattctttgggctaataatgattgacaagctatagagcatcaagaagtgaacccaaccacaagtgctacccaagagtatcagaagaaaggaaaattgtcccatgcaactgaagggggtcctagtcctcatataggaggccaaagcttgcctcagaggggtctcctctaagtgttcagtgtgtatgtctgtatgtatttgtctgtgtgtgtctgtgtgtgtgtgtgtgtgtgtgtgtgtgtgtctgtgtgtgtgtgtgtgtgtgtgtgtgtctgtgtgtgtctgtgtgtgtgtgtgtgtgtgtgtgtgtgtgtctgtgtgtgtctgtgtgtgtgtgtgtgtgtgtgtgtgtgtgtgtgtgtgtgtgtgtgtgtgtatgttacctgaaactctttagcagctgtgggttctctctctctgtcaggagctggagtggctgctggagattaaccgactcacacaccgactccttctgtaagcacatgacgctagacagttcgatgccannnnnnnnnnnnnnnnnnnncattcttgtagggaaggtcacaggtgctttgctaaagagctgtcctttacaaaagagttttgatgtagccatgcctaaagctttgccgtgatcactgtcacaaggaaacttttccccaaagtcttactgtgtttaaatgtggtgtcagagtcccgaggtactgatccagggccagccaactgagctgagctgagcctgtattttattcccacctgaccgggattgttccctgttggctgtaatgcatgcagggaccctcacagcagctgtgaagataaagtggggacagaccataggctccctaggccatgctatggtaaccatgtgtgcacgaggcctgggagagtttgatgaaggacagtgttctgatcacactgtccatgtgtaaggacatggatacatacctgaccatgtgtgtacacaacaggcccctttgcagagtagaacttgcctcccggaaggaacacccagctccagggcaggctctgaggtatagataagacctaatcctttcctcacacagggccttatcacttgtattcacaaaccaagcgagaacagttggatggttgggtgaagatgtgtgcaagtgaagtcactgcgttccaggaacctgggtcagggtggtgtgaactaaatccatgcgggacgaatggaaagatatgggaagagtctacacacagatgtacctgaatctgtacattgaacaagatatgctcagcttcataaagatctgactttatagtacattttgagtcatggctacaaactattgcctggccacaactatacatcctatcttgttggcagccatgacaccagtacatgacctaagactggctatgagcagcccatgcactgggaatggtgccatctctttgagggggatcctgtgttccccgtttgtgtgtgtgtgttgtatgcatgtatgtatgtttgaatatgtatgggcatacaagtatgtgggtgtgcatgcatgtgcatgtggacacccacatggaagccccaagttgatgactggaaccatcctcagagctcttcccctttcattgagacagactttctcaatcaaccctagagcttgcctgttcggctaggttgacgagccagatttctctgtctctaagtctatcttccaccttctgaagctggaattataggggagcagctgcagccactgagcactgttacgtgagatcccaactgtggtcctcctgcttccatggcaacccatggccttcccagccccgcattcccatcttcagtgggtggtcagaggaaaactcaaagggcaatagtcatgatgtgaagatgatttaaaattcacaattctaatggaagtcagccatgttctcgagggtgctgtcatctatgacattttcatatccaagggcagagctaagtccttatgacagagatgtctggcttgcaaagctgagggattttttacctggccctttacaggaggagtttactaactcagcttctaaactaaactggaggtgacaaatggagccccagagaaggacatcttcagacccagcacaccctgactcttgtgtctcctgggccccaagtttccccatttttgagaagactgggaaagcatgcagtaatcaaaggggagggggtatcagaagagtctggctcctctgtagacagccatctaggacctgctgcaggtgtcggtgtggggggctcctgcagttgtctgtcccttggaggatgtcacagggctctgttaactgcttccctgtctcttttcttctagttttgtccgaactgccatccctttcacccaagaaccacaacgggataagcccgccaatgtccagccttattacctctatggatccaaggtaaacagccctgtcccatctcacccgtgacagacagagtgggaaaagacaaagggaaaggtgttcccagaatcaggaaagccacggggtatcttattcaagaggaacactgagagccaggcagaaaccactgcaagtccattcaactttattagttcacagctagcagggatggggtagaacattctggacagagggagctgggcaggagctgaggtgaggggtgagtaatgtgctgaggtgggtgggtaactggggacatggggagtctccttgtggcctcccagtttcttctatttcttggttgatttatcataacatcatcaggtgattctgggattctgggctctgtaagttccagagctttacagacagagcttaaaggccattgtaggtgtctagaactatttctgagaggaaggtctcctctacctcatgtgacttattttgtttcctcacatgtgcacatcttcattccaagtgattgtcgccactgggtccattctaattcctcggtccttctgcccattcactcaatggcatttcttatataccccttgtaggccagacatgggttaggttgtccatgctcggtgtccatcgggaatggagacatgacgtacacccacccacaccctcatttccacagttgtggagggaatagtttccaacaagtcccaccaaggtcacaatatgtacaatttaacccttacaataggggctcatgtagaaggaataaagaaacatgtctcccactggggatggggggggggggcgagagacaccagtgattttcttgctaatggaacaaaacccagccacctttgatcccatttttaaactcagcagagataagccgagatgactatggtggagtgagagctttagaagtgtggtgaaccccagagaggctctggctggggcacctactgtgtaggaggaggatgctagagaggatgggtgtcttctccagagaagtcaaactgtttaaggtaatttctcaaacctagagaggctcatcatccaggggtggtagcactcgcctgtcctagcactgagggtctgaggcagcaggactgctctgagttcaaggacagtctggtctacgtggcaagttccagttagccaagactgttatgggagactgtatccccatacacagaagaaaacaaaggaaggaggggagggagggagggaggagtggagatgtcttgcagacgtcatttcaagaggcttagagacatgggtcacaaactaaaaatctggtttcccttcccagttctctttcaaaccttagcttacataaaagaaagacatttgtattgatgttaatgctagtctcatttcttccaagtactgtgccagattcaggtctagctactttcactgtccatcacatagccatggttgattttaatactgaaacagagtcttccgttctttgctaggcctccaaatagacaatactgaaacaatgccttgtttgcccctgatgtaccttgagggtctgtgttgtccaacttggggaccgttgtcatgtgacatctatacagcactgacatgtgagaggacagaagtgggaggtctatagacaaattttcacaaataggaccaactatggagagcaatttaagctttggaaaacggggcatctccttactgttgctcactccctatagtgaggcagtatggccggttggttaccaatctctctagctaaggccaccacctctaaggcatcctggatggcttcagcctctggttcagctttggccctggcccctgagttctttcgtggcagttcctccagggggaacccctgcaggtcttcttccctctgaccaagagctggggtctcctcgggccatcttaccaacccattggcttcctccatttggccggctctgtaagaccaccgaggttcgtgacagcggaggcaccagaactggaggcagatgaaggccagcacagcagtgaagcaggccagcaggatggccatcagcacccaaagagaaatctgggggtccaccagggagcccccggcagccagcggactcttatccagggtgtggaacatggtacagtagtgactatacgggaaggcagccttcttgcagctgatacagaggaagtagagagtggaaggagcgaggtgttccaatgccacagaggtgatggttcgaggcaccttctcctcgtgatggaagttatagcgcaggtatccggagaagatactgttccagttgggcctgtacataatatggtaatagtcctccaagcagggctccgagggtgaccaggagatgatggctcctgtgtgagacacgttcccaacctcaatgttcatcccgggtctggaaccaaatcacagtgaagagtgacatcctccctcctacatcagcatttgacatcatcctagccgctgcagactgagcgcatgagatggccacagatactgacatcgttagagagacaaaagaaaatggacgtccggaggttaagctagtaagccagtggtggaatacaggtaggaatgaggactggctcatgacaaagctagcagccctcaggctcaagatgtacccacatcatcccggccacagcccatcctggctgagatccatcactgacagtgtcgttcccagcccttccaaacacaggcaacgtgaagagagctctgagggcctaccttatgcttctcagctcagtcctgacctcttgcctctgctgtgaatgctgtaatgttacctagaacattctgcccaatggcttttttttttttttttgacaagttacttttcccatgactagtagagattccctctggcgccccccagtggcgatctacctcaaagcttctgcaagtgttttgttttgtcaaagcccaaggtgcaagaaattagtttctcagatcaaggtcctcagctcccaggatagcttaacttctaattgccccataacttctaaaagtagcaatagtactatgacttttgtgactgtctaacccactagttcccaactttcctaatgctgtaaccctttaatacagtacttcatgtgatggtgaccctccaaccataaaattgcttttgttgctacttcataactgtaattttgctaccgtcatgacttgtaatgtaaatgtttgtgttttccaatggtcgtttggcccccaaaggggttgagaaccacagcaaatcggcagttgctggatccaggctgtgccaggtggcttctcccacaataacagactccattcccatcttattaatgagcggcctggagtatcagctcacaggaagagagagaacttacccacttagccactgtatttcaatgcagagcccctgagttcagtaatagattattattgttgattatttattattattattattattattattaaattattggtaaatgaggtaccctggttggctgtatggcagatgagccctgttcagattgtaagcctttcagctttggtaaaggagaggcatcaaggtttttgggttttctttcattctctccgattgagagaaagctttccttctgaatcccccctgatcaaaaatctagacaagcgttgccaggctctatatgttccggtctccctctgccttcttctccattccccatccccagccagaagtgcagatgctgcggaagattgaaatggcaagcgggcacgttcagcccaaagtgaatattaagccaaactgatttctgtttctgggcttgtgttgttaggctaggtgagccaggggaaaacgtaacagcgtgaagtaagttttcagtccttggtttccatctctaaagacagtgacatgcttgagaaagcagcttcctcctctccacgtggctgggaatttgcacccagtaaatgggaaatacaaaagatgaggcaggggtgtacagagcctcccagagatggctttcagaaggaaacggacttactctccctcgggtctcttgatgtatgcccacctccccacccagggacctacatacccaacaaacacacttccaacctccgta

SEQ ID NO: 1320 - DNA, 4294 bp, Mus musculus
gaattccgttcctgtctcagtctccgctgctcctctccttcagtcgcactgcggggtgatgcccaaggcgcatcacttttcagaactggaccatgaacaacttcatcctcctggaagaacagctgatcaagaagtcccaacagaagagaaggacttctccctcgaattttaaagttcgtttctttgtcttaacgaaagccagcctggcctactttgaggaccgccacgggaagaagcgcacgttgaagggctccattgaactctccagaatcaagtgtgtggagattgtcaagagtgacattagcatcccgtgccactataaatacccttttcagactcttgtgtacttacaggtcgtgcatgacaactatctcctgtatgtgtttgctccagactgtgagagtcggcagcgctgggtgctgacccttaaagaagaaacgaggaataacaacagcctggtatccaagtatcaccctaatttctggatggatgggcggtggaggtgctgctcccagctggagaagcctgctgtaggctgtgctccctacgacccatccaagaatgcttcaaagaagcctcttcctcctactcctgaagacaacaggcggtcatttcaggaacctgaagaaaccctggtcattgccttgtacgactaccaaaccaacgaccctcaggagctcgcgctgcggtgtgatgaagagtactacctgctggacagctccgagatccactggtggagggttcaagacaaaaatgggcatgaaggatatgcaccaagcagttacctggtagaaaaatctccaaataaccttgaaacctatgagtggtacaataaaagcatcagccgcgacaaagctgaaaaacttcttttggacacaggtaaagaaggagctttcatggtccgagattccaggacgcccgggacatacacagtctctgttttcaccaaggccatcataagtgagaacccctgtataaaacattatcacatcaaagaaacaaatgacagccccaagcgctactacgtggctgagaagtatgtgtttgactccatccctctcctcatccagtatcaccagtacaatggaggaggtttggtcactcgactccgctatccagtttgctcctggagacaaaaagcccctgtcacagcagggctaagatatgggaagtgggtgatccaaccctcagagctaacgttcgtgcaggagattggcagcgggcagtttgggctggtgcatctcggctactggctcaacaaggacaaggtggccatcaagaccattcaggaaggggcgatgtcagaagaagactttatcgaggaggcggaagtcatgatgaaactctctcaccccaaactggtgcagctctatggggtgtgcctggagcaagcccccatctgcctggtgtttgagttcatggagcacggctgcctgtcggattaccttcgaagtcagcggggtctctttgctgcggagaccctgctgggcatgtgcctggatgtgtgtgagggcatggcctacctggaaaaagcttgtgtcatccacagagacctggcagccagaaactgtttggtgggagaaaaccaggtcatcaaggtgtccgactttgggatgacaagatttgtccttgatgatcaatataccagctccacgggcaccaaattcccagtgaagtgggcatccccagaggtgttctcctttagtcgctatagcagcaagtcagatgtgtggtcgtttggtgtactgatgtgggaagtcttcagtgaaggcaaaatcccatacgaaaaccgaagcaattccgaggtcgtggaagatatcagcactggctttcggttatacaagccccgcctggcctcctgtcatgtctaccagatcatgaatcattgctggaaagagaaaccagaagaccggccacccttctcccagctgttaagccagctggctgaaatcgcagaagctgggctttagcagggactcattgaccagacacagccataaatcctgagtgaaggaacaatgtcctttttccagagcattaaaagctgccaccagtccagaaacccccacaggtgcctggaccatggtgccagcacctatgcagccacaactgcagcatcatagaaaagggtggagggccagccactgagccaacagctgaaccacaactggagcagtatctgcgtgtcaccccatcccagcctcttgtcgtatgctgtactcaaagctccattgcccactctgggagcatcccctccccctcttagcaatccatggagaggcagacgtaggccacactcttctttattattactttaagaataattcaagtaacctttaatttggcccaacgagacaatgtgcccattttatggatggaagagcgggaaagcatcattctttttctaagaaatgcaagaggtgattaaaccagggtgttctactacttcaaggctgtcagccacagcttcctgcctcacatgaggcggagcggatgcttgtgccagaggccggatgccataaggtttcagagcacactgccacctctctttgatggggcacagagagctccaccgggtggatagggcagggtgacacattcagaccccacggcaggaccacaggatgtctgaggtcggtcaggaatgagagggcctctgatggtggaagtaaagagctgcaaaagaagcctttgggttgtccctgacccagcggccctgtttcacggtgagtcatgtgtgtgactggatctcctgttctgtgcaggatgctgaagcagtgactacagaacggtcatcattccagcctctcaggagcggcatccactcagcactgtcatgatccttgtgactttgagactttgggttctttcaagcctttacgggttcagcagtcttaaggttgccatgtaagctctcaagagcccagcaaaggaagaaggcgtttgctcttgcccaaactatcaggaaggaaagaggcaagcactgggcggtgcttccaaaatgcacagatgtctcctactgattggcactcgcacaggtgacatgtgtatatcctgcacacaggtcatcctggcgaatcacagttcataccaacccaaccacgaggtattattcatgtcttacagaaagtggacttggtcttttaaaagctggatagctgccccagtgacagaactgggaaggacggagattgagatgacacccgaatataactccagtgtagcctcttagctcttctcaatgctgcctcctactgggttgggccgctgagcgcataacacaggaaagtctgggttaatgggcaccccaccccacagccaagttgctcctactcagagcactggggggcccagtgggaccctccaaattgaaataggctgttctctttcttcaccctcacctggatctgagttcacaaccctggagccactcaaaattaaccctttcattctcccaacctaccagagtcacattgcctgaggccatttatactagagcttcaaaggtgctttcaactagtctcctgcagactgtttcctgtaattatcccttcaacctagagctggctctcttgtgagaaggaggattccctggtgccaggcacactggattttctgcggtgttcagacaaagcccctagaaaaatgatcagagtcacagatccctcttcctaagtcacgtggcatttaggctggcttgaggctcaaatgcatcacttccaactgtaatcactgtgtccagataaaactctgtcattcagaaaatgaacttcctcaactggtccacaatcatctctgtttattctcttttgggaaaccttaattaagagacgatttctgggacatccaatctggaagataaacactggaaccgagagaagtctgtggtgtggtttaggagactggcccccatacggtggtattggctctcttaacctcacatgcacgaaggctttgatggacgcgtgtgcactgcttactccagtgtcctgcttgggaagatgggattctcttctgctggtttctgtcttacatttttttgtaaatggtgccctgtgttcacagaaaggttttggtttgaaatgtattttgtaggccttgcaattcataatgtttggaactatgtatttatgcctagatcaggagagtatttattgcttgtcttcatgataaaaaatactgcaggtatgtcttaccctctgtgggggccacaagtcaatcattgcttatggaaaaaaatatatatataaagctacatgttttacaaaaaaaaaaaaaaaaaaaaaaggaattc

SEQ ID NO: 1321 - DNA, 1878 bp, Mus musculus
atgaacaacttcatcctcctggaagaacagctgatcaagaagtcccaacagaagagaaggacttctccctcgaattttaaagttcgtttctttgtcttaacgaaagccagcctggcctactttgaggaccgccacgggaagaagcgcacgttgaagggctccattgaactctccagaatcaagtgtgtggagattgtcaagagtgacattagcatcccgtgccactataaatacccttttcagactcttgtgtacttacaggtcgtgcatgacaactatctcctgtatgtgtttgctccagactgtgagagtcggcagcgctgggtgctgacccttaaagaagaaacgaggaataacaacagcctggtatccaagtatcaccctaatttctggatggatgggcggtggaggtgctgctcccagctggagaagcctgctgtaggctgtgctccctacgacccatccaagaatgcttcaaagaagcctcttcctcctactcctgaagacaacaggcggtcatttcaggaacctgaagaaaccctggtcattgccttgtacgactaccaaaccaacgaccctcaggagctcgcgctgcggtgtgatgaagagtactacctgctggacagctccgagatccactggtggagggttcaagacaaaaatgggcatgaaggatatgcaccaagcagttacctggtagaaaaatctccaaataaccttgaaacctatgagtggtacaataaaagcatcagccgcgacaaagctgaaaaacttcttttggacacaggtaaagaaggagctttcatggtccgagattccaggacgcccgggacatacacagtctctgttttcaccaaggccatcataagtgagaacccctgtataaaacattatcacatcaaagaaacaaatgacagccccaagcgctactacgtggctgagaagtatgtgtttgactccatccctctcctcatccagtatcaccagtacaatggaggaggtttggtcactcgactccgctatccagtttgctcctggagacaaaaagcccctgtcacagcagggctaagatatgggaagtgggtgatccaaccctcagagctaacgttcgtgcaggagattggcagcgggcagtttgggctggtgcatctcggctactggctcaacaaggacaaggtggccatcaagaccattcaggaaggggcgatgtcagaagaagactttatcgaggaggcggaagtcatgatgaaactctctcaccccaaactggtgcagctctatggggtgtgcctggagcaagcccccatctgcctggtgtttgagttcatggagcacggctgcctgtcggattaccttcgaagtcagcggggtctctttgctgcggagaccctgctgggcatgtgcctggatgtgtgtgagggcatggcctacctggaaaaagcttgtgtcatccacagagacctggcagccagaaactgtttggtgggagaaaaccaggtcatcaaggtgtccgactttgggatgacaagatttgtccttgatgatcaatataccagctccacgggcaccaaattcccagtgaagtgggcatccccagaggtgttctcctttagtcgctatagcagcaagtcagatgtgtggtcgtttggtgtactgatgtgggaagtcttcagtgaaggcaaaatcccatacgaaaaccgaagcaattccgaggtcgtggaagatatcagcactggctttcggttatacaagccccgcctggcctcctgtcatgtctaccagatcatgaatcattgctggaaagagaaaccagaagaccggccacccttctcccagctgttaagccagctggctgaaatcgcagaagctgggctttag

SEQ ID NO: 1322 - DNA, 92563 bp, Homo sapiens
gagtgagccactgtgattggcccagaagtgacctttgagcaaagacataaaggagatcagagaagaagccatgaagatgtctggggaaagagcttctcagtcagaggaagcagcaagggccaagaccctgatatgagagcatgcctggtatgtttaaggagctccaagcaagctacagtgatgaaagtagagtgaattaggaggagggtcgttggagatgaggctgagaggcaactggggtggtggtggatgagcagatcatgttggatagaccttgtagcgctctgagaggtctttggctttgctctgaatggtggatgatccaaaccataaatatagaagatgattctggtcaccatattaaaaagagattgtagaagtgcagggaagacagtagtagagacggggcaactcctgcaagagatgatttggggtaagacgtgtgtgatagcagtgagagtaatgagaagtgctcagccaccatgcatactttgaggcaactattaggtatgctgatttgaacaatttccaataaatattagcaagtaaaaaagcaagttgcttggcctgagatactgggcacacaaaaaagtatgtcgcaaaatagcatatgtggtacatcatatgttatttaatgagaaatttaaagtgtgcgtatgtgtgcgtatgagtgtgtgtgtgtgtgtgtgtgtgtgtgtttgaaaggaactggtagtaggagctaccttgggtcaacttgctctctcagggaagtagcaagatggagacttcatttctaggacattcccttcacagagtaagactttcatcagtcatggatagccttcttagggtgttgaaaatgttctaaaaattaaattgagagggctgtacaactctgtgaatatataccaaacattaccaaactatacactttcaatggatgaattttatggtcaatgaaacatatctcaataaagttattgaagataatagcaacacgtcagtcttgacttatagatccaatcccattgtcttccatcattctcttagataattaaataatccctgggcaggcatgttaaacaaggctttaatatgacatcagaagtacatattgcctgctttacttgatttttatttacaagttttgggtaatgtttcttgatgaggaatgtggtagagcatggataagctagaatccaaattttagagagcttacaatcagtagaacacacactgaaaaaacagaagaaaacaggagggcaagtaaatacacagtagagtgataacaaattggttgaatgaacggtgactctaataccctttaccattatattcaaaaccaacaataattgtttcttaagaagaaaaacaatcaaaatcacaattctaaggatagttttgcatacattttaagtgagcctaaggttgaagagctgtgaagagtgataacacaaaacagtatatacaaggcacagtatatgcagacatacaagattatagaaggctgaagtctaaacgtgcattgtgggaagtggtttcaagtcaataacttttattcttcatctatgattttgaaaagcaagggaagtagacagctatatatagccttttcaatgagtgtgcagcccaggggagcattgtgagctaggcaggatgtgagggtggggagatttccataccatacacagcatgtacaggctgggtaaatcccctggcctaaaatacaatccacagtgcttttatgtcaatgttgctcagcagaggtggcgtgggctgagctgcggtcagcctggggcacctaggacttcaggaagccaacctgatttctgccttatcttctggctctgaaaagactacagtcacctaactcttcccctgaggaccatatgcaaatcagcctgcctctctgccttgggttgaaaaggaaaatgaactggtatacatacaaaaaagaagtcagacaggggatcaaaataattttatttctcaacatgatgatccaactagcaccgcctgtcttccccctcctatctctcatcctgtcttgcttctttcctgctccctgctcagcatatttggccccactaccaagcggaatccttccctgctcacacaggcttaggacaacttcactgtctccactccctgttttgctctgtttacaaatcatgagatgtcctgcctccgtttacatattatttatttaatgttacattgaagaaacttgcagctaaattcacacacacagacacactcgcaccataataaaacacttaacattaaaaataaagatcaggctgggcgcggtcactgacacctgtaatcccagcactttgggaggcggagccgggtggatcacttgaggccaggagttcgagaccaacgagggcaacatggtgaaactccatctctaataaaaatacaaaaattagctgggtgtggtggtgcgcacctgtaatcccagctatctgggggccaaggcacgataatcacttgaacctgggaggcggaggttgcagtgagccgagatcacgccactgcactccagcctgggtgacagatcgagactctgtctcaaaaaaaaaagatcagaaactgtctacaggtagaaggaggtaactgatccagtagctgggataaaatgattattctaagtaaatattaaatttaactctgaaaaaatactggaagaatgtaaaataaatattaacattgattatttctgaaggatgagattagatgtaatttttatttatttgctggtctgctctttccaccaagaatatattttacttttgttaccagaaatatatatttcaaaaaattagctctaagtttactagccatttcagtcattattgtcttctacgaatcaaaccaatgatttttgacaaatgacatatttttcttttattttaaattggaaagtaaaaaatccttccattttatcatcttttaaattatgtaaattaaaaagcaaaacatttctttacctttccagttttatatgctggaattttgatatacaaacttcctgctatcaccatgtacatttaaacatacattaatataaacacaaaatatacctggaaaaggtatagaacaatatgtatggcttgtatgtaaaaacaaaacataaaaacatacaagccaaacatattgttctgcaccttttccatgttaacaatatatcctgaagttttttaggttgatacattatgaatatacattattggtttccataaccttgtagtgttccattgtaaggatgcaccatagattattttacttgtctctcattgatgcacagagaagtagtttccattacaaaaaaatactgcaatagccaggcgcggtggctcacccctgtaatcccagcacttcgggaggctgaggcaggcggatcacgaggtcatgagatcaaaaccatcctggctaaagcggtgaaaccccgtctctactaaaaatacaaaaaattagctgggcatgatggcacatgcctgtaatcccagctactcaggaggctgaggcaggagaatcacttgaatctgggaggcggaggttgcagtgagccacgatcacaccactgcactccagcctggcgacagagcaagactccgtctcaaaaaaagaaaaaaaaaaaacactgcaataaatatcttgtacagatacctctctgtgctcacgctatttttcccccttagaattgatagctctagcaaacgtaaggtgttgttgttgttgttgttttcagaagaaagaagttatgtaggtgccaaaatattctggatatgattcttaaatggatattaataaacctaattaagtttggatgggaaccacaaggaaattaaagggcttcaaagccacatccaaagaggacaattgaaggatgtctttggcctggacacaagagggccctggagttatccaaagggcaagtcctcggactagagaaggttggagttgtaggacttcaaaagataaagcaacaaagatgggttttaggtaacagtaagagagcaatcatttatctgatccagcagccattcccctacctctagtggcaacactctagtgttcctcagagaaccatccctcccccatctgtggatgggtaggtccatgtggctgggtagggctgactccaccccactcccagatccaggagtgtgtccaggcctggaaagggtcaaatgaatattccattgtcttggctctaatgattgaggtacctgcgagcatatcatgtgagctaggccaatgactcaaaattctgggacttttactagaactataaggaaagagatctagctccactggtaagatgttagcccagcagccattttgctgccatggaggacagcttgcccatgcatgaaaccagctcagaactaaagaatgaaaaccaaaacctctgatgtcgtcgttaaataccagcggacccagcagtgccaggttgaattgatttttcctttgttatagaaattgggttaaattaggttttttccaacccagtttcagttgcggccccaaagccctatattaatgtgataaagggaatgaagtacctccatccacacttgacgcattaagaggcaaaacagattctgccagtaatagcgttcgcccaccttcagcctttagaaaacaaggcatgaaaatgcaagagagagaatgttgggggctctgtgtttcctctcaccactagcccacaggggaaggtgggtgggtgcttatctaccagaagccaaccaaaagggactttaagagactcttcagggagcttggtgtgagtcccagagttttgcagctataaggactagtgtctaaatcccactggagaaacataatggtggaagtttgtggaagagctacttattcggtgtcagagggaaagggggctctacttggggcaaatggtatatccatcattggctgggacaggaggcccgagtcttccagtagaaccatgggagggaataagtggtatgtggttctgtttcttttttcttcatttgagacggggtctcattctgtcccccaggctggattgcagtggcatgatttcagcttactgcaacctccacctcccaggttcaagcaattctcctgcctcagcctcccaagtatctgggactacaggcgaatgctaccacacccaactaatttttgtatttttagtagagacaggatttcaccatgttggccaggctggtcttgaactcctgacctcaagtgatcagcccacctcagcctgctaaagtgctgggattacaggcatgagccaccttgcctggctcttttttctctttatttaatagaaatgagatttccctgtgttgcccaagctggtcttgaactcctgggtttaagggatcctcccacctcagtctcccaaagtgctgagattaccagcgtgagcccccatgcccagcctctgtggttcattttcaaggaaattttacccaagaggacaacctatgtcctgacaggacaaatgaatcccgacaggagctggaacagctaaagcccaagggctgagggttgggctccttggccaaggagagtggcaactcctacatcagggaaacagttgtcagaaccttcagctggaaaatctctgaaaacagcaaagcacatgaaacatgcaagaaaaagcagcaattgttcatccaccacatcccaaggacatcatccccagattactgctgcagcttcatgaacgttgcaccctttacccctcttcctcttttccctccagcctgagcttccgactcaggtgtgtcagaaaccaggcttgtgtgtgggaaaagagaggttaggacatggtggaaaagccaacatgcttcaaatcctgaagcaaacccatgcaaagttacggaaaagcatcaacttgaatacatgtttggagttttgattattaccttgaactgaactgggctttctttttcttttctttgtattgttgttgttgttgttgttttgagacagagttttgctcttgtcacccaggctggaatgcagtggttcaatcagctcactgcaacctccgcctcctgggtttaaagctattctcctgcctcagtatcccaagtagctgggactacagccacctgccaccatgcccagctaatttttgtattttcagtagagacggggtttcaccatgttggccaggctggtctcaaactcctgacctcaggtgatccacccgcctcggcctcccaaagtgctgagattacagacgtgagccaccgcgcccagcccctttttctttgcttaactttttattatggaaattttcaaacgtgcatcggtgcaaggagagtagaataatgatgtacccattagccagctttagcaattatcaagtcatggtcaaacagttttcatcccttcccctaccaatttctccccctccactggattatgatgaagcaaatcataaacattttattgttttatcaataagtcagtgtatgtttctatacaaaataaggactattttaacatgataatagtgccattattacatctttttttttttttttttttgagatggtgtcttgctctgttgctcaggctggagtgcagtggtaccatctcagctcactgcaacctccgccctccaggttcaagcgattctcctgcctcagtctcccaagtagctggaattacaggcacacagcacgacactccactgacttttgtatttttagtagagacaggatttcaccatgttggccaggctggtctcgaactcctgacctcacgtgatccgcccaccttagcctcccaaagtgctgggattataggtgtgagccaccacacccagcccattattacatcttaaaaaataacaagtttctcagtattatcaaacatctctttaacattcaaatttgtctaattgtctcataacgtctttatacagttgatttgcttaactcttaatccaaagtccaaacatgctcatatgtctcttaaagtctcttttaatctaagggttccccctttgatttatttgttgttttgttttgcttttgttttttgagacagagtctggctctgttacccaggctggagtacagtgctgcaatcccagctcactgcaacctccacccactgggctcaagtgatcctcccacttcagcctcccgagtaggcgggactacaggtgtgtgccaccatgcctggctaattttttgtagaaaaagggtttcaccatgttgttcaggctggtcttaagctcctgggctcaagcaatccacccccttgacctcccaaagtgctgggcttacaggcatgagccaccgtgccctgccctctatgacttatttgttactgatactgagtcatttgtccttagcatgttttgtattctggactcatccaattgcatctccacagtgtcatttgtcaggttcgtttatctcttgtatttcctgtaaactcgaatttatatctcgaagtttgattagatttgtgtttgattttgttttctcttggcaagactcccgagttgccagttttgtgtacttcctcttgcttcacctcaggagacatacaatgtctggttgtccttcttttaagattaatcagtgtgttacagtgttgtcagcttcatatgacagttatacattttcctattggctttttgcgtaataattttaacagccattgatgatcattgcctacatttattatttcattggcattgcaaaacgatagtattctgtcactccttcattgattagtttcttggaaaaaaagaacttcctcattaaatacttgatcactgaattgaaagataattcttcaagaaaagcaagcaatatgttttatttttttcctttgtttccagttttcagaaaaacaagttggttcttcagcatcctccaaaagtgatcaaaaggttgggatgcttttttcaattctcttttgaactcattgttttaacatttttgctgttcttcaattcatggcaattattattccttttgatactcaaattgttccatctttggcaagtgggaactccttgaatttggctcctatgaagtgaactttttaaaaccaaaacaaacaaagggactatttgtttttgtttatgttttccttaaagtgagaaaaaaatattgagcctcctaagtttgcatttaaaagttggcaaagatgagtctcagttagtgggtttgatggctctatgagaaagagaataaaattacttacgatgacactccatgtagactgagcaaacgaaagactcctaagtattgcaacagctactgatgatattttgttttcccggatgagaacactttgtgaagtctataactcttttcatctgaaccaagcaggtgtaaaatgtactttcctcagaggagtttgtagtctagtttgagaagatagcactgtattatctaggtttgctggtagtgacagaaacctcaaaataactgagacttagaaaatagatattaaaaaatgtaatccagggctggcatggaagatccatggtcaccagggtcccaggctctttctatcttatactccattgtcctcaacattcaatttccacctcatgatactagatagctgcttcagctccaactgttacctcaatattctagtcacaaggcaggaggaaaagggaaagaaaaggggatgacagatcccactaaggaaatttcctagaagttgtgcacacgacttctgctacattcagttgaccagaagacagtcatacaactacacctagctacaagggaggctaaaatttgtagtctttattcttgctggccagatgcccagataactgtcagggattctgttactctagtaagaaggagagagtagctatttgggaatagtagcaatccctacctcaagcccatactcagaaaaaaaaaatactatcttgtttgggcagtgtatttccacacatatgtcttaagaatctcagaatgggggaggtaatttaaaatataccagtaccgtaccctcctgggtgtcttgattatgctggggcatccagtatatgaaataaaattaggctgttgtctggtaatttacatttaaaaataaacattggagaatttcactcctatacagcaataattattatttcatttattatttatccctacccactacatgcaatatctgcttacactaaaatctcttgattattaacatagtagaggtaactgtcacacattatacttcaactatgtactaactctaaggtgacatgtatgactagcacctaccattcataagatgtatgggattcagtcctccaaaggaccctcacaaggaagctaaggatcagagaagtcatggcttgctcaaagagaaacagcatagtaagtgacagagctgggaatccaacacaagtttgtctgttttcaaagcccacatatactttgtttattatgccattctgaaggattcacttatttttcactcttccacaaaacgtcaggacagaaaggcagtcatctatatgtagcattgagaaatttctatgggctttaatttaaatcttaaaaactaataaacttcagcaacatatttcttcactttaatgtgtgagggttttgtgctcattacctcttttaattgtccaacccaatttggtgatgatccattcaacaaatttttcttgaacatctgttttatgtgtcaggtactgtgatggttgctgagtatatcatggtaagcaaaaccacacattgtccttactccttgtgctacatgatttaactgctggatggattaaaccaggaactataaagattaaactgtaatccttaccacaattttgagtttacagtttttcaaatatcatttcaagccattagcaaaggctgtatgtattttttacatatgcctcctcgttttgtgaattttgaaaggatgtggtttcggcctttgacatcagaggagaagctcagctatgttggctgaacgttgatagaaagataacgttgaaggcaagttgcccttgagcagctctctgaagatcaactgcctccacattgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatggggtatgtgagcagtttcatttgtcttttttcgcatagcattttatgtttggactgggctaatgcaaaaatatatacatagcataaaatagagcacaggaaacacaaacatgcttattgtaacaacataaaaagtacagtaaaagtaatcagaggagaatgcagagagcagtcaagaggtgaaatggtggtgctaggtgatttcagttctaaaaactgtaaatttaacattcatcagctttttccccctgcaaggttatgtttggtttttaaattatgaataacattttaggtagcaagtattatgattcgataaaacttgaactttctatgaaacatactaaatttaatgaaacatactaaatttaatgaaacatagattaatacaacactagcattcaatgggatgatctaccccagctttcttattttttagtggaagaaactggtgtttagaatggttaagttttgggttcagtgttaacgttttcatgaataactctgtttgtctcaatactcgtcgctagcctgatcttgaaataagatttcccaggcatttaattatctaaaagttgtaaggcacaatggcaaacctcttcatctcttgatagacttcttaggacaccagggttattaagaacaaagtttctgcagtgcagaccagcggttcttacccagaaggagtatggctgctttgctaggtcagtctatctctttatctaaaaatagtcttgtgcttcttaacatcactaataacaaaagcaacaggaataatcctaataatgtagtttggtagaaaaagcattggacaaagggtcaggagaccaaactctacttctcagtaggtgatccagtctgggcaaatgtctacctcctatttcaggttctttcttcataaaatgaaaaaactggaaataacaaccttcaagatccctttcttcttcaaaacttctttgctttatgcagtggctcttgtttagccctatgctgcaatttttcaaagcatgtttgatttcttactgtatggttatattatttttacatcattagtggggtaggacaaggattatcacttatattttactgaagggaaaataatattaggtgcctgatggtcacttagaaacaaaagtgctccagttctttgttggagtctgacttagtaggtggtggcatgagtttgggattctttggtgtgccagggtttaaagcacttcatgagatggagctccagaggaggtcaggctgggtatagagcctatggatgcctcactttttaaagttgcaggtgttgcatgtcttttgtgaattaaaaaaatacagaaaacaaaaaagttgcaggcgaaatagctctgcctctttagaagtgaaaagaattgcttgtcttattatcagactcttactgataacaatttaccagtcaatcagaaaacacatggaattacgtgcaagtcctctttgctaggtggccaggagcccagtttgtgaacttgggggatttatcatgtagagctaataaatcgcatggcattactcaatgcttttttgtgaatggaacatttaaagtttttgtttcatattgaaagaacagtcatgtacctttaaatatttttttcaaagtccattttgcagttttcaccagttcgtttttctgattcaacatagtatcatctcatttagttagtattaataattccttagcccaactgctatttgtgaactgattgtgaattcagctcaatattatttgtaagtaatcacaaaaccagatggccttaattcagaatattattggtcataatttgcatgtagacaaggttgtaaaatcaccctacttctttatctgagcattatggaaaatttcaagacaattacttcattctggggagccctaggctacagtttctaattcttccatgtgagatatagagaatacatgtccaaacatcaaatttcttgttttctaatgccttttttactcttataaataacattttaaaagtatttctttaattatttaattattatagaagtttattaattagaaatttatccaagttccctgaaaaaggtaatatatgtgaattattattgttcatgtcttaggtatactacatggtttcaggccaccaatttgcacacaaggctgcattaatattactcataagtaaataacattacacttatgggaagaacattttcatttttaaattaaaggcttcattttcaatctgtaaaatgggtgtgataatagtacccatttcataggaagatggcaaagactcagaggtataatgtctttaggctgaactttttgaaattatttggcagatcgaatatcagatattagaagtttcaaacaattcaacttaatatattaggtacttagcataggccctgtcatctggtaagcatctagtaaaaattaaccattatttgtatccctttcatgtctctacagaagctagcaggctgtcataacaattcattttcaaattatgggagatattcaaggattcttcaaagtcaagctaagatcagggtcctggattccttctattctgtggctaaatataagttttgtggggtagatatacatgcattatgagctgtttggccagttattgcccctcttagggtgtcgggtgtcagagcttctttttctcttttctcatgtgtaaaattatgattcttgcagttctcatattctatgaatttataacaccatatgaaaaataacccttctacatactcaagaacatattctgtaattctagaaatcaagtatgtttattctaacctaaaaaatcatgcctattgtcattataatactaattgattgaggttttactttaacatggttttagttctggtgttcgatgcctgtttttcctgttgagatgtgcaagtgttttcagaggggccaagaagcgccttcatcttgctggagcagtgggccagaaagaagcatagatttggcaggtggtagcttgcagacagacatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattcatagtgtttgccaattcctttggtgtaaatattcccatcatggcccattttaaactaccaatgtgatgtctgctggctcacagattcctgaaaacttaacaattagctacctcgggccagtacaagccgagtccagcacactgtcggcaagcctaagtacaaatgatccttggagaggtagccaccaactaaacagcatacttagttgcacgtgactgatatcggatccttttcagcggtaaagggaaaatggagagcctcaggcactttgagtaagcacaggatggaagaggcagcctaaatgggaataaagcatcatagattggtgtggctcacgtggccactttctagatgtgggatctcagaccagacacttgacctctttctgcctgtgtcctatttgtaaagtaaggaccccaacactacctacttcaagtgatgttgagtatttcatgagaaaagtatgttataagctttttaccaattgctacatggtaaggtgattattactcacaattttgcccaagcaccaccttggtcttctgaaagcccctctggagaactggaaaggttctcctattttgatgactctttgccccttagggatcaagtgtgctgtgctccttatgatgtgggaggcattatcatttacatggaacaagagaaacagtcaagatcaccattccagtaagcatctgggtgagggtctccactcctcatggccttttccctttagcctacagtcttatctagcaacagaaccatctcctgcttgcagcaagcatcctttctaaattaaagatggtaggtggggagatggtcccctttccttgcttttgaaagcattactgctagtgatcacaaacactgcttctggaatcagacagatctgggtcaaaaactagctcacatttgatctgtgtgattttgtataaattatataatgctgtgcaattctctaaaaagctatctttttttttttttttagacagagtcttgctgtgtcacccaggctggagcacagtggtgccaccttggttcactgcaacctctgcctcccaggttcaagtgattcctctgcctcagcctcttgagtagctggaactacgggtgcgcgccatcatgcttggctaatttttgtatttttttttagtagagacggggtttcaccatattggccagctggtctcgaactcctgacctcatggtctgcccacctcggcctcccaaagtgctgggattacagatgtgagccatcgcgcctggcctatgtttttaaaataattaagcaaggccagacacagagactcacgcctgcaatcccaacattttgggaggcctaggtgggcggatcacttgagcccaggaatttgaaaccagcctgggcaacatggtgagactccgtctccacaaaaaaaaaaaaaaagccagatgtggtgctgcatgcctgtagtcccagttacacaggagggtgaggtgggaggatcccttgagcccaggaggttgagactgcagtgagctgtgatcatgccactgtaatccagcctgggcaacaggctgattcctggtctcaaaaataaaataaaataattaaacattccttcatgatcttatttccttttaataagatggaggtcacctttattctcataagatagtaactaacatttactgagcacttactacatgtccaacactgtgcaaaaatgtgaattatttcacctaaccattataaccactctgtaagttaggaactgttattaccccaatttgtaggtcaagaaattgagacaaagagggtttaaacaacttgcctgatgtcccacgtctctagagtctacattactctctgataaatagtacttattaccatagttgttactcataggtaatcagggattccattgggttattacacagtatgcaatacattcttgctctgaagtccccagtgtaaaggacagtcctgaaaattggtaccccctgccaaatgggtcttctgcaatgaaatattttaggacctctacgttttccacaaatgccccaggacaaatccttgtctttattcacttcaagaagccccgctatgtgtcttaaaaaaaaaaaaaaagagagagagagaggcgggcacgatggcccatgcctgtaattccagcactttgggaggctggggcaggtggatcacctgagggcaggagttcacgagcagcctggctaatatggtaaaaccccatttctactaaaaacacaaaaagttagccaggcatggtggcagatgcctgtaatcccagctactcgggaggctgaagcaggagaattgcttgaacccaggaggcagaggttgcagagagccaagattgtgcgattgcactccagcctgggcaacaagagtgaaactccgtctcaaaaaaagagagagagagagagagagagagagagccttggcaagctttgcctcctaaagttctcctagaatctccccagattcccacaggatatctctcacctgggactgtcagcatatctatcacctgggactgctaccacctctcatgttgtccctgcacccgcttcacccctgcctgccacttcatcctccacatggcaaccagcaccagcttttcacatgtgactgtagtcaagtcctgatgaccttcatcagacgttgatgtgtccctacagcggctctccccattgccctaacgatggacaccagcagaatctaacacatggtctcgtctgtctcagctcatgtctcactttccctcatctctggaatccaaccacaccaggttttcttcaacgttaaagcctccgttttaagtgtcacttacttgggaaagccttccttgatgtccctagactaagtcatgtcctcctgtcctgttctaccacagcaccaggtgtcctttcttcacagcacatgctgaagttgtaactactcatttgttaatgtgatgatgtattaatgtaatttccccacctcaccctccattgaactatcagctttatgagagcaggcacccaagttgataaagatggccttgccagtgtctacaagagtgtctggcacacactattcactcatgcatcatttgtggagggaataaaaggagaaagggagaaaagaaaggagggagtaaggacataaggtatagattcagctggagaggttagagacacaaacgaagctcaaatagagaaggttcaatacccaaataatagagaccaaggcaagtgacataggacttcaaaagggagattactgggtgtagaaacaagtaacaaagactccctggaggtagtagtgtgtggcctatcgttgaacaaggaagaggaagattcagatattcaggtggttggaattttaagtgctgggtcagaaaggcacatgtaggaactagcaggagggccgggtcccagccctcaactctttttaggagaattaagcaactcttttctcctttttcctctgcctgtcttacccctccttccttgccttttacagctaaagcctccgtagataatattctttttttttttcttgacccagaaccttgctctgttgcccaggctggggtacagtggtgggatcacagctcactgtagcctcagcttcccaggctcaagtgatccttctgcctcaacctcctgagtttctgggactagaggcatgcaccatcatccttggctatttaaaaaaaaaatttatagagacagggtctcactatattgcccaggctgttctcaaattcctgggctcaagcaatcctcctgcctcagcctccaaaagtgctgggattacaggcatgagccaccatgcctcgccatgcagataatattcttaaaactacccaggcatttttacttgtgacattgagcagtcatgggctctcttctcttcattcccatgtcattcagttgccttccagctgggcttctgctggcatttgaagttttttacagtctgttatccacacaacacctagaatgaaccttaaaattttaaatcagatactactttctaccttaaaaccctccatggctatttagggtatttaaataaattctcaactatgcccttcaagacccttcatcctgtggtcccagcctgccttctttatttcacttcacaccacactccctttatgtgcttctgtcacatctgccttcttcctgaaccataagcactccaagctcaaggtctcagcagggcctttgtacagggccaggactagggtgagacaagtgagacacacacataaaatggcactcattctcaggatgcaggatctttgcattagctgtttccactgtctcaaacaccccagatttttgcaggagggtttgtttgtttgcttgtttgtctgaaacatggtcttgctctgttacccaggctagaatgcagtggcggaatcttgggtcactgcaacctctgcctttcagactcaagcgatcctctcgactagctgggactacagaagtgcatcaccacgcctggctaattctgttgttgatttatttcccatctcttcaaagcacatagataccttagtatctgcatttatttgttaggtttatggatctgcttccctgtttaatttctgtctgtccatctaatggaagggcagttccatgagagcagagatcttgactgtcttcttcatcacagtatcaccatcatctaaaacagttctgggcactggttagttgtagtaggtgatcagtaaatatccggggaatgaatgaaggtcacataactcatgttgcattcagaaaagcatctgaaagctaaaaatgtgggccttgtctagccacacagagacaagaaagggcccaagcaaagtactttgcaattgagacatgcacagtttgcatctgttttaatggagtgtcatcatgaattgatctttgcctgtgtaatgtgaggttaatgttttatggagataaccgttgtattgatattttcttttctcacaataaaattagatttgattcctactgttcagggactggtacacccattcatcagtttctgcagtagaaatagcccacagagaaatactataaacacgagagtttagattctgactcagtctgaaagaaagcagaagagctcagtttcaggctgggcacagtggcttatgcctgtaatcctcgcactttgggaggccaaggcgggcggattacctgaactcaggagtttgagacaagcctagccaacatggcgaaaccctatctctactaaaaatacaaaaaattagccaggcgtggtggcatatgcctgtaatctcagctacttgaaaggctgaagcaggagaattgcttgaacccaggaggcagaggttgcagtaggctgagatcgcaccactgcactccagcctgggcgacacagcaaggtgctgtcacaaaacagaaaaaaaggaaaagaagaagagctcagtttcttgaactacaagctccatgtaaaacaagacatgtaaatatcaaacgtggaaatcgtgtctacaaaaaactattttaaagctcttcgcaaatgttcatggaccaaatagtaaatcctcattccaccctcattttcttaacgaactaataatacattcctcccattcatcagtgaattatgaggcctactggaaaaagtagaccttccaggacataattttcatccagaggtcagtttgggtttggcttcatgacactcagaggcctcactaaaagtgatcctaaggagaaaacaggtctgtaatgccttcccatgcatataaaagtccccttttggatcaacagtcttctcagttccttgaaattcagtaaaagttttctgtattttaataaaataagagctagatacaggttcttatgtcttatgttgccatataattcctattaacctaaagttatttgtaagtaggcttctcattatatttttccttttctgatatttaaaaagtcacagaaattataactgtttgttataaaaattcaactatagggatttttccccccaaacttcatatattttgccatatctttattatgattattattggtttgtttgtttttattgactctgtatcaaggaaacgtttctgtgttggtacatttcaatttattcatttgttccgcaaacattttgtaaatagctgctctgtgccaggcaccacgctagatgtgaggaacgcagtggtaagtaatggaggcaggtgtcttaggttggtgcacaagtaactgaggtttttaattgaggtcaattacttgtgcaccaccctaatagcttgcattctaggggatgggacagacagcaagcaagtgtataactgcatagggcagatagagaatgtggtaggttctatggcaagaccaggcagccactctggctgaactgggaggtggggtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacatgcagagttcaagagaggggcacaagacgaggggcagaagccaaactctgcaggcccttgtggatcatggcaaggagtttggatttgattccaactcccatgaaaagtttccaaggttgaagcagtgggtgtgagtccctccatctagaagtgaactgacagctatggggtcagcagattatacaatggccaagaatagaagccaggaagctgggtacagtctcctgcagtggtctcctgggccattgtgtagtgtcccatcctacgagttgttcttcagttgtcttatgtttttttatttatttatttatttattttatttttttatttttgagacggagtctcactctgtcacccaggctggagtgcagtggcacagtctcggctcactgcaacctccgcagtggtcttatgttttaacttttttgtggcatccttcttcctgggggtactttgtccagaatcatctcactccatgttttgatgggaaagtgcctggtgtataacctgcgtcaggatcaacactgagctcagatagacagtagcagcaaagactgaaaccaaattagaattgagttaaatcagctttgattaatctcaagacagagcaaggaatattctgatcctcatattgtcaaaaaaaattaatgaaccaagtacattcagaatgttttctataatttggtctgaagacatcaatttactatctgtgtcagcactggtcttttccctcatgcagatgtatcttttgcagagttataatcataatgcatgacaattttatattctacttttctatctattctttcatataaatgtatttccatatatctacaatgcctccaaagtaatcatttttcatatatatgattttttaatggttgagtcagttcattgcaagaacatgcttatctattttatatacgtggaggaataggtgaacttatctgttagctatggttcaacattcaggttgtttccaggtataatgaaaacaccaaaaaaaagcagtatacataatatagggctgtctcatttttaaaatcagcttcttaggatagagtgccccaaataggataattgtgtcacaggataagaacattttctggtcttgatcatttattgctacatcatcttccaaagagattgaagaagcagtgtgtgggccaccaaaagcggcaccatgtttgttttcagaaccattagagaagattatgtttctaaaaaggaactaatagaaacaaaagaatctcactgttgtgattttcaagtactccattttgaatgttttagtgagagagaggggaaaatacgtgatcttttatacataggtgagatggtttggtttaaagtcagtgtcacatgtatgtagatgaacccaccacctgcatagttggatttaaggggtgccaaaaggtctcctactctgcaaaacctgaatgcccgaactgactgtcacagagtaggggtggtctgaaaggttcccatgaatgagctctttgggttaggtcatgaaacaccttatcaaggagcaaatgaaatacaagaaggtgtcacaggagccacttttgactgttccgtagaagttagttttaattttagacagggcctatgacactgaaattctcaggctgtaattccagaaaagcggatgaggtgagcaaggaacaacagggcagcctaatagaaaagagatttggacccgggtcaccgggctaattctttactctctctgggatttagctttcttgtccataaaatcaaaggattcagctgatcaatgctttttcaaaatttaaaaaacattttaatataaaattatacaagccatcaccatccccacatataaaacagagagaagtggaagttctctgcttgaagcagggcagggaaactgcccagaaccctatgccccttggcctgtcccttactttcagggatcaacaagttatcttccaactctgtgacccttccccctggggtgtaaattgaatagtagaaatgaaaagacaaagccagtttagaaagtcaccttgaaacctcattgtcctcatctctaacattataaagttggactgaatgatttctaaagactcttccagttcaaaaacatggaaacttggctcacatttgtaataccaacactttgagaggttggcattacaggatctcttgacggcacgagtttgagaccagcctgggtaacatagtgagatcccatctccacaaaaacaaaaaataaaaaaattagctgggcatggttgtgcacacctatagtccagctatttgggaagctgagggaagaggattgcttaagcccaggagtttaaggttgcagtgagctatgattgcaccactgcactccagcctgggctacagagcgagaccctatctctctttgtttttaagtggaaattgtgtatctctgccaattatatcaggaattcacaaaaagtgatggagattagccaaacatggaaatctttccaggaagtaatacctttagggtgattaataactgtgtggctcatgagaaagcatgttgtcaaaatacaagcatgaccccaagaacgcaccctaaaaatgaagtcagacatttcatgtgtaaccaatacaaaatctgaaataataacagccaatatttaatgagttctcgctgtgtttcatagcatcaaggttaagtgttttatatgtcttatatcataaatattcacaataaccacattcattatgttatcctattgttatccccatgtcatttatgagaaggctgaggtttatagaaactaagtatctctatctaggttacacatataggacgaatattaaaagttggattaaatgttcttcaatggacattttcagatctaagcttgtttgggtctgataagtcttttaatagaagctgaaaaggcagagttggggcaaggatttgttggtgagtttctaacataatccaatagaggtgttgagtcgggaccagcaggcttgctccagattgcccagcagacttacccgaaagacagcagaaacatcatcaacagcaacaattttttttaaaaaaccacaatagttagcatcactacaagaagaggactgaacactttgttaagtattttctcatttcctccttacaattctttgaacaagataaaagtaaaattttgttttggtgaggaagcaatggagctacgaggacggtaagtaatttacccaaggaagcaaagtgaaaagtgtaaaggcaacagcatgccttaggacataaggattccctatactttgctcctacatacattagtgtgacctgtcctgatatctctgtggttacccaagtagaattacattttgcaagaaggtaattctacttaccttcacgactgcgagcatctcagccagtttctcgctgcgagtttgtgaattcgccagtctttggtgactttgcagagtgtgtttccattcacctgaactctatgggctgacaaacatgagttcctggacttgtaaacctgaggatctgttcctggggtggcctctgacaaggaaagatgctgtatccgcctcagcactatttaattttccagattaacaactaatagcagcattagccacttattgagccttttctgggaataacattctgggaaagctatatccaaagtggtaatacaaggagtaccaggaggaaagtattagcctagcgaagtgacccagaaagggagtttgagggagctaataccaaacctcacccttttccacaatccatgctgaggccatttccatgacaatgatccaatttggtgtttcccaaagtggggtactatcaggagcacacaagatggcacatggacaaatctggttttaacatgtctttaatagttatgtatctactataatttatgttagaaataagtgttttaaaatttatggtggtaatttaaagtttcctcctagaataaatttgtttatgtggaaaaaataagtcaattgaaagaatactattgagcagacaatactatttgagggaactagggtatggtagaaattgccaagctaagttggaaactgaagcctgggagcactgaatccttgggataacaacatgaatcataattcattataatttgcttttaagtagttccaagagtgaaatgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagtgagcaaatgagcctcctgccacaaactgaacccacatttctctcaatccaagaaaaggctgttctaattccaaacaagctcattgtaaacctcaataacatgaagttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccatgtggcacatttcaataattttaaaaaaacagttgcaaaatgttatgcagtaacaaatctcccatctttgtcccaagtcacattgctgtcctacatcacagcaaccacgatagttaatttcttataagttcttccaataatactttatacatatacttgtaatactaataaacattcttcttttcttcctttttaaatagtagtaacatactctgcacacacttcttaacttttcttttagttggttaacaatgtatcctggagattgatccacactgatacacaaagatattcttcattctgtttatggttgcataatacttcattgtatgcatgaaaaatttcttttaatgaaggttggtctgtttccagtttttgttattatgcacaatgagaaatgaacagccttgtagatgtgtcattttccataaatacttttataacagtggttctcaaccaaaggtgattttgcccaccaggggacatttgacaaaacctggggaaatttttggttgttataagtggggaggagggtgccaccaacatctagtgggtagaagctgagggtgctgctaaatatcctacaattcacaggacagactcacaacaaaaaattattcagcccaaaatgtcaataatgctgaggctgagaagctccagtctgtagaaaacatttctagaagtggaattgctgagtcaaaggatatttgcatctgttattttgttgactatgagcaaattactctctacagaagttgtaccagtgaacattccccagggccacatgtgagaagcatgttttctcaaaacctcacaaacaccattatcttatgttttgatctttgctaatctgataggggtttaaaaaatagtacttaagtataatttatttgcatttctgttgttatagtgacattaagcatctttccatatgcttaaatatattccttttgttcattttcctataagtttattagtattttatttaatttgtaggagctctttaactaccagctaaacactttgggcagactagttttaacctacattttcattgtcaagagatttttatccacctgccaatttttctggaaatcttattccaaatcatttccattaaaagttttgtcatagggttcacaataatcactttctgctgcatacttggttttacttgctgttccttcaatcaattaacagatattaattgaacatcgcctcagtgcaagcagttatttcctgaaatgcaatgaagtttttatgcacttatgtattttggctactggtccttcagtgcttaaaaagaagacacaaaaaatacgttctttcaaactcatttaacatttcatatttcttattctgggaggaaggtctttgaaggaacattcacagctcagagatactgacagaaacaatacagaggatgccttgagaatctactttatgcttggaaaatatcacttagttcttgctcctaatttccacataagtccttttctctctgctcccttttgtaagaaaatctaaacacacatgttttcaacatgctaggatcatgttaccttgatctagtaagaatggggcttggacattattcctgagttatcatttcacttataagataaatatacccatataaaagcacactgaattactttattagaatctatgaagaaaaaggctatccctcaagaagaacatgagagagactgtcatgtacttgaacccccatggatacagatgagcaggtggcaggtgctctctagctgctgctcactgctaatggggttatgcggtttcaagggcgtgcatcatttcgcacacccagcatttgatgcataccccttattcctctcccataatcatctaagttgacactgtgatgtttttgaaacttctaactgtattaaaatattattttcatttctctgcttttcctcctgcttcacactctctgtaaaaacttcaaatatcataagaatatataactttgtgaaattctgccacagtggaacctacaacaaagaaccagtgttagcagcttggaatgtttttcttcttgtattatttctttggatattgcatatactaatacataatctcttcttccaaaaatgggatgatgctccatctgttgctttaaatctgctctttaacacttggtatatacttttgtccctctgtatagatgaactttattatctgttaatggttacagagtagtcattatgtatgatgacgaatttaaccatacacagatggatgtttaaccataactaatttaaccatttgtctattgatggatatttaagtttttccagtttattttagtgtaataaataatgcttctgtgaaaatcctttttattacatctttatatattttgaacaaatgtttccatagaataaatcagatcagggaaatgtatttattcattttagttaactgtttttaatattataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccaacccccaggaccacccacacaggtatctgctcttcatagtttcttatgagaaaacacattttaatagatgatcctaaattgccctctgaaaactgtatgtaagaataattctttttcttttcttttctttccttctttgttcctttccttctttccttttgaaaagtctcacttttttcatttgggtggccagggtgttactattttcaaatggcaggttttaaaggaagtgaaattgttttcctcatagcacatccagccacatggtaacccacagtgcgaaatgctgaggtggagaaagccagccaacggtgggccagtgatgagtaagaggtcttatggaaaagaagagagaaacgaaggcaggtgtgggatggatcagtttcctggctttaaggtggtccagggagccttgaaattaatggtcttagctccagactttcccagagctttagaatagagggaggttaggtctagctgaagatgggctggggagggaggaactaggaacagctcattgcaaattgctctggtgttttacaagatgctaatttttccatagagacagtaatgagcatatcttttttgttttgttttatcttgttttgtttgagacagtgtctcactctatcacccagagtgcagggacatgataatgactcactgcaacctcaaccccccaggctcaactgatcctcctgcctcagcctcctgagtggctggtactacgggcatgtgccaccacacctggctaacttttaaaatttttttgtagagacagggcctcactatgttacccagactgttgttgaactcctggcctcaggcgaccctccttctttggcctcccaaagtgttgggattataggcatgagccattgctactagcatttgctagtaggtttatgtaattttaaaaaattctcttaattaacttaatgattcagagactattcttatgtcgcttttgaaaaatgaggcaactgagaggttgagacacttgcctcaggttgcacagctgataaggaatgaggttaggatgcaaacctgagtctgccctacttgaaagctccagttctcccctactctgccttaccagaggagaaagctgaaaactgctatttttttagaaacgtggagatgtccttttcccatgggtagcagacacataacttctcatcgacacatttgctgggctagtccagcagcaaaagagccaatgttgttggagcaaagaggagtggctattctgaggaaccagggagtgtgttccacctttgcaatccagcataagcattgctcagtcaaatgggacagaaacaaagctctgcgagtccatggcttggtgaaatgggtcacacaattgattttccagcactgagttcagggaatgatagtcttctgtggaaagtcccagcaagtgctaagccaggaagcatagtagttaggttatcaggctctggagtcatagagtggagcttgtacgctgctcttctacgtattaagagggttggcctctgtgaacttcaattttctcatctataaaatggggagataatatgttgtaggatcgtgatgaaacaggatggaatgttgaatgcctggaatatagaaaatgttcaaaaatagtatcattttcatgttttttcctgcttctctctttgaaacttataatccaagctctatttcataaaaatattaacataaaaagccgccctgccccctcatctatctatcaagcaatgcacatttatgggaaacctgatgctgacccatttgtaaacaacctgtttctgggttggggttttgtacatagcagagcagctccttctctgtgagatctattgaaagtcagcccttaatacaagggtttgttaaaaaagagaaaaagaaaaagaaggaaagaaagagagaaaggaaagaagaaaggaaaggaaaggggaaaagagagagagaaatagtaacataaaaagaaaaaagatataaaagctgattgcacaagcttacccttgtgaagatttgtaagcatcagcatcttgaattgtgtctgacacgtgtcagatgcttgggatgaaacatcagactatgaggatggcatatctttgaacgtggccaagaaaagagacaagggtaagcaaggtcctgtgactttcgccccaagtaatgcagacagaataacaagtaagaatgagagcaggttgtacttggcctctccctttctctggtggcttttgtgtggtttccttggaaagttttaccctggcatttttcagaaatagcacagttgtttgggatgattataggcaatcaccctttcccagagactgaactgtgtcgggctcattgaccagccaccccccggggaccaactagggaggacatagctggtcctgctgtttaccaagtattggatcttgtgagatgccagaagaaccaacctcagggtctttggaaagactgaccaaccagtcaggatggattgtggtggtggatcccaagcactcatttgggaatgagagtgacgttgacggtggaacatgaaatccatcccaacagaagagcaagcctgagagcaagctcatctgacagcctgttaaggcacaggcacaaaggaggccatgtgagttggtaggagaactcctccttggaaatcttggagtctcgctgtccactaaggtaaccactagcacctgaagtctactggcataggggtctactgagcacctgaagtatggcaagtgcaaattgagatatgcacaaaatatacaatttcaaagacttaagtacaaaaaaaactcattaatttttgtgtggataacaatttttttaatatactacaaccaagtaagattttattttcacaaatgcaatgttggctcactatcctaaagtcaattaagataatatacaatattacttgaataaatgtcaaaaaagaacatttcaataaacaaagaaaaatatttgacaaatccaacactctttgtgataaaacccccagtacactaatagaaaaaaaattttgagtcttgcaaaaagtcatctatgaaaacctacaactaacattatacttaatggtgaaagactgagtgctttatctgtaagtctgggaacaagacataaatttccacttttttttttttttttttttatggagtcttgctctgtcacccaggctggagtacagtggcatgatcttggctcactgcaacctccacctcctgggttcaagggattctcctgcctcagcctcccgagcagctgggattacagatgcgtaccaccatgcctggctaatttttgtattttcttagagacaaaattttaccatgttggctaggctggtctcaaactcctgacctcaagtaatccacctgcctcaacctcccaaagtgctgggattacaggcatgagccactgtgcctggccaatttccacttttaacactctattcgacactgttctgcaagtactagccagataaattacactataaagtgaaatgaaattctccagattgagaaaaaaaagtagaactctttttcattgcacaccacataattttccacaaaaaaaaaaaaaaaaaaattgtaaggaacttcctaaaaacccactaggactattaaacaaattcatccatgtcaaaagatacaagatcaacatacaaattaatttttttaacttttattttaggttcagaggtacatgtgcaggttttcatataggtaaattgcatgttgcaggggtttggtgtacagattatttcatcacccaggtaataagcatagtacccagtaggtagattttcaattcccaccctccaccctcgagtaggtgccggtatctgtggtgcccttctttatacccatatgtgctcactttttagcccccacttacgagaacatgcagcatttggtttttagttcctgtgttagttcacttgggctaatggcctccaactctacccatgtcgctgcaaaggacacaatctcatacttttctatggctgcataattctccatggtgtatgtttaccacattttcttttcttttcttttctttttgagacagagtcttactctgtcacccaggctggaatgcagtggcacgatctcagctcactgaaacctctgcctcccgagttcaagcaattcttgtgcctcagccacccaagtgcctgagattacaggtgtgcaccatcatgcccagctaatttttatatttttagtagagatggggtttcaccatgttgcccaggctagtctcgaactcctggcctcaagtgatctgctgccttggactcccaaaatgctgggattacagatgtgagccaccacgcctggcctcacattttctttattcattcttttgttaatgggcatttaggttaattctatatctttgctattgtgattagtgctgtgatgaacatatgtgtatatgcgtctttatggtagaatagtgtatattcctctgggtatatacccaagaatgggattgctgggtcaaatggtaattctgttttaagttctgtcagaaatcacctaacaatttgaaatgataatattttagatattgggttaaacaaaatttattgttaaaattattacttgttatgttttgcatttttgaatgtgcctactggaaaaacttttaagttacatatatggctcatgttacatttctattggacactatcactttagaacttcacatagaatttttatccctgttcacaattccagttaatatttgcctccactgtctgccctcatcacaatgctgctaggctgttaacaagccagacttacccagtatttttctaccccaggattttgccctggctgcttgctctacctgggatgctcactcccctagaccttctcccagatggctcctgttcgactttttggtctcttcttagatgccctttctctctccagagaggtctgccttggccacagtttggtcacatcaactgttctattctctttccagcacttctttgttttgtctgccttcccaagtatactacgggctctgtgagagtctatcatgttcatcagttcatttcctgaactcagaatagcacctcactcatagctggccctccataaatatttcctgaatggctaaatgtactagccttaaatctgtttaagattgtttaaactgtgttccaacctgacaccctttgttttgagctaattaagctccactgagggccagccactgctgggcactgggtatatgggaagatgccctggtctctgaccttagggagctcaggacctagtaggttccaaagacaaaaatgtcagcaaatggagttgtcatatcacatgccatgagcctgttgtttttatttcactatgcatgccctaaagaaagaacccaacagaggtcaaaacacagcaacctcaagctcgtgcaccctgtttaccagtagctgcagacagttcttgaaaaggcagctccgctgtgctctactatttgtgaaaaaacaggttaaccattccaaagaactgtgattatgggcaggaccagagcttgcatttctaacagtaaatgagaagatagtttgagcccaaagggcacgtttgcagaggcttttgcgggaagacaaacctcctaatttagcattagactacaaaagcaagttctagactgatatgtagagcaagacactcattttcctttatatataccctataaaagtgcagggaaaagacaaatatactccaaatgattaactttggctacctcagggttatggggaagggtgggataataacacactataaatattttcttcacatgcctctgtagtattttgttttgtttgtttgcttgtttgaaacggtgtcctgctctgtcacccaggctggggtcgacggcaccatcactatcacagctcactgcagcctgaaacatatgggcccaagtgattctcccacttcaccctcccaagtagctgggactacaggtgcacaccatgaggcttggctaatttatgtaattttttgcattgtctcactatgttgcccaggctgctctcgaattcttgggctcaaatgacctcctacctcagcctctcaaagatctgggattggctgggcatgttggctcatgcctgtaatcccagcactttgggaggctgaggcgggcagattgcctgagctcaggagttccaagccaccctgggcaacatggtgaaaccccatctctactaaaatacaaaaaaaattggggaccagcgcagtgactcacgcctataatcccagcactttgggaggttgaggtgggtggaccacagggtcaggagatggagaccatcctggctatcacggtgaaaccccctctttactaaaaatacaaaaaattagctgggcgtggtggcacatgcctgtagtcccagctactcaggaggctgaggcaggagaatcgcttgaacccaggaggtggaggttgcggtgagccgagatcacaccactgcactccagcctgggcgacagagcaagactccatctcaaaaaaacaaaaaagagaaaaaaaaaagatctgggattacaggcattagccaccatactgagcctctacagtgttttcatttgtcacaaaaaacataaatagattttgtactttcaataatggataaagttgtttttacttaaaaaactaaaaaccagacaccacaaagctttcctgtatttgatagggtctgcttctcgcatcttgaattttttttatctcagttctgttcctcagctactaaatcaaagatcagcttccgggctgaggacccaaaaacaggaagtaaagactgaattcactttgggagaatttgatgatgtaatgggtccctggatatcaaccaagcacgctcatatatcacaaatctcttgcgatagttaaggcttccttaacttctttaattgggaaggtaccctttattgagggcatctgttataagccagttaatttgttgacatcatcctattttattccccaatcaactctcaaaaggtaggtattatccccacttatcagatgtaaaaaccagggttctgggaagtttaatgaattgcccaaagtcacagagctcttatagtaagaggcagagacctactttaaacatagctttcccaaacgtgtgctcatttcaccatcatttgctacctccttaaaaaaataaggtagaatggggtttgggccacaatcctgaacaccataatcccaaatattgaaatacaaaatgtaaaaatacccaaaaatataattctggaaaaaataattttaaaaacttttttaaaagacatttgtttacattttaaagtggatttatttgagaaacatatgaagacatgacgaaatgcttcataggccaccttgtgcaataaaataggcaataataatatacatatttttgcaaacataaacacccaagtatactaaggacagtcacatgggtataacagttatgagcagacaaactatattcctaaagaaatagctggtattcaaggggaacgccttcagctttcgcccattcagtatgatgttggctgtagtttgtcatagatggctcttattattttgacgtatgttcctttaatatctagtttattgatagtttttaacatgaagcaatgttgaattttattgaaagccttttctgcatctattgagataatcgtgatttctgcctttagttctatttacgtgatgaattacatttattgatttgcatatgttgaaccaaccttgcatccctaaagcctacttgatcatgtaaaaaaggattagccttttttttttttttttttttgagtcagtattgctctgtcacctatgctggagtgcagtgtcatgatcttggctcactgcaacttctgtccacctcagcctcccgagaagctgggactacaggtgtgcaccaccatatccagttaatttttgtaattttttgtagaaacagagtttcaccacgtttcccaggctggtctcgaacccctgggctcaagtgatccaccctcctcagcctcccaaagtgctaggattacaggcatgagccaccacgcctggctggattagcttttcgatgtgctgctggatttggtttgcaagtattttcttgagaatttttgcttcgatgttcatcaatattggcctgaagttttcttttttgttgtatctctgccaggttttggtatcaggatgatgctggcctcatagaataagttgtgggggagacgctcctcctcaatttcttggaatggtttcagtaggaattacattggctcttctttgtacatctggtagaattcggctgtgaatccatctggtcccaggctttttttgggtggtaggctatttattactgattcaatttgggagtttgttatggatttgttcagggaattaatttcctcctggttcagtcttgggagggtgtatgttgtccaggaatggattcatttttctaggttttctaatatgtgtgcatagaggtgttcatagtagtctctgattatttgtatttctgtggggttagtggtaacatcctctttgtcatttctagttgtgtttaattggatcttccttcttttcttctttatgagtatagctagtggcctatctatcctattaattttttcaaaaaaccaacccttggattcattgatcttttgaataattttttgtgtctcaatctcctttggttcagctctgattttggttatttcttttcctgtatcttaattacagagattatgacacaaatgtatacatttgtcaaaactcactgaaatgtacattggtaaattttattatatgtaaattatactttaataaagctgatttttaaaacaaaaaaactaatatgcaatatatttcacctttaaatttttttaaaaaagaaacagcttatataaccatggtcatctgaaatgctatgatagacaacctaagtcttttaatgagattaatcaaaaacagcagaagaaaattctgtcccaactctcagagacagactaatttgccttcagtatttgttctcttagggtccctggctgattcaatggtgtccaccaacactgagggcagatctcccccacctcgcccattctgatacacatactagtctactctggaaacaccctcacagacacaccccaaaataatgctttatcacgtatctagatacgtctctttttttttttttttttttttttttttgagtcttgctctgtcgccctggagtgcaatggtgcggtctccactcactgcaagctccgcctcccggattcacgccattctcctgcctcagcctccagagtagctgggattataggcgcccgccaccacacctggctaatttttgtatttttagtagaggtggggtttcaccatgttgggcaggctgtctcgaactcctgatctcaggtgatcttcccgtgtcggcctcccaaagggctaggattacaggcgtgagccaccatgtccagccttagatactccttaatccagtcaatttgacacctaaaattaagtctacaagtccatcccttgtctatttggcacccatacatatcttaaaccacacgtaatttccaaatgaagacaataacaaagtaatagttctgcctaacaagatgcaactaacataatgaggctatcctgtgtacaacagaaaattcactaatcgtgatttttgagattttagatgttaaggacttagacttcagggatttttatcattcaggatttcagcattcaggactatgacattcagaatcgtgtcttttgggattgattggtagtgggtataatgacgtattttgcaactggttccatagctgaattccatagctgaattctcaatggcagctcaattctaggtacctgtgagaggcttcttccatccagaagcactttcctaactatctttccttggagcctgatagaccaccaatggaatttgttccattggctaaagcatcaaatcccctgagatccattctccaagcacaaggatccttagaaataggtaacatgtaacatcattataaatcacaaataccatcatgtgaattagttatcagggaaatacagctagcaagtttccaaggaaatgagacacaggcccagtagtatttgatggggaggttggggaggacatggagaagggatagttatagatcagagtcaggaatgtcctttgggagtgtcattgtgggactgcggataattaaaggacatggagaagccagaggcagaaaaaaaaaggtgccactaagggtatgcaccacaatccaggtcgggtccgagctcaattactatgctaatatggtcatggatagacacagagaagagaaaattgtcatatgtgtgtccatggatttctctacgcatctcagctacaagttctgccaatgctgccatttgtcacaagggcagtggggtacatgaccccgtgtctcactgagtggaaacctgtcaccaagaagaagactctaaaggcatgtgtccccaggagtctgctcagagtgtttatcccacacttagggccaggaggcagttttggatatttggtttggagggttggaataggtttaaaaagccaatggatcttatctagcagtagatttctggagcaatctggacaaaaatattgtcttctttcttacatgaatgggatgttcttctctccccacagaagaagcgcacgctgaaggggtccattgagctctcccgaatcaaatgtgttgagattgtgaaaagtgacatcagcatcccatgccactataaatacccgtttcaggtaagtccatcaggtgggtagttccccattccctggactgtggttaaaatcttcagtcacagccgggtgcagtggttcaagcctgtaatcctagcactttgggaggttgaggcaggcagatcacgaggtcaggagttcaagaccagcctggccaacatgaaaccccatctctactaaaaatacaaaaaattagctgggcgtactggcgggcgcctgttatcccagctactcgggaggctgagacaggagaattgtttgaacccaggaggcagagttttcagtgagccaagatcgtgccattcactccagcccaggcaacagagtgagactccgtcaaaaaaaaaaaaaaaaaatcctcagtcactgtgagagagggtggacacggatgactctctgcctctctgctccaaggttaggacttagacaaatcccattaggaaacgtatgtgttccttccatcagtgacatttatttgttaattctttcacttattgaacaaaaattaagcacaaaatcttgaaaaggtggttattccttatacccctttccctcatgtcttctcttcctcaaggaaagtcctaattagtgaaggaagaaataaagctgctatcaggggcccgaaacctaatgtgctttaagtgcagtttactcatgatttgaggcaacatattgcaattgctgggtatgaattgcttggagattctgaggcaaaaagattcagattttataatctgaggactatctggaatcgcactgtctagtacagtagccactagccacacatggatgttcacatttaaatgtattaaatgatattaaaaattcagcttcttagtcacattgggcacatttcacatgttcaatagcaggacatggctggcagctactgtactgaaacagcactggttatagaatgttcctatcactgcagaaatttttttttttttttttgagacagagtctcactctgtcacccaggctggagtgcagtggcgcaatcccggctcactgcaacctccacctccctggttcaagtgattctcctgcctcagcctactgaatagctgggactacgggcgtgtgccaccactcccggctaatttttgtatttttagtagagatggggtttcaccatgttggtcagactagtctcaaactcctgacctcgtgatcgacccgcctcggcctcccaaagttctactgaacagagctggtggagggtatctttaaagtccttgtatatgaatcttggcacttctggcttcaaaggcatggatatctccttgcacatcccagggtaccattcctgcttgccaacctgagggatgaacatatttttaacacggcatagaaaagaactttttttctactagaaaagtgaccctcatgagttggaattttgaggactgaaaataaaaggaatagcatgtatttttcagttgttcaaaatctcaatgataatgagtgcctaaaagagaggtgaaatataaagaagactgcagtttagttaacagtattgtaccaatgacaatctcttggtttttttttttttttaatttttttttattatactttaagttttagggtacatgtgcacattgtgcaggttagttacatatgtatacatgtgccgtgctggtgcgctgcacccactaactcgtcatctagcattgggtatatctcccaatgctatccctcccccctccccccaccccaccacagtccccagagtgtgatattccccttcctgtgtccatgtgatctcattgttcaattcccacctatgagtgagttttgaaagatgtgttgtggttacgtaagatgtcatcagtggagaaaagtaggtgaaaagtacacaggaactctgtactatttctggaacttcttgtgagtcttaaactatttcaaaataagaagttttcaaaactctcattgcacatttgtcatataatatctttctcttccatgtgccagaaatatttttttaatcactaaaaacttaagatgagaaataaatgtggtttctagtcaagaggagaactttctcctgctgtcttagtttagtgattgctctcttggggcatggaatctgagacgagcagctgaaactgcttaccctgtgtttttgtagcacccaaacacctggataaaaaggatactggccccctaattacccaaatgtttgcctatatgacgataaacacccgagaccccactctcggctcagtaggtctgctgtcagtcaactatctccatgcacgctgctcaccttgaactctgtgtgtgtgtctccaggtggtgcatgacaactacctcctatatgtgtttgctccagatcgtgagagccggcagcgctgggtgctggcccttaaagaaggtaattaaactcctttgccattgaatcactgacactcttgatcctatagtagggttgggttccacaatagaatagagtgtggtgtgagagcagctgatggctgatttctcttttggggttggtggaagttcccaagttttcatcctgggcccaggaagcaataactggtatcattcagggattgaccaaatccagcctgctgtctgttcttgtcaggctctgagcaatatttgtatataactcatttcaaatagtttaataagtacctacataagatgcttgattttgtctcatggtcagtaaaacctaaaatatttactgtctggccttttaagaacaaatttgccaactcctcgtatagtatgaagaagcagagcataggccctcatgtgagatgacctgggtttaaatcccagtctgtcacttgctatgtacacttgggcgagttccttaattgcctgtgcttcagtttcccatctgtttaaaaggaagaaaaggaagggataacagcacctgcctttggagctgatgtgagcaaagtcctagaaactaggttggcccatagacagcatgcaataaatatcagctagctttcaagcttttcagaccattggtaagggtatttcttaagccttaccttcctgatggcacagttagaggcagcagtgtttaagcacatgggatgtggagccaggcatgaaggtgaaaatcccagctctgccaatgattagcatgtgaccctgggtaagttccttgaccttcgtgtgtctctataaattttgactaaaaacagtcatggagctgttgtgagaattgaatgattgaggacttagaaaaatacccatcccaaagaaagccctggatcaatgttaccattattgttctttagcctgaagcactggatgtgtcagaagatctgggttcaaatactaatctgcctctacgaagctgtgaggaccaaggataagcaaactatttgttatctctggagctgcaattcctctatctgaaaaaaatgagaatagaaatacaagttgtatcttatcccgaggttgttgtgagccttaaatcggttatgagcagacaagtgctgggtgaatggggaagtgctctccgttcttacagtcttgggacatacagcaaacacaaaagtaagaagtaatcaaaatgggctgggcgcagtggctgacacttgtaatcccagcactttgggcagccaaggtgggaggatcacttgagctcaggagttcaaggctacagtgagccatgctcatgccactgcacttcagcctgagcaacatagtgagatctcatctctactaaaaataaaaacattaggcaggcatggtggcacatgcctgtgctcccagctacccgggaggctgaggtgggagaatcacctgagcctgggaggtcaaggctgcagtgagccaagtgagccgagcctgggtcacagagcaagaccctgttcttaccccaccaaaaaaaaaagaagaaaaaaaaggaatcaaaagggccccagctatggtcattggccatttgccctctgtgaagggattttatacacagggtgttaaaactggaaggaatattagagattagatatctagttctgtggttggttcatttatttatttattcattgagacagtgtattagtccattttcacactgctataaagatatgcccgagagtgggtaatgtataatgaaaagaggtttaattgactcacagttccgtatggctgggaggcctcaggaaacttacaatcatggtggaaggtgaaggggaggcaatcaccttattcacaaggtggcaggagagagaatgacagaaggaggaacttgccaaatacttataaaaccatcaggtctcatgagaactcacgtattatcacaagaacagcatgggggaaaatatccccgtgatccaattaccaccacctggtctctccctcaacacgcaggaatcatggagattacaattcaagatgagatttgggtggggacacagagccaaacgatatcagacagggtctcactctgttacccaggctggagtgcagtagcacaagcatggctcactgcagcctcgacctattgggctcaagtgatcctcccacttcagcctcctgagtagctgggactacaggtgcatgacaccatgcccagctaacttttttctttttttttggtagaaaaggggtctcgctatgttgcctaggctaatctagaactcctggactcaagtgatcctcttgcctcggcctacgaaagtactgggattacaagcatgagccactacacccaactctgttctgtgccttatgtatgtatttgtttcagtagcagaccccccttttttttccaaccaaaatcttacttcaaagccacaaacctagaagggagaaaaccaaagtggctgtggttaaaggtaggagaggtggggggtggtaattccaccttctcaaccttctcattacccttaaggcacctttgtagagcccagtgtttaacaatctcattgcatagtgggggaaactgaggctcagataagggtttgcccaacttaagaacacataactaatgcaaggcagagccagacgcaagcctagatgtgctgatgcctaaatgtaacatgaactaccccagtaaatagcacagtgcatttatgcgctcagatcaacccatgcttctgagtggtctgggcaatactcattcaggctcactcagccaggtctaatctcgaggtgttataaaattggtagcccttgatagactgacctggaaataactcttctgttggtgccaacctgtttcagaaacgaggaataataacagtttggtgcctaaatatcatcctaatttctggatggatgggaagtggaggtgctgttctcagctggagaagcttgcaacaggctgtgcccaatatgatccaaccaagaatggtaagagactgggaattccctctagtttttgtgaaatgaccataaaaaagtaaaagcttttggcctttaatcattgagggtgtcaggaacagaatgcaaaattctacattttcagaattttccaagaggaatcatctgtctttcctaccagcctgttggtgcttccatctcaaagctgatgtctacagctcctaaccacttgaagtgtgctctttggaccagcagcatcaacatctcctaggagttagttagaaatgcaaatgatctggccccactcatgacctactagatcagaattttcattttaacaagatcccaggagacttatgtgcacagtacagtttgaggagccctgctataacctgcatttgaatggcatggtctatttaaatcttaattaaagaggcagccttaagagatataaaatatttatgtcttacagtgacatcatgtcacacataaatttaattacacaaattcaactctatacccttaaaggtgagaggaattttttttcttttacattttactctgtgatttctccttgcctcctcttcaaacttgcccttgacctccacagtctcagagaggagaaggccgcagtctaaatgcaaagtgaaaacaaaaaaagctgtttttttgcctttgacagtaaaggctcaggtccaggggattgggctgcaactggattttattgatgactttggaaccttaacctccagtcgagtacaactccactcgaatgcatttcacatttattatgctcttgttcctctcaaccatctggggtacatggcgtgatgttaagggaatgggctgccttgagcaattcagtatgctccgggtcacaccgctggaagtgctctgcaaatccattgtcgaataggaataatggcccatgtggattgttttccttccattttcctctcttctcaacctcttttgccatagtttccctttctcatttattcttttgtgcgctaaaacttaatactgaaaattggcaacccaaggcggatgtaacacatggctaggttttctgtggcttcctgattcataggccctctcattgccactttaaaaaccaccacttttcaccctgcaccttggggaaaaaagctcttagacataatcgatccctgggcccagaagaacaatacttaacaagttttagaaattggtaactattcaagtgatcctacacattagtcctgtttaccatattcatgcgggccaatatttaataaaaatgaaatggaaagttttctctggataggatccaccataataacagaacggcatgggcttacctctgtgagtgaaagccctttccaaagtcagtgatctggtctccaaatttctgccaatgccttgctgtgggccctcagatgagtcacgtggccatcaagggccccaatgtcctcatctcaaaaatggcagggagttctgaggggcttaggatgaaataatacctaagcccttttccaattctgaaattctttgacttggtatttccattttgtaattttcaccatgcatgctgcagctattcctcttcggggcgcaagtatttccctcctccaagtgatacacatgtgactgaggtgctagggacatctgaatgactcaccagaatgccagtgcgggaggactggtcatgccgagctgttccccatgtgaaaccagggcctgagcactcttggggtcctgctgtggttgtcatgcagtcactgtgctaatggttttgcttttgcattgcaacccattgccatatcctcctctgagcatctcctcactctaccctcttctgatttggttaaataacttcatggatctgagttttgcacagttgagagcagagttttcaagaagcacactgcactgtgaacgcagcttatggtcatcaccctggatgaaggctcacaggattcctggtaccgagcacattggcagtgcgggtctatgagcactgggctttggataatccctctgagcctctaagagcattttctcacctgcaatatggggataatgataataggtagctatgtgtaaggctgggagattcagtggtgttgtggaaagcagtacagctgccaacatttacagagttcttgataaatggtaattgtgtctacttgtcttccttattggtggatgaaagaatctgaggctgagatatagcctcagaacttgtatgggtctgggaagcagcagaagtggatgagtaaaaacagacccagccacacccaacccatagtaacacccatttctgcaaccagaactggccctgatctccccactgtggggagggaaaggaaggaagggaaaagcaaggccagaggacgaagaaagagagaccagtcatagaatgtccagggctggaagtggccaaggctcacagctagtattggtgaagccagagttagaacaccagtctcccagctccaagttgagttctaaataggaaccatacttcctattacaggggttttccttcttctgtggtcattgtatacccaggtcactatcccagcctactctttcttggcaagtctgcacgggactgggctccagtgtcaatgtgtgactctcctctaccacatccctgatgtgagctgtccaacttcaagtcaacctcatacagaaatgaggaactcatcgtctacctatgcagcccattctcttcccatctctcgttattaaggacgtctttgtattagcctgaagtctgtgcagtgcctcccgtaccacagagagccccagacacagccacacacctttgattcattgagtccaggaatggcctttgcagagctacaaaggagaaatagtgagagatgcatatgaagagatgagaggaaggagagagagaaagagaaagagagaggagaagagaagagaaaggaggaaagagggaagagagaggagagctaaacagacggagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttagcaggtggcagagacattcccggaagtctctatgcctacagggaagggtgcaagtctaaccccactggcaggcttttcctgggaatacagaaagagagggcccccgaatatggacttctggaagcttctggtgtgtactagaaaagggaatcagaaaccagcaggcccaaggagataaaagacagcttctgacaaggccaagtcaggtttcactgtgtcttattgctccttctggccccctttcttctgttgttttccctgggccctttttctcagaaaaaccccctggctgctcacttccggttgggtccattagttttcatgctcattttttcttttcctgtttttctcttttcagcttcaaagaagcctcttcctcctactcctgaagacaacagggtgagtgagagcgctagctccgggtgcaggtgggcccacaggctacctgattggcatgttcctatttgcatgtccccctctccccatagttttcaaaccctggctgcatgcagcaggctgtcatgattcagcagaactcaacacattgggtatttttgggcttgaactctcttggggggtctgtccacttaaaggaccattcagctgctaaatctccatctcactttatttattcaacaaatactgatatcaaattgggtggccattcacctgaccactttggagtatagtagcagctcactctacataaaagtgtgtctggcatggtggctcacgtctgtaatcccagcactttgggaggccaaagtgggaggatcgcttgagcccaggagttcgagaccagcctggacaacaaagtgagacccccatctctagaaaaaatttttaaaaattagctggtgtggtggtgcacacctgtagtcacagctacttagcaagctgaggtgggaggatcacttactcccaggaggtcgagactgcagtgagccatgactgtgtgccactgcacttcaacccgggtgacagagcaagaccccgtctccagaaaaaaaaaaaaaaaaacaaggtgcacatctactcttcgcaagcattttggagacatacatttgttgatattttatatatttcaaagcacttccacccctttattatctattttaaaacttactatccgttctatccacttcagagggttttagttttattctcattgtaaagcttgggaaatcaaatcccaagacaggtcttgaggcttttccaaggccattcagcaacttagtaggatgcaaggtttctggcgtggtggtctttaactcgagtggtggttctcaaagtatagtccatggaccagaagcatctgcatcacctgggagcatgttagaaatacaaattcttaggccccacccccagacctgctgtgtccaaaacgctgggggaggggcccaggaatctgcattttaataagcctcctcactgatctataatatactgacttacaagtcttagatggcatagtacctactctagggcagcttattttgttaaggagatgaaaaaaaaaagatgggggaaaggatcatgacctttaggtagggaatatgaccctgaccttatgataatattaacaccaatatccacttttctttcttttttttttttttttgagatagagtcttgctcttgtcacccaggctggagtgcaatggcgtgatctcggctcactgcaacctccgcctcccaggttcaagcgattctcctgcctcagcctcctgagtagctgggattacaggcgctcaccatcatgcccggctaatttttgtatttttaatagagaccgacttttaccatgttggccaggcaggtcttgaactcctgtcctcaggcgatcaacccacttcaacctcccaaagtgctggaattacaggcgtgagccactgtgcctgaccaatacccacatttgagtactcgctcttcattccagagcaagttctttaacaagagctttcagattccatttcctcatgcttcttcctgaagaatgagctctgccttttttcccttcagccaaaatggtgacatttcaaaactggcagcgtccccataaaggaagctctaaatcctcaaagccccagcctggtgtttagatctgtcatcagcctactccctcacaacatgagagaaatgtactgaaactgtagcagagaatgagctctctctccttttctttcactgaccttctgcagactatttcaccatcccctttgaaggcctggttcggaaccctactgccctcccttgcagacggttccctcaacagtcccgcctaaacccacacctcccatcttaagtgaggctgctcttgtgtctttatttttggtatcaatgaaggtgaaagccagaaaacactgctggtccttctctccctacactctgccatttggcttttcagccttcttggaggagcatcgtggatactgttttgagtgttctgaccacaaaggttttggaatcattgttctagtttcaaccgcatgtctaaatccaatgcaacggttctcttgtctgagccacttgaaatcatttctctcctcaccttcttgttctgctgcctgagtggtaatgacatctcgggttgtcatacagagaaactgtttttaatccagtctgagccaacaggtctcatgctctatgtgagaaacactgtgagcagggccagtcctccggggactggccagtcctctgggggttgggggatggctattttggttcaagatgtaaaatatccatggtcagagtgaaggacaatcctaggcctcttttgcctatggatacaaacaaggtcgtatatcacattgaagtacaaattccgattcctcttggccccctgcatccatgggaactcaactcttcctcttacagtccctcccagtcaacccagggcttgctgaggggccactagaatgtgtctgcatgtgtcctttcttgctggctgcctactaaggcaccctatccctgccactgctacctgggctctctgtgagggcccctcagccccgtggagctcttcccacctggggccagcagaggtcctggggggtcaggttgtgctgaggcctgcagcagagtggccaggaggcaggatcctcattcctttcatgcctcaccacatcatggaggctcccaaacaacccttcctgagcccacagactcagtttctccaaatgccatcccttgattttctcactcaaatctaatggttcccaaccttatcaaactcaatcctgccttttaatgacagatattttgtaaggctccttttgttatcctgaaaagaaatttataactaatataacatatatatacacaattttttaaaattaaagtacttaattaaaattttttgttgctttgagacagggtgtcactctgttgcccaggctggaatgcagtggtgcaatcatagctcactgcaccatctgtctcttgggctcaagccatcctccctcctcagcctccgcagttgctgggactacaggcacttgccaccacacctggctaacttttgtattaaacatactttttaaaaagaatcaacaaatgttctaactgtaatatttaaaaaggaaagaaaaataatatatataacaaaatatgtgtttctatataaatattgggacatgactgcactggaagacagaatgaaatagtcgaattcttgcactggcaggtaggatccattggatttggcatctcgaatgcaactgatacaaaatgtggtattgggactcaactacagcattaccaccagtgatataattttccaaaatgatgaacaactcttagtaaacttctgaaccaaagcatagtcttccctcaaagtacaaggtagttgcattcttgggaaatccagtactttggatagggtacagctaggatctaggctcaggatgttcttatataattactgtataagctggtttctcaccacatgaatgtttaccaggatattcgaaagttgtggggaatgtgggactctacagagcattttgcattaaaggcctatagcatacctcaaactgtgatgttcaaaataacccccatattccaagcttgcatgattattagaaaaaaaaatacatgtccagtgtgcccctacagaaaggtactatcataatttgagggccctgctctgacctttctcttcacagctattaaccaatgagttgacctgcagtgggatgaatgccatagctctgtttcttcttcaaacatccttgaacactattcctccctccataagctcttagagcaaaagcctcaggccatccactcttgtccatagcaccccatttacacatcctcacaagctccacaaatatctagatttcaaattccaatctgcagccgggcacagtggctcattcctgtactcccagcactttgggaggccgaggcaggagggtcacttgagcccaggagtttgagaccagtctgggcaacatagtgagaccctgtctctcttaaaaaaaaaaatccgatctgggctcagctgagatgacatactacatcaaaatgacgagactcttttttcagctccagtatttttatgccactaaatgcttcaatgtactcagagaacttgtgacttcctaacactaaaccacattctagtgaggaacttaatatttccctacatttactctcacaaagtctgctaacccatagcaggcgtgcccatcctgaactctggcgactatgcgctttgtggtcttttcttcatgtcctcaatatggacatgaagaaagggactgaggaacagagacatcagcaatagagcctacaggagaaggaagggagacaggtgctagagtagagagagtcttagggctaattcaagtggtagattggccaggtccatttctccatctgggcctcagtttcctcatcctaaatgaaaaagtgtattaagtgatctgttagaggaattccagctccaataacctatgattccgtagatctagataaacccacaaatcatattagtaaagcacaaactgaaagatttcatgttgactgcatctcctttgccaagggcatgatgcatccagcagagaggctgctgcatataacatagtgcagatagagaaaccagcagacttttgtgaaaatcacgtggctgcttggaattcactgtggtcagaatttacctcatagaatgagcaatgtgatgaattccaagcactgatgtctttgtgtcatgttcagcgctgtaactctaactcataaagaaagtctaccagaggaaggcagactgtctccccagacaccccgatgaaaggaggcattttacctccttttttatgtctttgcttggttttgttgtctctcttccccagcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggtaagtcatctttgtggctgctgtccccgtgtttgaggtgtggtgcgaacaaataaaataccaggatgatttgtcctatctcccacagtgtaaccacagcactgaggtgggagaagagagcagaggcagaaggaagagggaggaagaggaagtagttgaggctcatttttcctcttctcagaagtggctctgaggcagtcacttgctatgcttgttccctgcaccccatctcaggcactccagacccaaactcatctaaaaaaccccctggatttttccactgacatctacaatttgggagcttggcaatttgttctgcaaagtgctattgttcctgagtgttaagtgaggctgaaggtacatcccattaggaagtgcttatttttggtgaaaagaaaatgtgtgtatagagatggtacagattgatagttatgttaggacgcatcagaaagaagacactaaagatttagttacaatcgcagtcattgaactagccatccacatgactcagggagaaaataaggttgtacaaatactactttcccactatgcaacttttgaatgaaaaaaataccgagcatgagattcacactgccttttaaggttttttttttcctcttaatatatccgatgtattaacccatgctctggaatattttccagaatctgagttcaatagttgcatcaatccagccataaatgtactctaaattgcaaattcccttgttgaacacttaggttatctccaatattttgcaaatattaacaacactgcaacgaacatctttgtatattaatattaagggtttaaatgttttcaaggtatgaggttattattaattttaaagtataaaaaagaaaactgtccttgcaacatatagatcatttatgtcaacattttacttaactaacagtagagagaaatatacataaaaaataagccaccctccatttgcccccacgtcaagtccaaaagtaatcactatttggccgggtgcactggctcacgcctgtaatcccagcagtttgggaggccaaggtgagtgcatcacttgaggccaggagtttgagaccagcctggccaacatggtgaaaccctgtctctactaaaaatacaaaaattagcatggtgtggtggctcaagcctgtaatcccagctactccactggctgaagcatgaaaatcacttgaacccaggagggagaggttgcagtgagccaagatggtgccacttcactctagcctgagcgacagagcaagactctgtctcaaaaaaaaaaaaaaagtgatcactattaataccttcttgtgtatcataaataaaagttatacctgtgcaaatgcatccttttttcacttgtaccaagtggatccattctgttctgcatcttgcttttaatttttaatgatattaatacacattgaagatcttttcataccagcacatgcaaatctacctcatttttaaaatagttgcatgggccggccgcagtggctcaggcctgtaatcccagcactttgattgggaggccaaggtgggctgatcacctgaggtcaggagttcaagaccaacctggccaacatggtgaaaccccatctctactaaaaatacaagaaattagctgggtgtggtggcaggcgcctgtgattccagctactcgggaggctggggcaggagaatcgcttgaacctgggaggtggaggttgcagtgggccaagctcacaccactgcactccagcctgggagacagaatgagaatccatctcaaaaataatcataataataataattgcacaatcttagaatgtatgattgtattattagtatttaaataatcctttatggtgagacatttagttgccagtttatttgtttcctctgctgtttcaaacaaggctttaatgaagatcttgtattcatgtatcttggccatctttggaatacaaacatatatatatgatatatatttatcacattagttttccttttcttttttttgagacagggtcttgctctgtcacccaggttggagcacagtggcactctcacagttcactgcagccttgacctctcaggctcaagtgatcctcccatctcagacccctacagagctgagactataggcacgcaccaccatgcccagataatttttgaattttttgtagaaatggggtctcattatgttgcccgggcttgtctcaaactactgtactcgagaaattctcccgctttagcctcccaaagtagttgggattacaggcatgagccaccatacctggcctatatgtcacatttctaactgtgcaacagttaagtcagagtatgtgatatcttaattttgccacataatttcctcacaaagcttgccaaatttaccttcctgctaacagagttatggaagtgccaagactgggtatcattgaacttttaaaaaaagtcaatctgatgggttaaaaaaaaaaaagaggggcacaaatatctttaaggataagactttaccttttacatacaccagaatttacattttcaaggtgccttctctttaagtaggcttatcaaccccattacagggggaggaaagacagaagtgagacagggtaaaacgtgatgagattcagaaccatggtttgagaggcagtgtggtttgctagctaagaacagaccccaactcccctcgtctggaacctccctttctagttgattcatgaagacaattgagctagtcacatcaccttctctctgtccattatagacaggcccatatccgaaataggttcaagactgtctacagggtctacaaacaccgaagggacctagaaattcattagttcaatcaactgactttacttagcacacctaatgtaccaggaaatttgttctcctaggccttacttccccaaatgacagttaaacccttcatttggtgacctgtggaaaggcttaactatgcacttcaaagggcatcaaagaggacaccccagcagccagtcagcattatgggaatttccccagtttgctttgtgatagtgtggtatagtggaaagcacacaagatggggagacagaggacttggactttatcagctactcttgtcatatgcagctgaggattcacagatgaccatgtcatatgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatgctattcaaaagcaaaatattatttgatgcattaatataattgtaaaagtatagtatggcaaaagtagacataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgaactgattacacatttcccataaacataatcactagattgaaaattggccttattataagaaaattaaaacatgttatggaataaagagcaataaactatcaggcatctttttttgttttgttttgtttttttgtttttttgagacagagtcttgctctgtcacccaggccagagtgcagtggcacgatctcagctcatggcaacctccacaccactgcccccacccgccaccacccaggttaggtgagtctcatgcctcaatctcccaagtagctgagactacaggtgcatgccaccacacctggctaatttttatatattttctagagacagggtttcaccatgttgcccaggtttgtctcaaactcctgagctcaagtgatccacccacctcagcctcccaaagtactaggattacaggtgtgagccaccacacccagcctatcagtcatctttttacagattgacagagtatggagtatctacttaaactagattttaagtataatctagtttaagcccttcatttgacgggtataaagtcagaggtccagagagtagaagggatgccgctttcaccctgtggtattaaatgagataatgaatgtgaaagtgctttgaaaactacaaagttatacacaaatgtaaagaagtttgatattcttattttgtttattatgttttttgtttatgcacaattattaattcttgctcaaaagtgactcctgatccccaaatctagcctggctttatcctttttttctcgtgtttataccgttcatatctgaagaagctcaattagggaggccttaaattaaaaagcttacaatgccaactggtagtgtcttttagaatctgtggttggaaagtcatcttttatattttaattattttggtttcctgactataaaatgatagtactaaagtggaaaaaatgttgattatcacacaaaaatgtttccttatagaaaatagacactgaatattaatctttttttccagtagaggaaatttcacaatgaggagaacagcaaacagagctttttaagtaaaatcgccacttctttttttattatgtttcatatttcagtagtgaaatcaacctgcctttaacagacaagttgctattattttttaccaattcctttttttttttttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttttgtgtgtgtagttttagtagagacagggtttcagcatattggccaggctggtctcaaactcttgacctcgtgatccacctgcctcggcctccaaaagtgctgggattacaggcatgagccaccgcccccggcctaccaattcttgtattctaaactttaaaatgtcttatcgcaaatgccaaataatgtgatattccccaatctttaaatgacttttaatggattaaacctataaaatgatataaaacttagttctatgtaagtctaaacattaattttccttttaacaggcatgaaggatatgtaccaagcagttatctggtggaaaaatctccaaataatctggaaacctatgagtaagatattttatttgtttttggaaaatacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttctttaatttttttttttgagacagggtctcactgtcacccaggctggagtgcaatagtgtgatctcggctcatcgcaacctcaacctactgggctcaagcaatcctcagcctcccaagtagctggaactacaggcacatgccaccatgtccagctaatttgtaaattttttgtagagacaggatctcactaggttgcccaggctggtctttaacttccgggctctagtgatcctcccattatggcctcccaaactgctgggatcacaggtatgaaccgctgtgcccagacaaaaagatgtgggcgtgtcagatgagcacagaagttggctctaacaggctccatttgatgaaatctgggacaatttgagtatcaaaataaataatgactattaaaataagtaatagactacaaaccattgaataatataagaatctgtaataaatagatagactgatagataaataaagaagtaaataaataaaaaggaaagggttttttcttatagtagaatgccaactaatgaatgataaagtttaaaaatcatcattttgtaacccagagtatcaactgattcaggcaagaatcctcaatgaatgtcaccactagcaagttaaagtttgatgagctgtggcatatttacatagtctcaaagtatctcctcacaaatcacttgtaattacaaagtggaggtaactagcaggcccgtctgaaacagtcaatccaaatgcacataaataatggagcaaaaaggtatcttgtgtctccttatgtgatgcactgagaagggcacacatcacttctgtgatattcctgctcaaaaaatgcacaacatgaatttacttataaggatatattcataaggatatattagacaaatccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggtgtgatggcacacgcctgtagtcccagatacttgggaggctgaggcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgttatgtagatcttaaatctcatgacttcggtaattgtactgtggttagataagtgtatactctgtgtcttaggaaatagacacagaagtacttaggaataaaagtcaattctcaaatagttcagaagaaaagtcaatctatgtctatctaaagagaatagtaaagcaaatgtataaaatatcagcaattggctcatctgggttatgtgtatatgatggttcttttacactattttacagcttttctgtaagtttgaaattatttaaaaattttaaaaaattaattactcactaaatataagataccaggcctaaagaataaagctaatgaggacacctattaacgcattagggttcttaattcaaatgtggtcgtgttatttgttgctgaaattctagtagattctttagtgaagaaccgtcattttctggagtctctcaaccttgtttgttttgataaagtatgtgtgagtagcccttccctcagtgaacagaagggtcatcagttctaagaatttttgagctgaaataaaacatatagggtatatgcttaaataaaataaaaaatctttataggcaatacctttgaagaaaaaacaataagcatttatttcaaatgaccactaggctatgtagttttgtttgttcaactttgcttttaatcagaatctctttgtttatgatcaaaggagcaaactcaaaattccaacaggataagcaataggaaatggtgaggtctggagcaaataaaaaaagtcattcacccacctaaaggtattttaagccattttaaaaataaaacactataccatgcaaacaaaacaatctagttatactgtgcactttcagtttgcattctccagattatgaatctcagctggaaaataacatgacttacaagcaaacattcagatatttagtatataactggatatatgaaagattccagtatgataactttttattcgtgaacttagtgttgtctagtttcaggtgagatctgcctaagtacttaaaaatgtaccacctggtaacatagtcatgggttggtaaattgaatggattcaggtctcctgccttggtttgcagccatgaccttgggcaagttacctcaccctatttgagttctgatcccttctccataaaatgaatgctcagacaagatgaaggaaggcaaatcatgactctcttgctggcattcccttcccatgcactgaactcaggcagacatcaccctttgatagtgaagctatttacccaccatgctggtgacaaccttttcaatgcacagctctaggcagccactactatcgctgatggcctgtgtgtgagatgaagcctatattttcccaatcctcgattagataatctctaagagcccatgttggtgtcatgtactgttctgtcttataatgttcaaaacctctaacgaatccatgaattcctttagtcatggctactctcaagtagccaaacaagtttgttaagtggtattccttccctacccagaacttctctcctcctgcatttattaattttcaaaactgattattaaccgatgatcagtctgcctcctcttacctaaaaagcagccagagaggttaggatgtggctaaatattgttaacaacataaaaaaaaaacttcatccctaaaaatcatttatattcttctttaccattttatagttgtttttcaccagacaacaaaattataaaaataatgcaattacttggcagaatgtctggaagagcagtcttaaagaggaaaatactacagttgttttaaaaggatatttgctaaactttcaaactggtattacaattttatagctgcactagcaccctcctccttataacgaactgtctactgacttatgaaacgaagaggaaaattaatgttttctaaaactttattttagaaaatttccaatgtatacaaaagtaaagataataatataatgaatatccatgttccccaaacctagcatcaacaatgatcagtattttgccaattctgtttcatatgtttctttccaattaaacattttaatacctggaaatgaatcatgcatttgcttttgagtttaaacgcactggtagaaacatacgtgtgcagacttgttaaataaataaaatacacttaaaatttttttaaagcactggtagaaatagaaaatgaccatatgattttctagcattgtcttttataagtaaataatgaaactttaaaatatgtcattgacatatgacttttccttgctttcaggtggtacaataagagtatcagccgagacaaagctgaaaaacttcttttggacacagtaagtctccttaacctgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcagtgggttgacatgttggattaacgatagttttcatgtctggtgaaaatattctgggaatttacaggactagcaaaccacaggataagaaacctgggcttggcattgacatggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagttatcctctaaagccatgcagtgtgcatagcaggaccgattttactcagggatgtcaagattaagggcgaaagggaagagaaaagtagaaaagatggtatggtggggcaggtactgggctctagttcctgttatgtcaccaactcattgggtgactttggggacctctcttcttccttctgggcctcggtttctcagtgagtagaagggcagaattggattaagtcagggatcacagttacccagccctcatcctgccactttctgctccttgtcctgtgaccaacacagctgatctcagtccatggcattgggactttattgggaaacaagacaaatgcagaaaaaagagcaagggaataatctaaaataaactaaggtaaactccagaggagttgggaaagattccatgaagaaaaagaagttgagctgagtccttactgaactctggtctctccttggctctacatcaactcagcacttaattatttcctgtgggttccccaaaaaaacacacattagaattgctgggaaatgttcaaaaatacagattcccaggtcccaccccagatccacagaatcagagtctctagtgttagttcccgggaatctgtactttctcaagttaaatttacaatgcaaatgtagccaactcaaacctggcgctgccaggctgtgttattggataacaaagtagaacttgattaatatgaactaattgagtggagtgcaaaattagctaaaactctgaattacactgtgtttaaacaagtatagttttgttatattaatcacacatcagttaatgacgtctatggagcacttcaaacagcccacattaatgacttctaaaagatgattcctgtattacagcagttcttgtgaggtgctaagtgctaagtacattttgcttgctctggcagttgaaacattcctccttactgatacatatatatatatatatatatatatatatatatttatatatatatatatattttttttttttttttttttttttgagacagagtctccctctgtcacccaggctagcatgtagtggcatgatctcggcttactgcaacctccgctgcctgggttcgagtgattctcctgcctcagcctcctaagtagctgggattacaggcatgtgccatcacacctaactcatttttgtatttttactagagacggggtgtcgccctgttggccagactggtctcaaaactcctgacctcaggtgatccgcctgccttggcctcccagagtgctgggattacaggcatgagccaccacgcccagcctccttactaatattttgagctactttaccaaattctcttctcctccttaggtaaatatgagggcaaacatcaatgggtccctgtcagactcagcccagattctggatagaattgaatgacattttcttgctatttttcactttttttgtgtgctgtttttgaaacaatagctgtattatttctaggtgtatttagagtctttttatctaataagtataggacctttaagagatgaattcctgcatagtattccatggcgtatatgtgccacattttctttgtccagtctatcattgatgggaatttgggttggtaaaaggatgagttcatgtcctttgcagggacatggataaagctggaaaacatcattctcagcaaactaacacaggaatagaaaaccaaacactgcatgttctcactcataagtgggagatgaacaacaagaacacatggacacatcacacaccaggaacatggatacatcacacaccagggtctgtcagtgggtggggggctaggggagagataggattaggagaaatacctaatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaatacactgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctcgccctagctatggaacgtggtttttcttgtctttgaacctttatgggtcaaatgttattatcagtattattacttctccagtggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgtttcaagagaagaaaagcaccacctccagaatgaaagatggctgtatttcagagacactcttaaagtataatgcagcataacaagactatgaattatcagtccatctgttcacaataacttaccctgtgtgttgagattatcttctgaaaggtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagttactcatctttataagttccttttaaggccaggcacggtggctcatgcttgtaatcccagcactttgggaggccgaggcaggcggatcactggaggtcaggagttcaagaccagcctggacatcatagtgaaacctcatctctactaaaaatacaaaaaattagccaggcgtggtggcgggcacctgtaattccagctacttggaaagttgaaggaagacagtcacttgaacccaggaagtggaggttacagtgagctgagattgtgcaactgcactccagcctgggtgacagaatgagactccatcttaaaaaaaaaaaaaaatccttttaaacccagagattctggaattcaaacaaatagcatgggccactgtctgtgtgtgtacacagatatgtgcccacaggcaaaccatcattttagttgtgggatagaaggatttgtgttgttgtagtttctatatactttgttccttatactccaagtgtatgccctccgcacaaggatcttgtctaactctgacctttacttagggccctcattgtgactaagttaagtgaatcataatatttggcttaacaaatgttaccagtgcaagtttacagcggggtaggaacagagtgttagataggaagtacttaaaatagacttcagattttttaatttccaccaagaatgaataaaatggtatgtccatttattagtgcttatttcatcagtgctggcaaaactgtcagggtggcgaaagttacattctcagggcactcccttcttcccacctctctcatgaaaccaggagcttaatgttctttttccttccgccctgcagccaaattctcattctggaaagggcctaagaaatatattatcattaagagaatccttatacactgttggtaggaatgttcattagttcagcccctgtggaaagcagtttggtgatttctcaaaaaactaaaaataaaattattattcaacccagcaatcctattacagggtatatacccaaaggataataaattattctacctaaaagacacctgcactattcataatagcaaagacatggaatcaacctaggtgcctatcaacagtggactggataaagaaaatttggcacatgtacaccatggggtaacatgcgccctgaaaaagaacaaaattgtgcattctgcagcaacatagatgcacctggaggaattatcctaagtgaattaacacaaaaatggaaaaccaaacaccacatgttctcacttataagtgagagctaaacagacatcaagatagtaacaatagacagtggggactccaaaagttggaaggaatggagagtggcaaggatagaaaaactacctattgggtaatatgttcactatctagcaaatgggttcaatagaaacccaaatctcagcaacacgcaatatgtccatgtaacaaacctgcacacatactccctgaatctaaaaaatttttaaaagttatatattcccattaagacactgatgaagttttcaggacagttttgtgcctttgtagggaaatggagaagcagcttctaacattctttgaaaggaggcatcctggagtagtagaccaaggctgggctttgctcacataccagagttcaaatccgaattctgtcactttctagttgtgggtcgtgggaatgccacttaagctctctggcactcagtgtcattggcggttaaggataccaatatccagatggcaatattgtggtaagagttggaaaatatctgtaaagagtctgatacatggggagctctaaaagggcagagcttatgtctctgtctccattcatggttcatgtcagcatgagaacagtctgggatccatgtaggagaccaagaaatatctacggaaggacaggagtaaatgaaacggtagccattcttactgaaatctgctctatgccaagtgggcctacagtatttcctccttctgtgggcaagaaagtggagctggaggcataagcctggtttcctgagatcactaactttccattctttctaaccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggaaaagacaacaaagttagacagtgcaagaggtagaggctcactagaaatggtctgttttccctctttactccgagaaaaccaaagccatggagatcaaggatagaacttaagagacttagaaagtgacagagctgggagtggatgccaggtcctctttcaattagcatctccaattttagagttctaaagacataaaatacttggcactgtattggatgagtatataatttaatacatagaataacagaagagatatttctatctggaagcaaaaatatatgaactccagttctggctctgctcataaaactacctaccattaactgagtctttattatgtgccagaaaatatgcagaccatttccaatcctaagaagccctgaaggcaggtattactatgctcatttcacacagaagaaaccgaggttcaggagctgatggtgcctccctatggccgtgggtctgaaggggccaagccacatccaggctccagccaactggactgcaagatccttcctgcttttctgcccctctgtacctgtttcttctctgtaaaacaatgcctaagaacctatctaggtctcaaattcccttctaattagaacatttgttagaactaagctgtttgacaatgaccaaagtgcagtcagaattaagagaagagacaaataatttttaaggtgtcttcggaaaatttttttggaagactgaggatgtgagcaggacgtggagcaagggcaggtggcaaagaggaagggcccgatccagggatgggagggaacacagtgtacatcacagaggggccgtgcctctaccatggctgggagacagtaaggaggtgacctgcaaccccacaggtatgacggagaagggatgaaacaaagtctgtgtcgaggctccccacaactacccccagcttcagggattcactaggaggccttccaggacaaagacttattgagatttaatacagcaaagtgatacaaagcaaaatcagcaacgggaaaagacacatgggacaaaatctagaggaaacaaaacacaagcttccaagagtcctctcccactggagccaaacaggacgtgcttaattccgccagcaacaagttgtaaccacacgttagcagtctaccaggggagctcattagagactcagtacccaaggcttttattggaggctgtttccacagacagcccctgcctagcacatgccaaagttccagatacccaaaaggaaaacaagcgttcaccataaaacacattgtttctagcagacggtttaggtacagctcgccacccttatcagttagggaaagagccctcccgaaatccaagttcccaaacaccagccaagggttaaccatgcaagcaggtctttctaaggagggtagtcaggcctgttatgttcatcctctgcagcttatttgacttatgaagtcaaataagggtgaaggggtcagagaggctttctcaatgtatgctgacaatcagttaaattcatagaataggcaaggcaaacacatagcaaatatttccattccctcattttgtggcaatggaagaaccatcaccaatccatcacagcattgctgtccactgggtccagacacaacctcagagtcctttttaacacagtactgcagcacccaggcccaatctgtcaagacagacttataagttgaacaatatctgccaccttgtgagaggttataagacaaagataataagaacttaatactcgtagacttttttgtgtctcaacattgcttcttaataatcattacatttgtgtttcatttgtttaagtgagaacaatccctgtataaagcattatcacatcaaggaaacaaatgacaatcctaagcgatactatgtggctgaaaagtatgtgttcgattccatccctcttctcatcaactatcaccaacataatggaggaggtaagctctagagcaggggtggacccgggccgcccagcaggaggtgagcagcaggtgagcaagcattactgcctgagctctgccttctgtcagatcagcgtcattagattctcataagagtgcaagccctattgtgaacagcacttgtgggatctaggttgtgtgctccttataagaatcaaatgcctgatgatctgagatggaacagtttcatcctgaaagcaaccccctgccacatccatccatggataaactgtcttccacaaagccgatccctggtgccaaaaaggttggggactgctgctctagaggacaaagccagagggcacctgggttagacttttttgaattgctatcaaggaatacctgaggctgggtaatttataaagaaaagaggtttaattggtccatggttgtataggaagcatggtgccggcatcttcttggcttttagggagccctcaggaagctttcagtcatggcagaaggcaaaaggggagcaggagtatcacatggcaggagcaggagcgaggagggagaagatgccacagacatttaaacaaccaggtcttgcatgaactcagagtgataactcatttattatcacaaggacagtgacagcaccaaggcatttgtgatggatcccacctaatgacccaaacaccacctcccatcccaccaggccccacctccaacatagggcttttcttttcttttctttcttttcctttcttttcttttctttctttttttttttttttgagacagagtttcgctctgttgcccaggctggagtgcagtggctcaatcttggctcactgcaacctccacctcccaggttcaagcaattctcctgcctcagcctcctgattagctgggattacaggcatgtgccaccacatcccgctaattttggtattttttgtagagacagggtttcaccgcattggccaggctggtcttgaactcctgacctcaggtaatctgcccgcctcagcctcccatactgctgggattacaggtgtaagccacagtgcccagccagggattacatttcaacatgagatttggaggggacaaacatccaaactatatcagcacccacacaggagacttaatgaaaactggcaaaagctcgccctggcttctttttgactataaataataaataaatatacaaatagaaaaatatgacaaatatttaattatattatatatcttctattagcaagctatcttgtggaaataatggaattttaccacttgcccatctgtgcttatgatgttttcaaggaggatatgatatcaataattaggctttgggatttgttttccagaataaaattagcttttgcgtctgatgatgattattattttttttagtgatttaagttagatggttgctagagcaaagccctaaccactgcttcttggcttttcaatcaacccaggcctggtgactcgactccggtatccagtttgttttgggaggcagaaagccccagttacagcagggctgagatacggtgagcagtacaatcaggaatgtaaactcatgtccctaaaggtctggggcaaattctgaataaactggccatgagcctacctgttcctcagactacaaatcaccattaaaacaagtgtattatatatctagagatgatggcactaatgaatatttacattgtgtgtaagagaagtacatatacaagcacatttctctaggtcaaaccagtggccattggttttagtgaagagttcattaatgaagtgtttattaagcacctactttgtacagagcaccctactaaatgctattagaaaaatattagaaaaccatgccttagcactgtgtttccacctatcttctagaacttttatatcatctagttggttgagtagcagactattgccagaactgcaagttgagagcatctagaagtgtttctctgcataagagagtgttaaaattctttggaatacctttaggcgtggcatgatctccagtgctgcagcccctactatgttttcttgccctacggaattgcttcactcacttgggattacctgcctggactctgaaggcatttggctttgcatcccttggtcccaactgtgtgctgcctgtggagaaggctggtctaattttcatttcttatctcctagcttggtggttctcaaatttcagtgtgcatcaaagtcttctagaatgcttattaaaaatgttgactcctggctcctatccaaacactcaccaaaacacaatccttgatagggtcctggagtctacttttttttctggcatgatctccctctgtcacccaggctggagatgcagtggcgtaatcatggctcactgctgccttgacctcctgggctcaagcgatcctcccacctcagcctcccaagtagctactatgcctggctaatttttaaaaattttttgtagagacagggtctcactatgttgccctggctggtcttaaactcctgggctcaggcaatcctcctgcctcagcctcccaaagtgttgggattacaggcatgagccactgtgcccagctgagtctacattttaaacaagcatgctaggtgattttgatacaagtggtcagagggcaatactttgagaaccactgccacgcatgggcttctttatccctaaccagcaccgtgtccggcacacagtaggtgctcaatactgcctgctgttgagtctctgcctcaaagcagtggaaatctggctgtttaggtaccagaccaagcactggggaaagagtgcctctttagcctccttatgaaaataagggtattctaataaatgtagaatcttgatgtgtccgtgctggatgggatttcagatattacctggtcagcctactcattttgttggtgaggaaattgagcctcggaatctcgtatttgtttgttaaacatttcttgagagcctcccatgtgccagacactgtgctagcttgtgcctctgcacaaattctctttaaatctttctctttaactgcccctctgccccagtaaggcctaatagggttatgtgtatatagcaggtgctcttaatagatgaatgaatgaaagaatgatcagctcaatgaaatttacttagtgtgaaaaatgacatagaaaaatgggacattgcaagaaccctttctttaatattttgattaatatggtttctttaatatcttcattaatgccactctccttctttccatgttaccttcccacacatattttcatagttttctagcatatcctatgttattatgtgggaaaaagataatttatttgccatctttgaattatattaacaataggctaaaattctagttagggctttatagtcccctggtatcccaataccttatatctactgcttgctgaccccagagaactctctctctctcttccagggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgtgagtgctcagaacaaggatatgcagaaactctggggggaacatcggttcagtgttcttgaaatgccattcaaacgccagggggtactatctccctgcgcaaactcccagcagtggcttcctattgcacagagaatacaatcaaactcttcacagtggtctccaaggcccaccataatctgatcatgcccacctcccccttctcagctcctacccatctctcctccagtccatgacatgccagccacactggcctctgctcatcttcacacacacagctgactccttgccatttttcaggtctcagctccaatgacatgtttttgttttggggagggaatgaatattattttcatccaaaccataaattagacaaaatgaccattggctattttggtaccataatattttcggcatttttgggagactgagtttaggccatctcaccccttgtctttttcctccaggaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggtatgagcatgcagggtgaacacccacaggtccagggtaaagggacagttctcactgaaatgactgggaacgcattaataaataatacattacagataatctcctttcctttctcaacttctcccttccttcacctactttgggtggtcctagtggaaagggcttcatgaggacttacttctgggctctgatcccagcccaaactctttcacctcctgcatttcagtttatattcttccaaaatggagataactgccactccttcttaacctctctgtgactcaatttcctcctggtaaattgaggaaactgagtttgtctgaaggtattattcaagggtctaccagaatcacactggggaagcccttaagctactctcagaatctctggtggctgggactcaggaatattcattttaacacattccccatatgatttgtatgcacattaaaatttgagatatgcagctgggtgcggtggctcatgcctgtactcccagcactttgggaggccgaggtgggcgaatcacgaggtcaggagttcgagaccaccctggccaacatggtgaaaccccatctctactgaaaattcaaaaaattagctgagcttactggcgggcacctgtaaccctagctacttgggaggctgaggcaggagaatcacttgaacccaggaggcagaggttgcagtgagctgagatcaagccactacactccagcctgggtgacacagtaagactccatctaaaaaaaaaaaaaaaaaaaattgagacacactggagtgttatctccaatggctttttcaatgcaacagtctataatactaattaggggtcaggtactctccctattgaagaacagttttaagaggattaacaacatcaaaacattcttaatttagtcaactgggagatgctttcttcctgttatccctgatgttaacatttcctatcacatcaggttgcattagagcctatctttggttagacaacaccaaggatttctaattagaactcaagaatgaagataaacttactcatcttgatagtggatcttacacattcaactttccagttaacttccagcggcatttgtgaggcttaattaacatttgtaaagctccatgatgcccttgtatgacagcactgcagtaaagcaaaggactgtgattataggagactccttaactactgatgactcatcaacagttttcctctccgcctttgtttgcctgtctcctctccaggctgccagaaattgtttggtgggagaaaaccaagtcatcaaggtgtctgactttgggatgacaaggtaaaagagggatgtggtgccggtgaagtctcaggaatgggactgaggcccccggaacattctgaccttctccctccactctcttcccaggttcgttctggatgatcagtacaccagttccacaggcaccaaattcccggtgaagtgggcatccccagaggttttctctttcagtcgctatagcagcaagtccgatgtgtggtcatttggtgagtgtcatgctgggccccactgccccatgatctgggcttcaggccagctgtttcctttatcaaatgcagacaaccctacccacactgaaccctgtatcatatcatgagggtgtcccactggagggttgtgtaagaaaggccccgaaaactatgaaagggccttcatcattttgtttgtttttagagatactggacatggtggtgggagttaactaaaagtggaaacaagagttctggtgccagctgctgtgaagtcaaaagctggagaagtcaggagattcaaatatgagccccttgaaggcagggaccatgttttgtccaacactacatttccatacttatctctcaataagtattaatatttattcattcattcaacaacaattaactgatcatctattctatgccaagggctaatctaggtgctgaggatgcagtggttcatagaacagaaaagacttctgttcttttggaactaaatttgagatgggaggggagacagaaaatcacaaaagatcataataacagtcataaacaataataataataaacaagctaagggatagaagataaagccaggcaatcataagtaggtgctatgaataaaataaaacagtaatggggcagagtgactaggatagagagagggtctgctttgaatagtgtggtgtgggaaggcctttctcagaaggtaattcttcagcagagacttgaatgataggagggagctgtcaccatttgaagagccagggaacagtgtccctgacagagggaccagcaagtgcaaaaacttggtgcatccaaagaacaaggggtactgacttattgggagaacaacaggcaatgaagctggtaggccatcataaggaattagaatttctaaaaagtgcaaatggccatgaagggatgaatgatgttggtattgcaggatgtgccaaatgttcttgctggatttgccatgtcacctgaagtcatagtttgtgcatactaaagtgtgcaaaaaaatataccagacaacctctttgatttggattacaagaattatactgtggacagaaactacttgaagattgatttttgccattcggtatgaaggaagggtttgacaagggcttactagtagtagaaaccaggggggagtttggctaggtaaatcttttaggagaagaatgagtgttaaaaatcttctgcagcattttagtctatccatctctaggagccaagtggtttgttcattatgagtcctacctatttcttaaaacagtaccctattaaccaacccttgcagctactttgttaaccaggtttaagttacagaatggacttgaaagaaattgtactaacagcatttttggatgactcccctctccccagtgtgtataactaggaaggttggggctgatgtgcagtcatctcactatgggtgatgaaactgatcacactgcaccaagcaagcaagggccccacaatgagacatttggagcaatggccactttagcacattcaccttctgactctgaatggggtttattcagccaaagggtgtcagcctgggaatttcctggggcatattaccattacagggttgggctgaaattagtccctgtctaggatatattatctgaagagagtccagaaatgaggttgatggatggatgcagaattgagagatcaatggaaaaaagtgtgaaaaaactgggggtaccagcctaagcaacagaaacctggatgagctgaaaactccatgcctgcatcagcccattggactttgtcctacgttttaagtttctttgccctaattagcagtgtgctattcagaacaagtcaacctctttgtactttgctcaatttttttatctatacatttctcatctgtgtattaaagcaatcattctgaaaccatgtttcagcatcggcacattttcaaaaaaattttcactaaaaattatggtgtcttggggtgataagcattcttatttagggtcaggttctgaatttccaactcctgaggcacctctgagtaacatctagagattctgatccactgggtttgggctagggcccaggaatctgccatttgaacaagactctgagatgatttttattcaggtgttttggggatcatgctttgggaatgtctactctaagattctctggaacaacctttgaaaagctctgaattagctgatttgcaagcagccttcttgctctgacaacctgtgaatatatcagcacatgataaagacaaagctaggtgtcacatttctaccaagggcagaagaggaaaagaaagggattaaatcagaggtcaaaaatagacaagcaaaagatgtgttttgcttggtctacatggcattttttaaattcaagaagttcaactcttaatttttgacgtcttttttaaaaaaatcagaaaatgtgccaattctgatccctcattttcatgtgccatactttggttggagtcaaatcatagctgtctccttaagacagaactgtttatctcattttccacaatcctccccaatcccaatagtgtcacacctcctgcactccattcatttacatcctgcatcttggcatttgagtctacaactcttagttgtagcatttgagtttggtacaacaaagggtccatcttgaaaatccttctccactacaaaggttgggaaatttcagttctttaaaaataggacaggcctaataagcctcaggtagacttgatgcacttctggaggtagcacatgaatcctaatgcaaggagtctgtaatttctagaggcaggttggtttgtttgctgtctgtgggctttgtcattcactgtgctgtgctcaccatttcttgtaggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagaggtcagtggaggaagtgcttccccatgcattgtcgtatacaatttgaggacctccctccttccctagagaaaggaaccctctcagaaggatgaggcaggagggataactaatatagattagcaacaacatgactttgaggatctgttaacgggatagatcccccatccctaaaggagctgaaggcgaccttaaatattatttggtttgctacataatgtcacaagctataagcatagcttcagagaggaggatggggtgtggcctatgccagcttccttctcgattttctgagaagagaaaaaaagtctgtaacatcataaaaccattaaaagcacaggaagttagttctataacttggggaacaaagttcacttgcactatgaaaatattaaaatggcttaatttgagttcattttattcattctgcatttaaaatggggagccaattcctctgtacccgcccaggtggctcatttaccccaaccttggattgcaggccatggcttgagccccatcactatgagtcttagtctttgctgtctttgctgagttagaaaatcatacatttcagccaaagtggaaagttgctgaaacagagaattaataaaaattctgatcattgtacgacaacaaggtggaatacaaaaaatttggaacactaggattttgtctcagctttaccatttatttgccattaatctttgacaattctctgaacttcctttttcttactgttaagagaattaaataatgcttggtctgtgagttcatagagcttttataatcagaaacaaagaaacaatagagacataaaggagggcataaaacaaatcttatccacttcataaggattagctacaataataataatgatggctgacattcagttggcactttttccctcttttaaccatcatttattgatttttttaaattaatagtctttattttttaacaaagagtacagagttctcatatgcccacctcacctgaacagtttccctgttcactaacatttggcatgagtgtgatacatttgttacaattagtgaacctctattcatacattaactaaagttcatagtttacattaaggttcagtctttgtgctgtagagttctgtaggttttcacaaattcatgtatccatcattatagtatcagacagaatagttttactgcactaaaaatctcctgtgcttcacccatttatccctctcctcatccccaaaccactggcaactactgatcttttcactgtcttcatagttttgcctttctcagaatgccatatattggcatcatacagcatgtaggcttttcggactggtttctttcatttagtaatatgctttaaggtccctccatgtcttttcgtggcttaatagctcatttctttttgttgccaaataatattccattgtatggatatatcatagtttatttatttacctaccaaaggaaatcttggttgttttcagtttttgtgtttgtttgtttgggtttgtggggttttgtttttttttttgagatggggtcttactctgttacccaggctggagtgcagtggtgcaatctcagctcactgcaacctctgcctcccagtctcaagcgatcctcctacctcagcctcccaagtagctgggaccacagacatgtgccactaggcccagctaattttttgtatttttggtagaaacagggttttgccatgctgcccaggtgagttcaggcaatcaatccacctcaggcctcccgtagtgctgggattataagtgtgagtgctcaggcagactggtttccttcacttagtaatatgcctttaaggtccctccatgtctttttggcttgatagctcatttctttttattgctaaataatattccattgtatggatatgccacagtttgtttatctatttacctgccaaaggaaatcttgcttgctttcagttttaaacaattatgaatacagctgctataaatgtttatgtgcagatttttgtatataaattttcaactcaattgggtaaatgcctaagagtatgcttgctgaatcatatggtaagactatgtttaactttttaagaaactgccagaatgtcttccaaagtagctgtattattttacattcccaccagcaatgagagttccttattagcattcattgttttggatttcagtggttctaatagatgtgtagtcatattacattgttgttttaacttgcattttcctaatgacatatgatgttaagaacattttcatatgcttatttgccacctgtatatcttcttggtaatatctattcagatcttttgcccatttctcaatcaggttgtttgtttacttattgttgagttttaagagttctttgtatattttggatacaagtcctttatcagatatgtgttttgcaaaattttctcctagtctgtggcatgtcttctcattctcttgacagtgtctttcacagagaagacttttcaaatattttaacaaagctcaacatcaacttatttattcatgaattgtgcttttgatttacatctaaaaactcattgccaagcccaatgtcacccaaattttctcctatgttactttttattttatggaagttttataattttgcattttacatttaggtctatgatccactttgagttaattttcctgaaaggtgtcaggtctgtgactagagtcattgttttacatatggatgtccaattattacagccctgtttgttgaaaagactataccctttctcctctgttcctttgttaaatgttagtttactatatttatatggatctatatctgggctgatccattaatctgtttgtttattctttcactagcaccatcctctcccattactgtagctttagagtaagtcctaaagtcaggtagggtcagtcttctagctttgttgttcttcttcattattgtattggctctctgggtcttttgcctctccgtataaatgttacagtcagtttgtcaatatctaaaaaaaataacttgctgaatttttattaggattatattgaatctataagtcaagttgggaagaactaatattttaacactatagtgtcttcctgtccatgaacatggaatatctgtccatttatttagatcttctttgctttcttttattagaatttttaattttttctcatttagatcatgtagatattttctgagatttatacccagatatttcattttttggtgttctttagcattaatttcttgatatatttttatatgtgatttattgaattctcaaaacaatttcatgaggtagatactattattatctccattttacaaatgacaaaactgaggttcaaagaggttaaataacctgctgaatgtcacacagctaattagtggtaaaactgagattaaacactagtcccttggattccagaatacctgctgttaacaactaggacaatgtatatggaatacagtcaacatggaagcacatacaaaaatccacaggggatgctgctattaaattctggtttgttttggatttacctatgacgcacaagtacaaggaacttacagagttcttttttccctctccagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcagtgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaatacctgttatcctttgtagagcacacagagttaaaagttgaatatagcaatattaaagctgcattttaataaatatggtgcatagggcctcggttccatatttatttaaatcgcaaactctcagaacttttccttaagtaaaaatggttacattgtttcattttccacagacaattaaagattacatatcattgaacaacattcattcaacaagtaaatatcaaacgttcctatggttcatgcacacagttcagtgtatgcatcctcatgaaaacaaagatggaaaagtcatagtctttacttctaaaaaattcctagtctgattgaaaaggaaaacatatgaagaaataaaattataatagaacaattagggcaacaacaaaaaactgtggtcaaagaagagaagagcccagaataagtgatggaatctatcagggaaaggatgacatcaagggaaacttcttagagccctgctactcaaagtgtggtccctggaccagcagcaatagcatcaccatgttgtgaaaaattcagattctcaggcttcttcctcacctaccgagcaagaattgtcattttaacaagatctgcaggtaatcgtatacacattaaagtttaagaagcactgtcgcgaggatatactgtctaagccagttttgaagataaatttatgagttataaggtaagtaagtgggcagaagtaagagacatactttccaggtagagagagaacaggaagtattgggaagctattgtcagttcactattgctggagcatgcgcgcatgcgcgtgcgcgctgtgtgtgtgtgtgtgtgtgtgtgtgtgtgtgtgtgtgtgtctattttctcagcaagggtaaggatgatagaagaggtgggtaaattgaaactgaatctataaatctatgaaagaactatactttaaaagaccaagaagttggaatttcaccctataggtagaaaagatgtcattgcacaggaagagaaggtcaaatttgcgatgtgtttaagaatatattctggcagcagcatagtgaatggatttgagaaaggcaaagccaatggaaaagaaactaatttggagattatctttgccttgttcacagtaccatattatttttcctaatcattcactgtcatctgttgtgtgggtgacatatggaaattgtaatttggagtacgtcattcactttagatagcaataaaatagctttccttcttaaaaccccagtaatataaaggctgggtggttatagttttggtgtgctgagcactctgtgcctttcagtccaccaaatgcccagctccattgcaggagccaggtcatgcgccagtcaaccactgagcatggaagagaaagcccaaggcttccatgcagtccttcctagaactcacctctgtgcttgaatcccactgccaaatcatccacatgagaaagtcaaaagcagattggaggaacagatctgcttctcagaggatttttcctgcagaccctgctcttctcagaatctcccaacacctaaggccacccttttgaggaaaagacagaaatacctcattcagcaagacagggagtatgtgcatcatcaggtgcagaaagagctgcagattcccaattagagggcttgggaaggtggcctggtcaggaacagagggctaggggtggaagctgcatttgaacagtaagcacatggttttactttagaatagatattaatttgcgtgggctttaatggggaaggtgctgaaattttggtgcactgaggctcacttcccagagccaccccttggtaccagcactaggggtgtgtgtatggttgtgtaagagtgtgtctgcaatgactttgagattctccccaaggtacaatgtatagttggcttgtagtataacagagtcatacagacaatgagtggtagacggagttttagagttcatttacttatttcataaatggttaccattcatctactatggctctttgttaggtacatgatctaaaaagatgactaagatatctcatcagttagggaccaagcacgtcacaatcaaattagtataattcgaggagagctttttgacaaaaggactatttaaaactgtgtggttcagtttaggagaaccttagaaagtggtacagaggaaaaccacagcggggcactcatgctatggtttgaatgtttgtgttcctccaaaattcctattgaaacgatctccagtgcaatagtattaagtggtggggcctttaggagatgatcaggccgtgagggctctgcccttatgaatgagattactgcccttatgaaaaggtttgaggaggtagtccctttttgccctttacccttctgccatatgagaacacagcaacaaggtgtcatctatggagcggagagcaaaccctgaccagatactgaatctgctggcgccatggtcttgagcttcccagtccccagaactgtgagaaataaatttctgtggtttataaattacccagtctaaggtattttgttatagcagcttgagtagcttgaaacaagtagttatcaccccctaggcctgaagggataacaagggagagtggtcatttaaatatggaaggagaatattggagagtgctgccttaaaggagaagacctttagtaagggacagaggaaacccaaggcaacatcacagggaggaagccaggggcatcaatactctgcctcactctccttcctttctcccatcaactgggtcttctattggtcaaatcccactgaacgcagaggacaagggagccctagtagggtagtccatagaggtcagtctccaggaccagagtgcagggtgagagagtggagtggatctggggagacaaagagaagatacctagtacagacaccaatccttcctataagagggctcagcctagtgaaaaagctcaacacataaaccaatgcaatcgattctcattgcttgtagattctgtattggtaaatttgtctactggataaaatttgtttataaccctaaaatcaatcctggaggcttttcctgcagtcattcatgacatgccaaagtgtggagcagtaaaaattttgcgttgctccatatacacattcccaactgaggtcaaacagagtggcgttcagctctcatgctgcaaacaagtggcttttctcagtctatttagtgacacattttctgcatttctgtactttttttctggtgattttgctgtttaaaatggcccccagccaggcacagtggctcacaactataatcccagcactttgaggggctaaggtgggtggatcacctgaggtcaggaatttgagaccagcctggccaacatatagtgaaaccctgtctctacttaaaaaatacaaaaattagttgggtgtagtggtgcatgcctgtagtcgcagctatttgggaagctgaggcaggagaatcgcttgaccctgggaggcggatgttgcagtgagacaagatcccgccactgtgctccagcctgggcgacagggcaagacttcatataaataaataaataaataaataaataaataaataaataaataaataaaacggcccccaaatgtagtgctgacatgctgtctagtgttcctaactgcaagaaagctgttagttcaataagtttaatgagggatgagttatagtactgttgactgtgagttcaatgttaataaatcaataatatatataaataagggttttttttaacagaaacatgcataaaacaaggttatgtattgattagttgacaaaagcgtggtgagcaggggcttgtaggaacctaaccctttatttcccctagaagcaatggttcagtatttgttaacttagtgttcacagcaactttatagaacataattactgaataataagaaccaactataattgcaaagagctgttgtaggttatgcgatgtagctatagtcacagcacagcaagagcacagagaattaagtaaacacatctaagggatcaggaagggcctcacaggggaagtgaagtttgagatgtgcattgaagggtaaataagagttcccaaaaaggagagggtctagaaggacatttcaggtggagaaatcagcaggcataaaaatgcatcttattccaacttcttctcctgcattattttcatgttacgtctaggacccttgaggcccaaaccaagtgctggccacaatcacgagagacaactgaaggagtcaagcacagttgaccttgaacaacatggaggttagcgatctcaaccccttgcactgtcgaaaatccacgtataattttttaatgctccaaaaacttaactgctaatagcctactgttgactgtatgccttactgataatgcaaactgttgattaacacaattttgcatcttatatttattatatactgtattcttataacaaacaaaatagctacagaaaagaaaatgttatttagaatatcaaatggaagagaaaatatatttagtattcattaaatggaggtggatcatcataaaggtcttcatcctcatcgtcttcacattgaaaaggttgaggagaaggaggaaaaggagagttggtcttgctatctcaaggctaatagaagcagaagaggtggaagcggaggcaggagaggcaggtacactcaatgtaactttacagaaatacatcgtaatttctgtctgaatttttgccttctcatttctctaaaaatgtttctgtataatacaaatccttctttcactatttgccttagtttcagtgcccacatcatagaagggtcatgtcataaaagaagtcgaaagtcatcttgagtaaccaaaaccctttgccagattgtctaacatcaatttgtgttctgatattgcctcttctacatcttcctcattgtctggcactggttcagtagcactcatctccatcaagttgtcatcttctgttaatccctctggagtggcatctattagctcttgatttctccaagatccatatgttgagacgcttcacacacacccctcacccacctttttgccatatgctcaatctctttcatgattttcttgattgactctgctgtaaatcctgtgaagttatgcacaacatctgaacacagttttctccagcagaaacttgttgttttgagattgatgactttaatagcttttcctgtaacaatgtggcatcttcaacagtgtaatccttccagactttcttgatgttctatcagggttctctttcatagcattgacaatcttttccaaagagtaccatatataatgggcattaaaggtccttatgacccccttatctagaggctggattagagatgtgtttgggggcaagtagaccactttgatgccttcagtgttgaactcatggggttctagataaccgaggggcatccttcaatatcaaaagaaccttgaaaggcagacctttagtggcaaggtacttcccgacttcagggacaaaacatcaatggaactgatccagaaagagttctcgttgtccaggccttcttgttgtacaaccaaaagactggcagctggtgtttaacattttccttcaaggcttgggggttttcagctttataggtaagggcagtcctgatgataagcttaactgcattgcacaaaacagcagagttagcctatcctttcctgtcttaaatcctggtgctcgcttcttttccttactaagcaatgttctttgtggcttttttttccccccagaatagggtactttcatccaaattaaaaacctgttcaggcaattagttatcctttctcctccatgattttgttaatggcatctgataacttgtctgctatctcttggtcagcagaagctgcttctcctgttatcgtgacattttttaagccaaacctctttctaaaattatcaaaccatctttgctggcattaaattcttcagctttagatccttcacctttcttttgctttaaattgtcatataatgacttcactttttcctgacttatattagagtctatgggtacgtctttcttatagcaatctttatagcaacgcacccacctaaaacctgcattttcaatatgagctaaaatggtatttaacaaaaagtgcaaggttttcatacctgctgggagccgcagctacggcttcatgaattttctttccttctttctctctttctctttctttctttctttttacagtggtccttatgctaaattcattcatcttaaaatgatggacaactgcagctgcagacctcaatctatggtacatatcaagaaaattcagcttttttcttgtaatgttatgacttttctctgctttttgggaacactttcagcatcactagtgtcacttcatgtgggttccatggtgttattcaaggtttgctgtattacactaaacatgatgaaaaatgtttcatcatgagagatgaattgctcactcagagatgattagcatcacacagcacttgaagtggatactggcaacacttgagttcaccacaatagcaacaagagatggccacaggccaggcgtggtggcacacacctgtaatcctggcactttgggaggccgagacgggaggatcacctgagatcaggagttcgagaccagcctggctaacatggtgaaactacatctttactaaaaatacaaaaattagccaggtgtaggggcacatgcccataatcccagctactcgggaggctgaggcaggagaatcacttgaacctgggaggcggaggttgcagtgagccaagatcatgccactgcactccagcctgggcgacagagtgagactctgtctcaaaaagaaaatcataataataatcccatttttgagcatttattatgtaccagactctgcttagtgtgttacattatcatttcatataaccttcacaagaatctaagggatatacttttttgttttgttttgttttgctttgttttgatacagtgttttgctctgttgcccaggctggaatgcagccgcaccatctttgctcactgcaacctccacctcctgggctcaagcaattctcttgcctataaaatgaggcaattttgagcaagtggtcaggttctatctacagaatggccaatgtaaattctgtaactgaccatcaagtttatcttttcctgccacccacataaatacttagaaccaaatgtgttagcaagctcatagcaggtagagctgtgattgatttttgttttgtttacattttggtcttatgtacattcgattctccatctcatctctctactcttttccttctttttaaaaaatttcttgctgatttttaattttttaacataatgtattcctgtaacttacatttaatatgtttttagaataaggtagcatattagtaaacaaatggacttagcttggaagagggaaagtgaggctgtatgagattgtggtaaaaagcatgggtttgacttcactaccttgggcaaattattaaaccttaattgcctcaattataaaaatgggaaaaatgattgtattttccttatagaaaaattacgaaaaattaaatgaggtaatgtacttggtaaatgttagccattattattattatcattatttatgttttcccttcatgcccattccagatacttcattactggtgtctataaagcagggtctcctgatagttttaaaatacatatatatatatattttttttttttttttgagacagagttttgctcttgttgcccaggctggagtgcaacagtgtgatctcggctcactacaacttccacctcccgggttcaagcaattctgcctcaccctcctgagtagctgggattacaggcgctcgccaccatgcccagctaattttttgtatttttagtagaaactgggtttcactatgttggccaggctggtctcgaactcctgacctcaggcaatccacctgcctcggcctcccaaagtgctgggattataacttgaagcttttctaaaacacaaggtaatgttgccacatggacaacacgtgggccacagctttgcaagtaccaaagcaattcttattgatatcctctaccatttcattgctgatgcacagcttggggttggatgtgaaggaaatctgaaggcagtagacagacagctatacatttcagtggcaaagtttaaaaatgtcacctatgggtgttcattccatccatttttactgaactcctgttaagtaccaggctccaaggatgcaatgggaaagcaagacagacatatccctgctcccttagattttatggtctcatggtggaatacagggaagtgtgttgacaattataatgc

SEQ ID NO: 1323 - DNA, 4366 bp, Homo sapiens
  misc_feature (2332)..(2332): "n" at position 2332  can be any base
tgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttcttcgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagnttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaat

SEQ ID NO: 1324 - DNA, 1863 bp, Homo sapiens
atgaacaactttatcctcctggaagaacagctcatcaagaaatcccaacaaaagagaagaacttctccctcgaactttaaagtccgcttcttcgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttag

SEQ ID NO: 1325 - DNA, 96597 bp, Mus musculus
  misc_feature (2986)..(3005): "n" at positions 2986 thru 3005  can be any base
  misc_feature (7486)..(10000): "n" at positions 7486 thru 10000  can be any base
  misc_feature (17313)..(17398): "n" at positions 17313 thru 17398  can be any base
  misc_feature (22084)..(22138): "n" at positons 22084 thru 22138  can be any base
  misc_feature (36130)..(36149): "n" at positions 36130 thru 36149  can be any base
  misc_feature (51795)..(51825): "n" at positiosn 51795 thru 51825  can be any base
  misc_feature (72322)..(72480): "n" at positions 72322 thru 72480  can be any base
  misc_feature (95799)..(95818): "n" at positions 95799 thru 95818  can be any base
agaaagagagacagagacagacagacagacacacacacacatggagcaggggaaagagggaaatatatccaaaaataatgaactaaaaacaatagcaacagtaatccccccgccccttaaaacatctttcaggacttataagcttgaaaccatgatcagaaaccatgatcaagagcttcgattgttcttatcaccagaatttccacggtcccaccaaacaggccgttctgcaggtacagttccctgcattcttcatcaagaccatgatcaaagtccaagctgggtgacctgcaaaacctcagatctctccctgccaaccaggcacctgtgttgagaaacaacccaccccatctttcatttctacaaatgtgcattgtgggattggtggtgaggtttttagtttacatctttaaatcttttaaaacatagaactttccattctcatccctgaaagtttacactttggtctctgcttaaatgacatgcaccactattataattgtgtatctacttttatgactttttagtgtgcataggcatgtcttgccttcattggtgcaaagagatgctagaagagattattgtaattccctgggaatgaggacggatgtgagccaccatatgagtgttgggaattgaacctgggtcctctggaagagtagcctgtgctcttaaccactgagccatctctccagcctccctgtatggtacttttgaacaatgcttatcttctacaacagccatacagttcttaaatggcgatttgcccttgactgctgccccagttcctagtagagtgggtgtcttgtgttgataacgtaagaaaactttttagtgaataaataaataatcaggatggggagactgctgagtaagtggagatgcccgctgccaagcccgctgccctgatttccatcccaagaccacatggcaggagagaactgactcccacaagctgtccatgccccacccttaataaatgaatgcaaaacaattagttaattaatcaacgaggtcctctaaaaagtgaagagcagtttagtagctatacttaggctgtatgagtctcttccctctaattaattcgctaatcagtttgcttctgatgaaatttcttccacctaactcaacctgatgacatttgcttgggtccagacacatgacccaacctgagccaatcagattcttccttcctagtaaacttggaactggactccagaggcaagcaatgagccttagatgtatctggatgaggggttggcggatgcttatgcagaggcggggcggggggagggggagagggttcccattctctctgtaaagaaaatcaacagtcagaaagtaaaacaaaagcctggtgtaacaacagtctccaatgctagctcttggaaggcagaaaaaggaggttcataggaacacatgcacccaggggggaaaatgtaaagcagacaatagtactaaatagagacaagagatattgcttgtattctcagagatttgctgcttcattcaagatgtccagttgtctgtgactccatgagaaactgctactatatgttataaatatatagagagccggtggtggtttcagtaaaaatatcccctgtagacccagggagtggcacttactaggtgtagccttgttggaagaagtgtgtcattgtggggacaggctttgaggtgtcagatgctcaaaccatgctcagtgtggtcctctcttcctactgcctgcctatcccgatatagaactctcagctccttctccagcaccacctctgcctgcatgctgccacgcttctcaccatgatgatgatggactgaacctctgagctgcaaaccagtcccaatgaaatgttttcctgtatagaagctgccatggtcttagtgtctcatcacaccaataataccctaactaaaacagagccccaccccatcctcttttagacaacggcagtcaacgtcaacctgagtcctggtgaagacacgcactgtgcctacttcaggaaggaagattagccaggttgattcatcaggttgatcacacacctttggcagattagttactgatgacagcccagctctcagccagatcaggtctgatgctaagcctttctatgactttgttacccattgggccagctctggagagacctcctgctttataaggaggaggcttatgctgaagtcagacttgaccttgaacccttgagtgtctcaactcttgtacctgaaaacaaacaaactcatgggttcaaacaggataaagaacagtgatttcaaaaataattctgaatagagacatgaaagaaaatggatggatgtggagttaaagttatccacccctttattaagtttgtaacctcaggctatatttttttaaaggaaaaaattgcttttgaattccccagtggactttttcctcccctgccccccccccctttttaatttgtcattcagtggccaagtcagggtttgctggcttctggaaaatccaggggattttgaaaatgaaaatctaaggtgtggctaaaagtatacagagtaatcttttatgccaaggggatgctgggcatctcctatgttagttaaggttcctattgctacaatgaaactccatgacctaaaggcactggggaaggagagggtttatttgattcggatgtccacatcagagatcatcactagaagaagtcagggcaggaatttaaacaggacaggaacctgaaggcaggagctgacacagaggccacttaggagtgctgcttactggcttgctctccatggcttgcttggcctgttcttctttctctctctctctttctttctctctctctctttctttctttctttctttctttctttctttctttctttctttctttctttctttcttcctttctttctttctttctttctttcttccttccttccttcctttccttccttccttccttccttcctttcctcctttctctctctctgtctnnnnnnnnnnnnnnnnnnnnttcctcctttctctctctctgtctctccctcccccctccctcccttcctttctttcttccttccttccttccttccatcccttccttcctttcttctttctttattctttaaaattttatttatttattatatgtaagtacactgtagctctcttcagacacaccagaagagggcatccaatctcattacagatggttgtgagccaccatgtggttgctggaatttgaactcaggacctctggaagagcagtcagtgctcttaactgctaagccatctctccagccacttggcctgttttcttaaggaacccaagaccactggcccagggatggtactacccataaagggctgggccctccctgtcaatcatcaattaagaaagtacctcactgccagttcttccctccattcagatggctctagcctagccaacactgttgagtagctaagatcagatactatggaatcttccacatcttcatttctgaaggccttaaaacagaacgcactagtctggggaccagatgtctgggcgggattagggatgctgcctagagttacagaacaatatttcttttcctctatgaatctaactgtgtttttggcttctttggttgttcaagctaccagatttccttctggtattctgggagcctggtcattttctaagactagaattccaagtgattctatcaaaaaacaaaacaaaacaaaacaaacaaacaaacaaacaaacaaacaaaacccaaaaaaacctgcaccataactcttaccagggtagagcaggaggttggggccctccctaggactgtgtgaagcagcagcaggggacctgcctgatgaaagttctatgtggggcatcagggagaggtggctttcaccggctgacggcttggcatacagccacaccttgttatcatgtctacaattagctgtggggccgtgtagacagggaaactctgctgccctgtctttttccacatccagcaaccaagagagaagaagcttatgaaggcaaatcttatacaccactgataggaattcaaggtagtgtaaccactgtggaagtcagcatggaagttcttcaaaaaaaactaaaactagaccttccagtgcaactcagccatattccatttctggatagtttacccataggactccaagcaagttcacagaggtggtcacccatcgatgtttaccgtagcattcttctcaaaagctagtttattaaagcaacgtatgtatccaggatcaaaggaaggaacaaagaaagcacggtgcttatgcaaggttcgtgccacttgcaggggatggaggcaactggggattgttttgacaaacaagtaaagacaaatattgtgtgctttctctcatatgtgattcctagatcttatatagtgtgatggtttgtatatgcttggcccagggagtagcagaaggtgtggccctgttggagtaggtgtggccttgttggagtaggtgtgtcaccgtgggagtaggtgtggccttggagtgggtgtgtcactgtgggaatgggctttaagaccctcttcctagctgcctggaagccagtattctcctaacaaccttcagatgaacacatagaactctcagctcctcctgcaccatgcctgcctgaacgctgccatgttcccgccttgatgataatggactgaacctctgaacctgtaagccagccccaattaaatgttgttcttataagatttgccttggtcatggtgtctgttcacagcagtaaaaccctaactaagacatatagatatataaaatcacacacatatacatatgtctacatagaactaaaactatctagggcagtgcctctcaacctgtgggtcgtatatcagacaccttgcttatcattatttacattacaattcataactagcaaaatcacagttatgaggtagcagtaataattttatggtggggggggttcaccacaacatggagaactgtattaaagagtcacagtattaggaaggttgagaaccactggtctaggggaacaaagagctttgggattatagggggaacactcaacatcaaatacatatttgtatgagaatgtccttgtgtaacataggaccatgtataatgaatagacacagtgaaaaatattttaatttaaaaaattgtgtgtgtgggcccatgaattgactcatgtgtctctgtgtgtgtctcatgtagctaagactagccttgaactcttgatccttctgtctgtacccctcccaagtgctagcattaagggctgtaccagaacatcagctgggtatggtagtgcataccttcaattccagcaactgggagcccgaggcagatgagtctctgtgagtttgaaattagtctgatcgatctacaaggtgagttctaggagagccagggctacctactgagaccttgtcagagggttggagagatggatcagtgtgcaagagcactggctgctcttgcagaggacccaggtttgaatcccagcattcacacggcagctaacaactgtatgtaaccaaagttccgggggattcgatgatcttcaggccttcctgtgcactcatgtggtgtgcagacacacaggcagacaaaacacccacacaaattaaataaataagtgtgtgttgtttttaaaaaaagaaagaaaggaaaggaaaaagaaaaaaatcaaactagcaaacgactttcctgagaagttgacgtcactttctactccgatccagggagccgggggcatcctctgggtacgccctaaacacaagttagtgggcagggccagttccaagatgaacttgcaagaaggggagggggagaaactgagcaagaagtatgaaccctggcagttttttcatgccaggccccgtatgtccccaccaggggtcagccagggtctggaaggcagatgttgccctggccagctgttggaattaacagagtcaacgtcactttggtctggagggagccccaaaatttcactcagatttgcacatctctatttaagaccttattccgcagagcagttatccaccgtcattgaatatgtctagaaggggactgactagaaagatcggcacggtgctccatacactgtcttactgggggtgggtgggggggcaggcagcaggagtcaagggggcagaaatgcttcagttgagggtagggagagaccgagctggaagtatgatgtttttgtgcaccatggaaaggttatcctgtgttatttgaatgttgattttttggccctcatatctaagtttccatcctgacatagcattgaaatgcttaggtggagaatcgcctctctcactgcgcagtggtggcacacacctttaatcccagcatttgggaggtagaggcaggcagatttctgagtttgaggccagcctgatctacagcatgagttccaggacagccagggctacagagagaaaccctgtcttgaaaaaccaaaataaataaataaataataaaaataaataataaaaagaatctcccatctcaagtttgtgtaagcaagtcttatcatttattccctgccttgttgataaatgctgatgaagtatcaaagatgacttggggctggactggcatccttcggcaagcagctcagggctgagcatatatcctgggtgagcaagccttgttcaggaagtcaggctcagctctgacattccctgttaaccaaatacccctgccccgggggagtgccttcttgccttccatcagcactgcaactgtctttgaggtagagaaaccctgtgtctggtgtcaatactcttgcatccatccagtttgtgagtgtttaggtgtgtatgtgtctatgtccatgtgtatgtgtatcctttagtgcaagatgtctgatatccaccttattccttgagacaggatctctcactgaacccacaacttattgtttctgagctagctggctggccatcaagacctggaatcctcgtcctaactctgtcccatatagtgctaaggtcacaggctcgtggccacacctggcttttaccttagtactgaggaatctaaactctggtagtcatgtgtgctcaccggcactctttaaacttttatgtgtataagtgttttgcctgcgtgtatgtatgtacaccacgctgggtgcccaaagaggtcagaagagggcgtctgatcccgtgagttatgggtggttgtgaatcattggggaactggactcagagctgtcttttctccagccccctccgccagtgctcttcctgaagaaaatgcagaagtctcagagtggcccagggcttctgacaagggggaaaaaagtcactaaatcctttgcccacatttcggatgctttccactagacgcaagcacaaaacacaaaacattactgtattgtgaaacaattggattcgttttgaaaacacctactccgttaaatatttgaaagtagaacaggaaaaaaaagatgaaatcggtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggcgagcggagcgcggcggcgcgggtagggaaggggcgcgcggcaggcccacgggaccagcctgggacgcacggagccctcgtgccctccgggacagtcgcctgccccggagcctcagctgtaggcgcccggagcctcggcggcgagtagcgcgtggggcaggggtggcgtgtaactgcaggaaccggggcaaccggagaaggagccggaacccggccgggatgagaaggtgacgccgccggggggcgccactcgctttgtggggaagatgctcgcctactgcgtgcaagatgccaccgtggtggacgtggagaagcggaggagcccctctaaacactatgtgagtactgcttccaccgaccccggcggggggctggccagtcccggagattcacgcccccaggggcagcctttgactccagagtttgttcgcagggctgtgatctctagggaagccttttctgcccttcttccactcccctgtcccgggtttctttttttggcattgcaattggcaagtggctgcccttgtctgttacaacggtgaagtcatgtgtccgcccgctgcttggatggttggtgggggaagctttcgtcagccccttgcagagcatttagttcctttgggaaggagcatctttgccgcgctccctaggggagccgggcactcacgctcactcggcccggaatgctttccgttgctttgaccagagacccacacttctctttctgctttccacgtttgctgttctgcctgcaccggctggggacagaggaagcgctttgccccctgccccctccactcttcgtttcgagctttgatttccttcttaaaaccattgtgttccgcggtgtgaggagaattgtggcttttccttttatccctcctctggacgtgacccttcgctggggtcatttcctcgtgtaagtgatgctctgactccagacacgagtaggcaaatgtggtctgtggtctccgaggcacggttgactggcccgccgcccctcccccttctttacccaaacttaatgagaagaggctaaggttgaccagctgggctttagagtgtgtgacagtactctttcatctcagccggtcctgtctcccagtcctttacacctttggaagtaaacattgtgtccttgttgctttaggatgacttgccgagctctgctcctggagatagaagagactcacagtaaagaacccaaaacacagaaaacatggagacagtaagggcagcctcttatttgcaaattaggcatttaaaggcgtatttagaatgctcaaagcattaattttaacaattaaaacgggctgttggtggctgccctagattgcacattagtctccaaagtgccttctatttcactgttggaaggaggctggggctggtggtgtcataccagccggaggctactctttctgtcaggatcacagcagacttgaaggcagagttctctgcagttgactagtggggctggactcaggttgggaagaaggtaagagtggtcagaccggagagacggatctgtggggggcattccctgacacagtcagagatcctttccaattgtgtagtctagtgtcgaaagcctctacagccgttgcaaaaacaaaacaaaaaatcccagatttcctccaggagctgtggaggcagctaagtaggagagcccttgactagcgagtttggagagagagagagagagagagagagagagagagagagagagagagagagagagagagacggagagacggagagggagaaagaaagaagagaagagaagagaagagaagagaagagaagagagtgtgtgtggttggagggcttcgatcagcaggtggccactctgctctaaggacaggtatccatttgtacaactctgggttatgtatgctgccaaccatcttgacaactttggggggcactgcaggctgtcttaaggattgttttatatatattttttcagccttcagttgaggctggtactgctttcaatgatggcagactctgccctgagaccctagcaggcgactttccaggtctgggttttacatgaaacatccaatttaactttgagcagctaagcccaaggttacaatgtaagatacactggcagcaaagtagcagccaacaggaccaagacctgctgttggaagtatggaaaggcaggtcaggctactgtttgatctttttaaaaggcttacccactgcacaacatggtacacattctttaaaactccactggggcacagtttccttgtattgaaaacaaaattaaattcttttatgtgtacaggtgttttgcttgcatgtatgtctgtgctccacttgcatgcagtacctgcagaaagccaggagagggtgtaggtttccctggagctagaattacagacaggtgtgaatgattgggtgggtgccgagaattgaaccgggtcccctggaagagctgccagtgcttataaccgctgagccatctctcaggctctagttcctcacttttaaagtgagggtaataatagcgtgtacttcatagggctgtcaagagacttaaatgacatcacccctgggaaggacttagcccagttctgggtacatagtgagtgctcatcaaatattagctaactgttggcgagactctgacaaagaaagtttctgacctaaaggaagagagacttggcgttttaagattgataataacgtgtactgtgtggaaaatacaaaagaagtcctgttcacttcccttgaaatggtcatttcctccctttctgcagacagagtgtttcctgggtcatctccacttccgtgtgagaatgaatggatgatgtgattcttggggcggagagtgacgtcacccagcagatgggatcacgcagagttctagaaaacaatgaacggagtgtgctatatgttgtggccttgtggagctggccgggggcagatggctcatctggtgcaaccttttacttaacagataaggggatgacagagaagcaggtgtgttagctagtcacagcactggggctaacggacggacttccagcctgtggtgtgggtgaagataccccaaatctggttgaagttgacaaagaagagagatacactgctacacagtttgagcactgatatataatacactggtgcccaataattgaaagagttcaggagggctctcgggcagttttgttttttttttttctatacctcttgtatagtagataccccatcctggaagggcaagtgttgtgaaagaggcattccagcatggttagccggcaggacaccttgtacatatgtgtggtaaaccccacactgggaaagcatgtctccttccatgcctgcttcgatggagtgccgagcctgtgctttggcaaatcgcagagcagagtttttttttttttttttttttttttttaatggatgtgcacattagccagagcttgcagatgagggaggcttggagcccatgcaggagggacagcactggctccagaacactggggaacacatgaaaaggttctctcaggacaccaaccggagggtgtgcacatccccacaaggagggggagctaaagaggtgggggggtgtatttctgtgctttgggtctgtttataaaaggcagacaaatagcctccatcttccatgctgttcgtagtgcaggcagcactccacttccttcctctctgccagcccctgccccgggtggggctgggaaggatgagcacccgctgcttgggtcagcctccctgcttgggagaccttaggtaaacgggcgttggcctcagaccctgtttctttaagatggctctgcagatgccagatgcaaaccatagccacctccgtcggagggcttgccggtgtaagttggaaagcagacttctttgcgcgcacaggtgtgtataggtgtgtttggagccatatggtggcggggagacgcttgtttatctgaagcaaaggagacatcatgtctgtttggatttgggaggtgttttgctttcacggtcatttccttccctgagtgtttatttcagacaaataccagtcgtgaatgctctgatcctccacaggactctagggaatgcaaataagagccagtgtcagcagctacttccatggtgccggatgctaacaggcatgctctccagggagcctgatgcttcatttactgtactggcgtgtctgtgtgtgtgtgtgtgtgtgtgtgtctgtgtgttgctctgatccttattacagatggattgaccaaagcttggtgaagttaaagttgcttaggattccactcagcttcagtgggatctaggtaaacacaggttagtttactgcccaaggagaagcccaagacagggctcttcccactcggacggtgagtgagtccaggctcagacccgtgtgacggtgagagagtggtgatacagggtggcatttgagggctgtctttctggaaaggttgctcatcatgtgtcatgaaactgggcttgactggtggacggagaggttcctgggagaacagggtctgtctccagtgagtgctggaaagatagatgcagggcagacctgtgagactaatgcattttccctgatttccatcatggcagattgtgtttgctgtcccaggagtggtgcgtttaggaatcggtatcaaaccccttcatgcctctgctcttcatttttatttcctgagcccgagattatggttccagcctcactggagcgagaagggcagcctcacagttggaaagagccttcttttttagggccttgaatcatggaagaagtgagagcaggcagattggggttcaaataccgcctctggcactcccaaacagtacaagcttggatccctgactccaggctcagcatcctcacctgtaactaggcagagaagaaggcccagctgttgagggtctgatgggacggacactgggccgcctgcctcgtggaaagcacccagtgtacatgacaccagagcacagaggacagctgtccagacctggagggggtgctggcctagtgttggggcctagtgtgagattgttagatttctgataagctgaggagagaaagaaggtgggctggtgggctggtagagaaggggaggctccaggtaaggacaaggaggctcctagctaggagatgagcgccacacagagcctgctccccatctgcctgcttctgggagtgtgactctcttacacacacacacacacacacacacacacacacacacacacacacacgaatgggaaccgtttcttctctatagagggaagtgatctggtggtgaatcacagggctgatgaggttccccgttcatggaacaaccaaccacatccttcaagaccgttgggacagggagcagagccagccgtccctcatggctcactctgttcagggttgagtgtgagggatattttgaggggagagggcaagccagggttggagtcaccgtgtgtggtggcaggcggaggggaagggaagggaaaaataaacctatttgatgtcaagtaagaccggctccagcttcagaaatatgagcgccagctattgcgttttccaaagagctattctggggccagctgagttaatgggcagtgggggctgtggactaggggatggatgctggggaacttctgacttagggtttgcctggccatccctggaaattgccttctaatttcctcatcctgagtcacagagtccttggccagaaaagcctaacaggcaactctgttctcttttgcctcctaattaaagaaaataaaacgactaacggagttatccgtacagcagtcacgcttactcgtcattagtgctgagaatccaggaaagagatcatgggccgggacagaactccagggacaggaaggacaaggggtgtgtgtgggaaacgaggtggagattctggctttggaaataggttctgagtgagggccagcggtgttctctgtcctgacaattgccaaaaataatggaagcttccaacagggtggtcagtgtttggacaggctggtccccagagtgcgagctgcctccagcctggttgggctggggggacaggagctgtaggcaagcaggtgaatggagagggtcaggggcttggactagtgggcaggccactgagaggcctcagataacctcaggcaagtcgccatggtagcagcagggactaagccctgttatatacacagggctgaccagagtccagccaggaccttgcaaagcacagcaaacgggttaggaactgacctgaggatctatgagggccagacacggcaacagtgctgacactgagggcgcttcacgatccccgtgtgggggaggtggttttgtgcctattttataggtgtcgaaatggaagttacacacccttagggtggttctgaggcagggctgtgattctcacctcgacccctaacaagttggccagctgccactagattctccagctgagatgagccagggagagatgacaggccaatccaggcagagtgtcctaaggagtgagaggcactccagtgctgggtcacctggcctgtcgtcatcactcactgccatgccgtgtctcggtttccacatctgcaaacagtgaaacagtgtaggtgaaaagaggacccagttccagggtcccaggagaaatcagatgagtttatcctgacaagggttctagaacggtgcccgcaggtcagacgtacgagattagaatctgcctgactggttcagtcccaaagcaggaagacctctccgtgaactggagttcccaggggaggcaggtggatggagaaggcggcggccgctttggtggtggggcttgggtgtgatgagcgttggctgggagaggaggaatggaatgaccagaagacagtccaggggagggaaagtgacgccctacaggaaacatttatgcgggacccaggatggactcacccaccatgaccgtgggtgagaaggagaacggagcatatgaggaaggtcaggtcctcaggtggcagccaaagagattcagtgcgccaagcactggggaggtggagacgcggggcccttggagtttgctagtgacctagtctagccaacgtgaggattttttttttttttgaggacaagatgcctgccgccaactctgacagcctcattttggtccctgagactcacatggagatggaggggattgatttctgtaagttgtctatgacttacacccgagtgcgtgtacatgtacacacaaactcacacactcacacacacagagacacaaatacatacatacacacacacacacacacacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnggagggagggatggagagagggaggaagggagggaggggaagaacgcattctgactgcagggctgtgttggtcagtgctagggcttctaggtgtgccttgggggtcttgagttcgctggatcccagcccctttagttcatagcctttactcctagtggccggactgccatttcaaagttgattgcacccagtgctcttggggaaacagggctgcagaggagaaggggacgctcccaggagtgaggcagtggctgcttcagatctcaacagtgcatggctgggggtgggggtggggcaggggcagcagcgtttcagaggaatcctttccacccaagctgtctggtgtccagacaaagacagggcttgccttcgattctgaatagctcaatgggagatatccacccctctggactcaaagttttatgtacagtgcttcatactatctcttcagtcttttgatcccctacagtacactcctatatcccagtaccctgcttctttgggggtgattgtcctaatagaaataacagctcctggttaggatactctcttttcaaaaccatttaaaactgcttctttgacagcttcatacacgtatacaaagtatcgtgatcaacccccctcctctcctccatcctccctccctccttccctgccagtatgtctcccccaccttcttgccccgtttccttccataactcagtgtctaatgaaccacttactcactggtgagtcgatgtggggccatccattggagcatgagcaacttgccacactgagaaaactgactctctgtttccaggagttaccaacggtcagtagcatttcagctagggtgtgggggggtctcctgagcccccgccccatccatgttggaatgtctactggtttgatcttgtgcaggtcttattcaggtaaccccaactgttatgaattcatgattgccctggccctgtaacatccagaaggtgttctctctctccctctctctctctctctctctctctctctctcacacacacacacacacacacacacacacacacacacagcactcctccctgacttttagctcttagtattctctctgccttgtcttctttgtatgatggtgatagccttgtgtgtaatactttctatgtgccaaaggatattctccaaacagcttcacactttataaagctgctgccggcatccacagggtacaggtgagaatgtctaacctcatagctgcaccaggtcccaagactcccgaacgtgccttgtctgtagattcggttgcttccaagtagcacatttcactcccagaaggactagatggtcgtaggccattcagtctgaggccttggttgcttggctttccacgaacaagtcaccttttccccctttacagtccccttgcctatctagaatggctgctgccctttggatctgcctcatagagggatgcgtcaggtatgaaaggggccccctggcttcccaagctgtatcttcctaagttggtacaggcaatattatggcagaaagctcttctggatgtctggagactctctcagcaaggctcacctgaccagtttcttcctgagaaggttcacagccagggctgtcctgggcacacattgggtcctcagtggagatcttctatggcacaacccttcgactacttttctatttccgtgcctccacccttacctgagggggaagtgacacccaggtggctgagttagcagagaggaaacagctgcgcttctgctcctcctctgggctttctttggccccttccctgtcacttccctttgtccagtaaggaaaccaccctccccaggcctgggcggaggtacacacgggatggggcagagtcctttcctctgtgtgcactaagtcagagagggcctctgaaccagcgctgggatccctaaagtgtgggtgaccttcagatgtggcggaaagtgatcgctcttatcaatccgaccataactccggggaggaaggggtggtgataatgagtgtacctcctaggtggggtaaggaaccgaggggctgtgcactgggttgaacctctgtccttttattgtacagcgcctggtagagcatcctccactctcaagtaatctacttagttgatggagaattcgccctgtattacgtcaccgccattcactgctgccatttagtctgtgccaggcacctccagacctctgatttataatcagagttgcctttctaatgccattggacttacggctgcagtttagagagtagcagtctcattgtcagtaaaggacatatttgggcatatttgtcccttcccctggcctgtgcctggtctctgtcaccttacttcacacacttggactctctccagggctgccccaggggtcatggggacttcgaagcccaatgtgctgtcctaaggagcctgccccttgttggaaaccctgcctcatggctttgcctacctaggggttctgagtgaataggggctgtccctgtcctttgaagtaactcctttgtaaacctttcagggtaggtccagttctgatccagctttagtctgtttcctggtggctggaacccaaaaagctattttaagggactcgcctgtgtgggagaatttctctgagtgacagcagagaggaggcctagccgactggcacaggcctggcgtgaggctccgagaggggagctctctcctgaattctacctcccaggcaggggctgatggggcgctttggcacagactgcctcttggaggggacaccagctcttactggtgagattggggtatgcagggatggctgctggttcatccccagtgggttggtccaccaatccttctcacacacagttaaagtcacccagaacaatgtctgagctttgctttcaagctgggattaattatgtcagtcatttctcattggcagctagagcaaaagagcttcgcttcccactgtgctttctgagggtcagacccgggaagtgggtgcaccgagacaagaggaagtttatgggggagccctgcaaagcacagccactgagctagggggcttacgtccaggagaccctggccattgctgaagatagggcatctttcttctgtccctggtgcttacgtggtagaagtcaaggcttaaacccagatctctgcagtgacagaggagtgagttttctgctgtacaccagagagttggtggactgccctggacagtgggcccttacgtgagagtgtgccatccaacttctctatcccctgtcactaggctggaagcatccacagcagggtcaaacctagcagcattcggcctttctcatctctggactcttgttctggtccttgtggatgctccctggtgtgttcccaaggccatctcctccctactgtgcggtctactgagtacagaacagggtggtgtcctggtctcatagggaatggagtgacgagaaaagggatatcctgccgtgggtgccctacggctcttaagatgtcccttctggtggcttcccaggaggcaggagcctaagggactcatcacatggaccccagacagaattcccagggtcatggatgaccgctgcaattcacctgcccgctctgatctctgagcccctgcattaacaccgtgtggttgcagctggcaattgagataaacttcaaagtggtccagagccacttttgaatccggctgccaggggctctctgtctttcctttcttttcctttcttttcctttcctttcctttcctttcctttcctttcctttcctttcctttcctttcctttcctttccttttctttcttttcttttcttttcttttttttttggtttttcgagacagggtttctctgtgtagctctggctatcctagaactcactttgtaggccaggctggcctcgaactcagaaatctgcctgcctctgcctcccgagtgctgggattaaaggcgtgcgccaccacacccagctctctgtcctttctttagagatgatgactctcgtggcattgtggttgggatcaggggacagtttaagtcattaagtcattctcatcctgacgcttgctaaggtaaatccaagctctaggacctagagtgacctccggagagacttgggtggcagccagcagaagcagggagccagaggatgtaggacgggtgctgacagcctcttccacgtgggctgaggtgaggacttggaaaatcagtcctgagttgtggccttggctctctctgccttgctggtttcacgtggtcacctttgttcaagcccatgggcttccgtttctgctgaaatgatgataatcatcctaatacttagctcatgtggtttgtgactctttatgatgatcagaggttcgataggtgtcagctgttgttattaccaccgttatcatccttcatgatttttttttaattaccttctagaagcttctctgacctcacatcttaggaatatttcctgcgaggtattagcgttttgagtgacctgaggttggtcagctcttagcaagctgtaaacttacaggtcgtccatttgtccagtatttggaatgtttcctaggctccaggcagggtgaacacaatggggtggcctggctctgtgccctcgatattctcatgggaaagggaaacactacacaaacaatcagataaaaatatattgtacacgaggtgcgggataaacactgnnnnnnnnnnnnnnnnnnnnnnnnnnnnnnnnnnnnnnnnnnnnnnnnnnnnnnntaggtgaggcggttattggaggagggttggtgtcctagtgtacagagaggtggcaggtatggccctaaggagaggtgacttttgaataggacttgagagttgaggcagtgaggcattatgggtatgtgagagaaagtagttgtggggcgtgggggaccaacaagtgctaaggccctgaggtagagtggcagccgtcctttccaagatggagcaagggggctggggtgtttatgttttggtgtgagagtgtgtgtgtacacgcatgagagggcaggatggagtccctgtccctcccatcctgggagtggcctcctctgctctgcagtgccagcttcctgatgtcttgtggaagactcagactggccactacactgcttggggtttgatcctgactccctaggaagacacagtctccatcagcagtgacgtgggtggggacccccggaccccagaagcattggcatctgtagggagatgtatgggctggaagttaatcttcaacctactgcgtgccaggtgctgcagtaaaagccaagatgtcagctgtgcgtgaccacagcagtctttctctttcatgtcccttattccatccagcagaggtcatggtgggccctggagcagtgtggtgaaacctgtgggctgaggctttgtcccgtggaaatcttttctctcaccccacgcttagcactgttgtggttggatgttaaagcacacatctctccaggtgtccatctctccatcacacatctgatgtgagtgatgtcaagatgctatcagctgagctcactgaaacctctgtcctccttggagtagatagaactgtgaccagagaaccaggtgtctctgttaattaactccattgcagactaaccggggaacgtaaaatctaccttgtgatggccagggaaactgtcttccagagcgcgctcgcgggggtggggggtgggggttaaataataaatacaatagtgccaactttcgtaagtacctgactcatttagctgtgagaaaggcatagcacagtccttgctatgcagtcaagggaccagagtcaggcaaagactgacctatcgatggtcaccagccaggaagaggtaatgtggggactaaggcttgcctggttgctcctcagccttttagagaatcctcctattcagtcacaccctgctgccccatagatctctacttgaaagaggggagttaaccagcaagcctcaggataagaggacaaaagtcacaaaagccacaggaggccagcccctctcctttctttagacaggaaaaaccatttgttatgggaacgccacactgcaggggtctggctttgttgtgtggggttgtcttcctgggtggggaccctgttggtggagggccatttagggtgtctagcaagattcttttgacacctagtcctaaggggaaggccagcaggtggctggggcagtgcggtccttgcgagagggcaggacattctatcttgttctctttggaactaaacaggtcttaactagtccttgggcccagaataaacagcagctgttgctggctccacccctgcgacgccagtctattaacagcttagccctgactcccttgggttcagtagcactggggttgggatggagccttgcattacagagcctacctagtgggggtgtacactggcctgccctctcccaggcccaatctccactcactggcctcataccttctgccctaggacgaggccaggatccatcgggtccatagtcctggatcgactcagctcttgtctttgccacctgcttacctagtgaccttgaacagaatgtaactctgagcctcagcttcctttgtaaaagcagctaactttacctctgtttcagggtgtcgtggctcagtgcaagttttacatacaaacacacacagcaagccagccagccacacacacacacacacacacacacacacacacacacagagagagagagagagagagagaaacacagaaacaaagacacacatacagacagatacagacacacacacacacacagagacacagacacacacatacccccagccccgccccccccacccccccagatacagtgcattacagcaggctggcctcaagcttacactggagcaaagatgaccttgaatctctgatcctcctgctttcacttccaggggtgctggaattccaggcttccaccaccaacccagaccccagggctttgttagtcaagctgtcttctctgtccctggtacagttattgaagacaaagttcccgacttgagcttgaactttgccactcgggcttgttgttgggggagctgctgaaagaccctgcacctcatttttcttgtctgttaggtgggatgctagacccccccccccccagcagtgagggctaagcaggctaacgtgttttaaacactcaagactgccagctgtggaggaagatgtgggcaggtagtgtaacgaagcccctgtgtggggctgtgagccttgtctctagtgaacaaacaggtcttctactggatgtgaccacatcaggatgtttccctgggctgcaactgtgagcctgcttgttgtggcttctctctgactccttactcttgggaacttctgccatctttttagctcttgaggctcttgaaagattgcatgggaacccccatgagaacatccaaacagagaactcatcttttgcaaagagagaaaacccaacagcaacaaaaaaaaaatctcacctaacagttagtcctgagtgtgtttggccctggtgctggggtgtcagtgtgagcacttcaggctttgagaaaaaaaaggtcctctggatgtggattctccccaggagcctggccccttaaaagaagtagccagcacggtgttaatacacacacacacacacacacacacacacacaggttttgtctgtttttgttcaagaagagaaggctgtatggctccattttgaacaccagaggctgccactctctgatagacagggaagagaaggaggctatattccagggagaaatgagaataggagctcaaggcttggacccagactgctggctcacaggtcagagccagcacctctgctgtgtggtcctggggaagtcccttcaccactctgcttcacttccctcgccttcgaaatggcaacagaacagaacctctggtgtggcatcgttgggaagattgaacgagaggaggaagccacgtcctgccaaggcgtggtcctgccctctctgagtagacacagcaggtggattcaactttccagagccccggggcctccagggcctgatggagatatatttagaacacttgcgagggccacatggtgtctgtgacaaaggatggagcctgtggcatgttctagggggagggtgacctgcaggtgagggaatgccagcccttttcctagctggctggctatgagctgatgcccgcctaccccagggcactccgtttcctcagatggatggtgacggggacttccgttaggggtgctctgagaatcgttgccagcatgaaagcatgcaggaagctttttgtgataaccacttagccagctgtaaggcgtgatgaggggccttcatgtcagatagggttcacacagagcagggagcttgctctgtccctgagtcaaacctgggaatgaccgtggaaaggagacagggtgctgtcatgctgtgggatgtacttgtgatagcagagcggagttagcatgtatttgaacccatgacttagcatccgaaacaactaaggtagcgaactcctcctggtagcaagtgctggaggtaggactgaagctgtgaaccagggaccccccccccaggccagacagtcctttgtgcggtgtctgttgtctcttgtcacagaggaagagaacatggtttatacgggtctttcgctgtaatgggaagcggtttctagagccactcagaacgcactaactggaaaagacttgatacacaggtttccaggagctcagcaggaatggatgtagccagggaaggcaggagccatagaagtggggcctctgaaacgagggactccgatcctatacaggctcactcctgggaagaaatccacagtaataaaaaaagctctgggagacagtagacatccgagtctgcacagcataggcaggctgggaggaacgtggaaggaaggcacggaaggacctggctgctggcccctgtgcccaggagggcatgcaggacacactgtttgttgtgaaatttttatttgcaaagcagggagttagaggtcctgcacattaaaagctttctgagacagtgtttgaaatgatagtgaaaaaatagacattcttaaggtagtaaaaacactttttgagaaaataaaagaggagtgtgtgcgtgtgtatgtgtgtccgtgtgtccgtgtgtccgtgtgtgtgtgtgtgtgtgtgtgtgtgtgtgtgtggccagctttcttgagatgtaattcctatagtgtgcaaatggcccatgaaatctatacagttcaatgacttctaatattcacagtgttagacaactgcactgtgatagtcaactgcagaatgtgtcatgatgccccctccccattggtccctagccactggcaactatgaacacaccttttgtctttggaccagtatcttctagccatcacatataaatgcagtcatctgttaggtgctcttttatgactggctttcattaggaaatactttcatccatgtcgcctctttgaatggcttgctggggttgctggattcattccttggggcccagatcttagcacggccagcccttggttgcaagtacaggctatgctggagctagccctccgtctcctgtgaatgaaccctcgccccttccccggccagcacattgaaggttgggtcttcagtacaggttctgctttgcagttttattctcagcacttcctctgcctcttagagctggtgggggaggggtggaaactgcacaaggcctccactgatctgtccccccccccccccagggaccttctttccggtagtgggtggggaaagagacagaatagcatctttatttgtttttaatattgcccgactccccccagcccctttcctaagttctggtcagagtccccatggttgttgtcagactcccttcccttgagactccgggttatgtgacttctctcttgggggcagccgatggggaagtccacaagtgctttggcttcctccagtgtgaagttagttagactctctgtttttcctctagttggagctgggccagcacaaagctggcacatcctttaagaggcggtcagctgtaagtaacacggccctgcagaacctccttaagcatatggaatcggggtatctcccatgcctccctgtttataggcgggtgttgttgcaggtggggctcccagatctctgtgggaagctgttgtatcggggcttacctgctctgaccctgggtcagctcagtgcctgtttgggagtagaacctggcattgaagttctgattgaggctaccaggaggctctgccccgccctagactcactagctcccaattcatatcctctcctgtcaccctgcagaccagagcgggcattttttggataccttttggtggcctctctctctctttccctgtacttacgctaaagctgtttccactgtctggagtatgtgtttcacctgccctgttcctttaagacaccattccagtgtctcttccggagtcatctaaggtacacgggcctttcccacatgtgtgaggtatttgtaccatatgaagagaggatagaccggatcctgcacttaagccccaggctaacagacgaaaagttctcctaggacaagggctttgctaacccttgagctgaacacttgtcaatatttgctgaacctgcctgactcgtggcctggcccgatgtgtttgttggtcacgtgctgggttttcccgacttcagatgcagccagataaattaatcttgttttacaaggtgttttgtgtatatgaccatggcagaacccacatcctctatattttccctgtcagcccgacccttctaccccttccccatctcttcagcgtctactctgatttgtttaatctaaacccgtgcatcccctggtgtgggatctgttgtatggcttgcataggtggctttgtgcgacctcttctctttgacccagtagatcttttgtgcattctctggcatctgcttccttgcttttgactgattcacggctctctgtgcccacgtgcactacacttaccaactctccccttgatggacacttgagttgccttcaaggctctctaatgcaaatattactgtggcaagcatccatgcacactactgccagtgcaaactccacacactgatttccctcacatgtagactggaaggcaggatggctaccaaatgactcagtttgggaaagtagtgccatgttgcttctcagatggctctgtcagtttatacgtaggcttcccacgaactccctgtctgctgaccccacttggtaactacccaaagaccttccagactgctggttctcctcctcacaaaccaatctgacctccactggatgatataataaattctaatctcttcctcattccttgccaacccatctctcctgcctgcaatgaaagtcctttttataattttccacccaggtctcactaatgggcccagaaacctaaaaccttccattatctgaagaacacagccagcttttcaaaactaaacctcctttgttttctcccttaatctgaactaagcccttcctatctatcttccttctccaccgagctgggagcctctctggcaggttctgtagaccgtccaggaaaggctgaaagttgtgttgcttcacatggtgggggaatgactctagtcctcccgggttgcttctctccttcagaagccaggtttggtatttagctctgtttaaactgtgaccgtgctggcaggtggaaaccaactgggtttatctgctgggcataatgacaggaaaaaggatgctacaaatacttcctaggcgctggcctgggccagattctcagtcatcactgttccatgacacctcatgttgctgaaattgactattattggtttgggggttggggtttgttttttggtcattttatttctttttatttaaaattatacttatttatatttattttttaaagattgattttaattttatgtgtatggatattttatccgcatatacatttgtgtactacatgcatgcctggtggcccaggaggccagaagaaggtatggggcccctggaactagagttaattacagctggttgtgagccgagaacatgggtgctgggaaccttgctcaggtctgcaatagaggagcagcagatgcgcttaacccctgggccacctctctggctcctgtctgcgatttcactttgccccatcacagtgaggcttagacatggcgtcaggtccggtgttctgagcctattatgtgcttgtctgagttctccagttacaccgtgagctgtgacccggcaacatcagcgtctcctcccccctcgcctctgtccgtgcccccaaccccccaccctccgcagggtttttcacttagcagatgctcagtaaatacttgctgagtggttgacacagattgcatgctatctgtcatcttcaaaggttaggaccagaccgttaaaaaaaaataaacaaaatctttctcttaaaagaaggcattacctcctgcccttcccttgcaaatgttccttctagtcttatttattgcttttttggggggtagggagtcttaggagagcgactcagaaagcccctttaatttaagagagatgccataaatcacacccattacggagggatcaaatgcctgcgtgcgtgcgccctataagtggattaggggcgcacacttgggatggctcctctgtttgtcccccacccatctgcagggctggccttccctggcagtgtgtggtatcctactaattgctcttcaataaacaacagtctgttgaaaacctcccatgaaaaaaagtgccgtctatgtattgtatcgggaaaactaaatattatgggaaaggccaaatatttccactgtgttaagaaaataagagccccggctgtatggagcttccctctcagtgggcaaaagactcggtggagacttcaaagagggaaaagctgtcaggacagccagggcagtggctccattaaagaggagtgagtgtgtgcatcctactcgtggctgcagaagctgcaacattctctctgcctccgggaggatggtggaatctgggtgatggagctgtaatggagtccttagtatctgggcagcatctgagctggagggcccctgaccgcacgtggaccatctgatgagtctcttctggccagttccacccacctctcatcactgggttaagcaggcggggttggctggctttcagtggggagagacctaaaaatcatttggcttttactaagaagtcaggctaggttatctaagggccatccccagggaggggagatctgagctgctggcttgcccattttaatgggctgggggaagctgtttgaggagtggccgtaaaattgctcaccagacctgaaatatgagaatgctgtctatgagtcagagggaagagctcccaggtacagagaatgggctcttgttcttcagggtggttgaagacctggcactggcttgctgggtttctccttagcaggatcattcccacctgccaaccctgactaggtacacatcagctgttaacccaaatgcagacgtggaggaaccgttgcttctcggtacagggactttcctcttccttgctcccagaggatgcgccagtgcactgtggtgacaccctgtagggatgacagccatgctcttcagctctgcgaatgcctaggagctgtgcagagtcccaaacacctacgccttcatggagcctcccatcagccaaggcaggactgttattgcctccttcatagacacagattcagaggtctgggggtgtgtggtggcgcgtgaggatatttccctgtgatcagatagatgagatgtggcacagctagaattcagacctagatcctgtgacattttagcattttgtgcgagatgaagttagccattcttccctgttggtggcactactaccatcttctcttcctcttctcctccttccttcttaggaaaatatgtatttattttatgtgcatgggtgtttgtgccttcatgtatgtctgtgcagaacatacattcagtgcctgaatgggcaagaaaagtgcatcagatcctctggaactggagttacagatggttgtgcgctatcaagcaggtgctaggaatcgaacttgggtcctctagaagagcagctagtgctcataactgctgagccatctctctagccccacaccctgacttcttaagcctcagtcttagttgtaaagagaggaccacttcccaggaacaaatgattcactaggtccagtagaattggttactacagattttaagagcactctggagaggggctggtgggcgtggccatgtgtcgagcgtgctgggtaccagctgtaagctctgcatcttaggtgcagaactcccttgaattctcgcagcgctcacgtgagatttgttttataaatgtaggatgaagactaggagatgatgtagctctctctgcgctatacagctcaggggtggtggagctgggcctttgctgggcctttccagtgccaagacacattctcttggtgtgagaccatgacagattgttttaccagagtggtcggggaggggaggccctgaggggtgtggagaaggggttggaaatagccaatccttcaggctgggggaagggaagagggctggggaacagccggaactatcaggatgggaccagtcttcatcactctcccgaacacagggactcagtcccccaactgatgccttggcattgaagaccaggccttcgtggctctgcggaggtgacatcactcatcctctgtgctggctccttggctaactgattagatgtggtcatggtgatgggtatgaccctgtcaggatgacgcatcagccgtgggatatcctggtgtgggaagaactagatttagccctggaccatttctctgttcactgcttctgtacgctcgaagctgagagtgctcttccactggcccaccaacccttccgagctccagcctccttgctgacctttgaaagcacatcacggtcaatagctcatctgatccctcctgtctttcacccagcaagcatttatgcagcacctactgtgtgccagacaccgtttcagatgctgtagacacctgggtgagccagagcggtcgctctccagagaagagggaggccccaggctgactgggtggaccagcctgagtcaggtcatctctgaaggaagtgtgtggtgagctgagcaggaactgggcagaaggaaggaagtgatccctgagcaggagtagaagctgctgtctatactaactgtatgtggcagtggcaggtgttcgggggaggggacacctggcaaaggccagtgggagagagaaagggaagaggtgactcagtttccctttactgtcgccatattctgggatgtgccccggggctgtatctcggactctgaatgtttgatgatgaccaagatgggcttctcatgttgccctgttcacgtttatcagtgacacggggagacaggagagagagcactctaagaggtaccaggcttagctttcaaaactaacttgaggaaggttggagtggaatgggcaggaggaagaaatgcaggaaacagccccgtttacagtagcatcatagagtagaaaacccatgttattcttgtgccttgcaagtctgacactgtccatcaaataacaatccccgtcccctccaccacaacccaacagctgctctctcaccttgtttgggtaataatcctaaaagttgcatgaagtcaggagcccaagtacagcaggggctgcagacacagaagtgggaggagccaggggctgggtcacttgttcattagaaaggaacgaactcagccctgtgagtgactttcaggtcctggggctgtagccctagaacttgcatttctgagatgctgtcactggagttcaaggtggagaaagatgagggggagaccgtgtctgttctgcctgagcccatttgcacaggtgaacattgctttcaacccccgccccaaccgagtcccaccctcacatgcagcatttgccgagatgagcggctggatagggaagctccgagacgggccaccagaggcatccctgggccaggaagaggacatatcagggggtccctacaggagccggaggaagggaggatcagatagacccaaagactgaactaatggtcacatacccagagacgaacggatggccttacttgtgacttccttactgactctggacccatgcaggaaaaacctttctcctatgagcctcgttcttgtgtctcatgggcccatgcacttgaaacacctggtccctggatccctctgtagagagtcgactcttgttacggagtatagcagtgttggggcctagatgcaagaatgacatgcgtggacagttgtcgtctatacaaggctgtgcccagacttgctccatgcttgctcaccacagaccacagtcacagaccttgtggggatggagctgggtataaaccttaacccctgactccaggtctctttctctcagtcccttgtccagcctctgagctggggatgagttgcctggagcggaggctctgacctattatagccttcctctaggaggtctttccccagacacagaaaatctcaaaggcagaggacattaggacccgggcacacttgtcagtcacgccccagttctgctttctcccctaccaagccccaaagccactgacagaacaaacaccacgtctgtatctcttctgactggccacttctctatcttctggagatttccatgaaaagaggcagctggtcttgaagagtcaatagaaagaggtcaccagggagtgagtgccatgtaggacgcttgccatggggcatcaagcttccagaatagctctgtaaggccatgtgcttccttctagatgcagggagtggtcacaagatgctagtgcccagcctgagggagcacagggcccagcctgagggagcactctagggcgggacttggggtgtgggtcccaagatgcctggcttgacctaactgtccccactgaggggtggccccgcccaccacctgttctttccctcagctcagcacatctgtccgtgggctccccacctccctctcacttgagataccaccaattctctaagacgcagtgactccgtcaagttttgccacaaggtgggaaaggacagtctcactaggattataatcccagctggctgttctagtcatgtgaccttgggcaagctttgaacccttttggaagttcagcatcttctgctggagagggtaagcacccctgggcctgtgtgttgatacgggagcttagtgattcagagcagccccctacagagagagtcagagcaaggagctattaaggtggtttctgtcccttctggaagtctcatgaaataccccatgattggctgctctcaactgtgtatggtcagtgtatgggtgaaggtctgtccagatctcccacttgtatcgactgggatggtggaggccacacctcggtccgttactacagctacctgcctagcagacagttaccaggaaaaaactcgaaggagctaccactgtgtttcttatgggcgaggcacactggtaaatgccttgtgggcattttctcacctcatcttcattcaaagtggcacaacagagaaaggccctcactgagcaaacccggtgacctgagtttgatccccagaacctacataaatgtggaaggagagacccggcttcacagagttgccctctgatctccacctgcatgatgtggcatgtctactcacgcacagatatacacatcacatcctcacgcaatatagtaaaaaatgtttaaaaaaaaaaaacccatccaagtcatgacctcttgctactcttgtttcataggcgtggaaggctcaggaactggatacctcatccaagtccctataccaaataagagaccaagctaggtctagcatgtgtaatttgtaccccccattaggcatccttgtcttttctgcctagccccaacctgtgtgataaggctggagggagactgcattgaacagtttatgtttttggctgagtggttcatcttcagtgcccattgcagcacggctggcatatctacagcaagggctgggaggagagacttctctgggacctcaagtgcagcctgggagggctagaatgtatagctcatgcctttgactgcaagagtctgggtgtgagtgagaggggtgggctctggccaagtgaagcaggctgaggtcagagggaggggaccacctccccccagggaatgcttgcatgacgtgacttcatgaagcgctgatggaagagagctggccacatgccctcttacctccagcctctgtctgatgaagaactcggatcaggaggggaggcccaaccagatgtagtgcctggcagactgccctggccccaacacagggctctcctccagctaacttggcagccctcttccccaaggggacctaggagcaaatgacgccctagagttggctgggacagagaagcgggtccctcatgggtacaggttaggaaggggcagagagatgagggttgggggctataaagatgtgacctggcattattttgttccggtcactctgtattttaacacaaattgtgtgtgggtgtgtgtgggtgtgtaagtgagagagagagagatggggggggaagtgggagagaaagaaacagaggaaagagagggagggaggaagagggagggagagaaacaaagagagagagagagnnnnnnnnnnnnnnnnnnnngagggagagaaacaaagagagagagagagagaaggaggaggaggaagaagaagaagaggaggaggaagaggaggaagaggaagaggaggaagagggggagagagaggagagatttttcctaagagcttgtgcctaggagtgaactaaaagtacaacaaaaccgttggtttctagcaatttgctccttctgttttcaaagctgctatgccctctgcaccagatgcccccaggtcctagtccatggctgtccctgggtgagtggatgactttcccaagcactgcccagatggaggtcctccatcctcttccaccttgggctcctttgagtctttccagcatcccagatggtctgaagtctcaggagcctttggtgtggagtttcttcaacttcacacagccttttccgggatcccgtatctccttttgtttctagggaccccgcccccaacatgttgcttcccaaggtttctcatcaccaggcccagtttcaccaacatgcctgcctcagcttgaggttccctcagatccatctgtttcctaccacatctatctctgtggccacaccagggctccccgatacctgatctttattcctttaactctcccacctgtgccacgttctctgcctctgtctgggccctggccctggctctgtggactgctatgcccactttgcctccatctttccctcacccacagatctgggacttgccttctccttgcctccttgggctccagccatccaagctcagcctgtttcacaccaccccagctttcgtcccttctttgcctgggtgtccccttgccaggatagccctctcctctcttccagtgtgacaacttctgggaaaccttttaagtttgtgatttaagtatagtttgtccccatagaagcttcttttaaaatctgtgccactgtggtggctttgagacctggtgtcctttgaaggcaatgaagcccttgagcgatattagcacctgtttcgtgggagtggcttagtcaggaggcagctggttagcataaagcaaggtcgccctcatctctccatggtatctaccagaagctgtgcttgtgctcctgggtttcccagcccccagaatcttgaaccaaagtaaatttcattcatttgttgatttatttttaattttttgaaacaggctctcatggagtcccagctaaccctgaacctatcctcttctttctattcctcagggaccaagcctggcaactttgtttcttaataaattacccggtctcaggaattctcttagagtaggacaagaccaccacctggagtgtcattatctctcatccctgggggccagagttgcacaatgttttattggattttgtctgaccagtgtctagggcggagcctagcacagagtaggtccagattgcttcttttctggatgcacctgatgagcggcttagctatactgagaatccaccaccaggtccccactgttgttccatgttataggttaaaccggggaagttggaggctgggtatctgtagagagtggttctgggaatggagtgggagaatggaaaggaagcatctccagtgctgtggtaggaactgtggttccaggcacctataatggcttttataaaggggggagggaaagggatggtgggatcgactggaagaaactggtttctagaaagggcgagcaagagcaagtttcccctcagtgcaggtgtccggttgtggggacaggctagtggagcgtcagtgcagtgtccctgtgctggacaccaaggacatggcagccttcccagagtccctgttggactgggtgatttatactacacaccagggtgtgctgaggccagcaagctatccgggcagagaagagggcgttttaaagcattggttccttccagccatggtgttaacccacctggatctctccttgcccggcagggacatcagggacatcttcctataggcaggatttctccttgctctgatggccgcacctactgtgagttagtgctgccctactgtgggcgagctgctgatccaccacacagggactgctgaggcctagcataggttttctccaagctcagtgactgtcacatgattcctgattacaccagatgaggggccgggagcacccagcacggagcctgctcagggaggtttctaggagacagtgggtcttgcttggagtttggaggaatgaggctgagaggacgtagtaatggagttaagaaccctttaaaaggagacggctcagtgggcaaagtgcctgcctgccatgcaagcttaaggacctgagttgttcaagactccagcacccacataaaaaagctggacgaggtgacacatgcttataatcccagcgctgtgggcagagacaggcagatccctagggctcagtggccagccagtctaaccaaaactgtaagctctaggttcagtgagagaccttgtcccaaacaataaggtgaagagtgttggaggaagacacggcaaagtagcctccccctgctccacacacactcagataagtgagcacacctacacacgtgcaaatacatctcacacacgttcacacctctctttaagtgacgttttctcctcttttacttttgaataactgctttactgagaagtaatttatataccatacagcgtggtctcagaacatctcaagagttacgcagctactaccacagtcaactttgggacctttcatcttctaggtcctacctgaagcagtcaccccgcttcaccatcagctctgagcaagctgtcaagcactttctggctcatagatttgcttgctgtgagggttccatacacagcaggtctccaggtgtgggtcagttctcgtttatttgactgcagtgctaccaaccacacggcacagttttgaaggtcattcgttctagatacaagtcctttaacaccgggggctggagagatggctcagcggttacaagcactgactgctcttccagaggtcctgagttcaattcccagcaaccacatggtggctcaaaccatctgtaatggggatccgatgccctctgctggtgtgtgtaaggtggacagtgacagtgtactcacatacatgaaataaataaataaatcttaaaaaaaaaacaaaaaacaaaaacaaaaacaaacgtcctttgacagacacatcgcagttataattttctcccgtgctgtgggttctctttactgctgacactcatcgaagcagaaaaggttgtgatcttgttgaattccggtttgcctgctttcctttcattaccgaatttttttggcctccctgtttgaggtctcgaagacttccttgcagcgagggaatcaaactcgggaccttgcgtgtgatacagtgcaacaaccactggggctacttgagtgccctgttaagactccatccttccgtctctcccatttgagaggctctggcccgtttgcatatggcggaaggaggtatcaatcttttccagctttgagttgggtcccactgattgtccgacccacggtttccccgcttgctaatgctttgccttcttcaggtaggtctctgttcaaacacccctgccccagacagttgctccctgaccttcagtgtctctcctgctcagtctcgggacctcagcacggtcccatgatttctgttgagcccagagcagcggtcgggtgtctgtctcactacctggacttccagtgtccagcacagtgcctggcttctgtgggactcaggaaatttcttttagttaagaagttgctttctcagaggattttgactaaaatctctgagcggtcctggcctcacggtgttggaagttaataagtgagaacgggccatcaagcaacattacattttggggatctcttgtctccccagcccagcaatcccattagttcatgttacttgcatttttggttggccctggtgactggaaatttcttcctgacagtggacagagacctgctttcctgcagttcccactcatctactgtctgccctgacagtcgactggacctgatccccgtgttgtgacagtcctttaaatatccgagaacatgtatcagtgggcactactgattcttttagctgttcctttgagccagtaggggctggttctgacctctctgtcactgatggaggcctggggatggtgggtggcacaggctgccaatggaaacttggacacagacacagctcagagtggaggagtggaggcatctgattccagttgtcccttcttcattagagtggatgagtcccaagcttgtaggcaggattctccaggaagtccagactccctgtcatagacattgagaaggcaaagctgaactctgtaggacacactcttctacaatggtgctttccagttaaagagatgtctggttgctttcttttcttcccagctagtcagtggtctctggaggtttggttggcttcaatgacccccaactctcactgacagtacacccacctgggagctcttaaaacctccaaaaccattcccaccttccaaggctctagtttaacgtgctttcgaggccaaggcagggtggttttaaagggcccgtggtgtctctgtgtagccggagctacaaccttagtttcgggatcacagggttgaacttgaaactccccactgccccataggaatgagcaagggctgatgtcagcacagcatccagagccaggggacaggagacaggggacaggggacaggggacacaagtgttttccaagatcgaaatctcatgttaaattatgaaagccgtacactttcaagcaaaaggaaataaatacggaaatgttcaaagtagaaagcgagactgtacctgtctcttccctgagatctctactctcagataaccagttctcgaggggcacagggccctgcacacttacaccgcagataaacgaacgtggctggctgtgcactgtaggctccactttgttttctcagcatgctacagaagagggcatcttaccatcagcacgtatatgagccataatttttataacttttaaagtcagtgaacattgagtattccttatttttttgcagcagagaatatttttcatacatataccaactctccgttttcctcttcctcttcctcctcttcctccctccctccccccccctctctctctccctcttagaggtccagttgctaagtgcaagaacttgtaagatttaggataggaatcagactcctagatgatgctagagagatggctcagtggttaagagcactgactgctcttccagaggtcctgagttcaaatcccggcaaccacatggtggctcacaaccatctgtgatgatacctgatgccctcttctggtgtgtctgaagacagctacagtgtccttataataaacaaacaaacaaacaaacaaacaaacaaacaaatctatcttaaaaaaaaaaaaaagaaaaaggataagagtcaccagaatgctttccagaaagccaggccataccaggcactagtgtcctaatgacagccacttgcctgtgtcaccagcgaagctttgctgagcacagcagagaggaaggtgtgagtgtgtcagctggggaggaagtggagaggtcacttccctgaaggaccgtgtaagggagcagctgacttctggcctcccctgcgctgcacaggaagcggaaccaaactgtgctcattaacctttgcctggctccgaggtatgacaaaggcacaggcgccctggcaggatgtgtatgttgagggcactgggccagggctgggcgttgattagggagtgtgtggagccagaagttcccttccgaactttgctagagctggcgagtggtggccaagcccatcggaacccagcacatactgcttttgatgtttccaggctgggctctgggctcctcggtgccaaagtgcgcctagcagacatgtccgacatgatagctggacatgtgagctgacacaaaaatgctggcacttgggaggcagaggtggatttctgagttcgaggccagcatggtctacagagtgagttctaggacagccagggctacacacagaaaccctgtctcaaaaatataataaaaaataaaaggggggggcagggggagctggcaagaagattcagtaggggaaagggtttgcctcctggtctgatggcctcagtccaacctgggatcctacaggctggaaggagaggattgactcaggtgtcccctgctgggcacatatgtaccatggcatgcaaaccttggtatgtgcgtagctatacccagtgcccaacaccaaccaaccagccaaacaattgatttaaaaatacggttaaacctgagagagaaagcgcttgtctggagggcttggctaatttaactctaagctcgtccctggctgtgggtcggacctcagctggtcacagctgggactcccctcttctttgggcgctggaggtattagcgctgtctttggagagataatgagaacgaaggctctagctgtgcctggcactcagtgagtcctcagcaaacaggagtggctgttgctctcctcactccaagggagcccatttgtttgctcagataagagcaaggtgtgcctggtggcctcttcaaccatctctctctctctctggggaattgaaggacggagctttgatggtgactccgtcttttcaggttcctcaggctttgtggatcctgggagtgcccagcttctatgtgcatttcccttccaggaaacagggaagaaaagaacatgaaaaaggcctctggcctcacagtatggcaccctgtcagcagatctgtgcatgtgcgtgtatgtgtgacttgaaggtagaagaaaaactgcctagggggactaacagaaagatatggagacatgaggagggagtgtgctttttttcaggactggagatgtagcccagtggtggaagttgcctagcaagtacaaggtcctgggttcaattcccagtgctgcaaaagtaaatagtgaatggataaaaagctttctttttccccagaaatgggtggtactcgtgggcttttaagtagtaggtggatgtggctcaggttctcgagcctttctggggtgactcctgcaggattcactgcgatggtcactcaccctgtggtcactcagtaggtgtgcatgttggagtagaggtctccctctaaatcccccctttaagtggtggctctttcccaaatcttcactgtcacttagaacaaattcccagctagaggaggcattggggttttaccagggccacctctgaggtcctcaatgttttcaggctaagctaaaaatgttagagtcaggagtgtggctcacttgatagtgtatttattatgtagcatgcacaaagccctgagtttggtccccagcatcatataaaccgagtatatagagtaaggcatacttgtggtcttagcaaccaggcagtagaggcaagaggtcagtagttccaggtcatctttgcctattgtgagtttgaggccatatggattaatagacccatattcctaacctatccagcttccctcccccaacccctccaaaattgagccaagtgacatgggccattactggcaaggtttaggactggcaaagacccttgtaccgaatcagaaggattcatagtctagctcttgcccattaagagtttgggtctggggctggagaactcccttcaataagtctctagccacaccttgttgctataaatcctgctattttcattgaatgaaccagttgctatctcaggacccagtacatggaaggccaggagagggcaagacagcttctgctaatagggagaccagggaggggttgggctcccccatgtcaaacagactgatgcaacatgtgtcaagctctcgggtggtgctgtgccagcaattagcaaacaagggtggatgtaatagcccgctgatgatggatcacaagctctgagcactcccagatgtggacagactcatggggccaatgggacccaggtcagatggtggcactcttgagggctccttctatggaacaatgagtggatgtggatagggacttttaatatcaggaccattactgccaccttgagagtcatctggaagacagtatcagcccaggctttggcatagccacttgattaggaatcatacccctggagccctctgcccaagggtggtttaaatttagaggacagcttggctggactggagatttacaggccactctctctcccaacccttcaaggcagatctatgtatatggggcatttagaaggggaaggtagggcttaatgttctcttagatggacatcaacttcttgggggaagaacttagcatgggcccctcctcatcaagaagctagtgcagtatccatggtccctttcattggcttctgggttgtgttcattctggtttctagggccatggttttgaacccagtttaccttgaatggtaggtttcccttcatccgtagactccagaagatctgaagtgattctgtgacctcccagatcctaaaaccggaatagcccactccaggagcaatgtacaccccccccttttttttgggtggctacagccccaaggtggagcttgtagtttgcagactataaggtagattagatttcctccctacttggctccttgactgggcaaccatcaggtagtgaagacaacttgcccagctatgttcgacggccctggtcctagccacctgatgccagagccgtgtgcaagcaggttggagagcattgcaggttggagagcatcgcagtggagtttccatttggcctggggccatgtctgctgggcatggggccagggaaaataaggccttcctcagtaaactgcaaccaccatgtgtaccacataggggtgcgcagtcccctctacaattccagctcttctccccttgttctactttctgtgtcaaaagcagcaacagacattagtatttctgatgaaacccaaaccaacccttctaggtgtggttgggccccatctttgcagatcccattctgaactcccctccagagactatgcttctttcttggaactgacctgcaagggatttgcatcccggtcatgcaaatttactgacctaccttcaaatttgaaggagcttggttcctagagggcagcagaacccactgggcagacagggtcagagagctcggatgtggtcaggcggtgtgtattcagtagatagaatgacctcggaatgggaggtggcctgatgaggtgctgtgctgattgcccatatgtggtgtccctgctgagggttctcgccctttagacgtgagctgcagagaaacatgatagtctggctagtccacaggaagctgcacatggctactggtctttaaggaggtttcctatttgtctaccatctgcctgaagtgaccagagaccttgaaatggaatccgtgcatttttaaaaatccagaagaaagggaaactccacacaggaaacataagcccaaggagctgtgtttggaatcagggtgtttaattgaagcccagctgctgggtaatgttatctggcagctcctgaaaccagaggggggtttatctgtaggggtaaacagagttggctttctccagtgacctctgccctctccacctcagacacctgctctttctccaaaactatctctaaagcagggccagccagagtgtctttaagaagctctggtgttggggtgaggggcaggagtgtgctggggcgaggttggaattctcatctggagtgataatcaaggctctatctaaggccgggaagaaaacagagcaagtgtcctgtcacgatagagtctggagtccgtcttcagatctctggtcttatctaccagaggaactgtctgcttccaaggctactgacctatggcatacgtgtcccagaagtttaggaaaacctggggctgggagcgtgagagatcagagatctcacagtcaatgaagtgggctgtgagtgagatccagctggggctggctccagaattctctcctcacttggccatctgccacctgacaagtcgctgccttgagccccagattccacctctgcccaaaaagcgacctcttaccatgtgccctgtaacaactagcaggcctccttgtatctcccagctagcaggcttcctgcgtctcctgactaccaggactgcctgcttcatctttccagcagcccggctgggagcctgtgatttatactccctgggaggtgaaagggaagcccgtaattcccacataggaaggagcatgggtgttaagccccagttaagtccttccccagctccgcttcacaggccctggagaatggtggagtttaatgacctgcaggcaagtccaccctcctctctctctcctagtgggcttggccgcttggggacaccaggcagcacctggtgcagggacacacctgctccctgtggagcattcgcgcaaggagacagtcaggtggaagaggggtgggggtggtagggtgattaagaccctgatgaaaaccttgctcctcttccagggtagcagggagctgctgtgtctgagcggtggccggcttttgctgcctgcctgaaccctgatctctctctgatccccaagttctgtctctggttgttcatgggctctcagtgcgcctttgactctccctcgttcctctaggccagtggtcctcaaccttcctaatgctgtgaccctttaatacagtttctcatgtcgcagtaacccccaaccataagttattatcgttgccacttcatagctgtaatttcgctcctgttatgaatcgtgatgtatatatctgtgttttccaatggtcttaggaatcccctgtggaagcgtggttggacccacaggttgagagccagtgccctaggcccttccctgctcagacgtatccagacttctctgttatctgaataaagctttaaaagatgtttagttcctatttcgtttcctatagtcatttgttttaaatatctacagacttaaatttacataaagaggactaggcccgtggctgccaaaaagtttttttttttctctccaaaattaaagtttaattagtattgtaacaataggagagggaggacctttaaatagggcacagccttcttgaatggctagatatccttgtgctggaactggcttcatggtaaagtgatgagtttagccccttttcctctttcggtctcttgaactcaccctgttctctgtgcccaggacggctctccatagccgccggcaccatgctcctgggctttccagcctccagagccaaatcagcttttagtgtttatcatttatcctacctcaggcaatggtagaaaactaaatacccagtatagaagataggggaaagactcagatttggttcatgtcttctacagtgtatgttattagctaagtggctttacttagcatctctgtgcctctccttcctccagcaccgtctggggataatcattgagaatagatcaaatgagctgatacgtgtaaatactttataccacaccggcatatagtaagttatctaaacacgtgctatcgtttggatctaagtgattttgtaatttattgtatgagataaatgtttgcataaagcacactataattcatgtgcacacacacacacacgtctgcctgtctgtctgcctgtccacatatttatttcggttcatctttttctcacacagggtctcataccgctgaggctggtcttgaactcactttatagtggaggatgaccttgaactcttgattctcctgcctccacctctcaaatattggaattataggtgcctaccactgtgcctggctttaaaaagattcttattatttttcactgctgagactagagctcctggtcttaaatgtgctgggtaaatgtgctaccactaatctatatattcaattcatatttagtacaataagctagtagtttattctgagcatatgtgggcagggctggcctttaacttgttttctttttttttttttttccttatcaagacctctgctcattaatactccatttctcggtggtgatatccccccctaatttcctggctttagggccctctccttgattgtctttcagagtattctccgcaccatgcagctaactgtcttagttacttttctgttgctgtgataagccaccatgaccaaggcaccttataaaaggaaacatttaattggtcatacagtttcagaaggttagggtctccaatggtgaagcaaaggcacacagtggccagagcagcttctgagagatcatgtcttgatccacaaccacaaggcagaaagtgagacacggggaatgatgtgtgtatgagtcacacacgtcctccaacaaggtcataacccctactccttcccaaacagttccaccaactggggaccagagccttcagacgtacgcacatatggggccattctcattagatcctccacgctgactctgtgacttagcctggaagagaaggaggaacagtgctccttcaccaattaacaggccacctccacactgcaagctctgctgtctaactggggacttgcacctgtctgtccacagtgcctaaatgagtctctttgctgaagtttctcctcctgtagcccaggccctggcttctctgactatagggtgttcattagaagaaccccacagacctatggtgtcagaattatttaccagtggccttggtccctgaattcctgcagtgccagagtaattctgttggacgtgcagatatgggaacctttgctggggagacttttctgtccccagaggtcacctcccttgtgtcccatctgtgccaggggaggtcagcagagtagccccatggctgagggtgtgtgtgtgcagtcttcaaaagtttacacttcttccagggctgtaggaccggaacaataagattccacacaatacgttgtgtggacaaggagctttctctccttccccagagacctcctgaactaggtggccttccttggtggcctgaggtgcagctctgtgtagtttaccaggggacagcctagacttggtgcgcttgccttgtcgatcttccatgtgtgcacttcatctctcctgtgaagttgcttcttatgccagacttgccagcgtcctaggtcagtgtgacaactctctgtgtgcatgctctgtgaagggcagtgagcctggttgtcgggaggctggctgtccggaggtcaaggtgagccacatatctctggtctgcccaggtctgcccatgtggaattttaaagtgtgaggctcatggacctgcaatttggaaggaggcttcacagaatctcattcactctgaggtagacggagaaatgtaaatcagctgtttcaaaaaatgtaatgacctcaattttatgtttattatccacaaataacacttaacctgtttgttttaaccctgtactcagagaatcttcattatcatttcagtgactgcttcttcaggtgtgtgtagagtgtgtgtgtgtgtgtgtgtgtgtgtgtgtgtgtgtgtgtgtgtgtggagtccacatgtttcctggccctggtgacaaatgagggggaaatggtctcagctgtgacactcctacagtaatattaaacagtgcctgcagcccagtcttggtcacctactcacctgcttctcttttccctcaggtatacattatcaacgtgacctggtctgactccacctcccagactatctaccggaggtacagcaagttcttcgacctgcaggtgagttagcaagaaccagctggcggcttgagtctcccatgggttcctcgttcatgtccacatctcactggaaggccctggacagagccaagaggcagaatccagtctggcacagaggggcagatgcgggggaccctatcgagcagccaggggcagatgtgggggtccctaccgagcagccaggggcagatgcgggggtccctatcgagcagccaggggcagatgcaggggtccctaccgagcagccaggctgggtactgtcttgactgctacatgcagacacttaaggctttgtcgctttccaccatggcccttcacagtcttgctttgtcatcctcccttggtcttggggtggaaaccgtggggaggcaagaaggcagttgtgggtgctgtgtgcctgagcagacatatctataaacatccatgatgagacacaagccaccacatcattgctagtaaagaaaagcaaacacacagagaagaccaaaactaaataagcaatttatagaactacatgctgggcatacctccgggtctgccttctacccaaacaaggagcttgccacccagctcgtacttgtggatggtaaacgtgtgtctctaacttagacagatgtgtctcttcagcaacacagtagtatatagccacactgtaaccattaaacacacccctttgatgctggctgatccgttttagggtcttttggtgacagatgagtattttatactcacactgggcttagacaataatatttgagaagttcgtgcagttgaccagatggtgagaaccagcctggggcggtagggcttccgcaaagcccaaactaggatcagctgtccctgtctagtctctgcttctcttcaggactgtcgatggcccttagtaattcacaccctgatgaactgagccgtcatagctcttgcagtttacatgtggctcccactatcatagacaccgaccttctcccttttccatatggataaatccagaggaagactttggtgaggtaccttctttggcctaatcggaatgcccagaggtaggaagggtcttggagtgtagacatgagccttagcagggtaaatgggcgtgtcacccttgcacatcagaaacaagtgatagagtattatgtgaatgagcagcattccgtggtggtggtgggggggggggtgccgagaaagtgggggtttcttcccttagaatgtgagtgtgatttagaaccacaaaaacacaaaagaagacgcagatgttcctagccctcacagccagcagccctggaatgacttcacttgtggccaggcttgtctgagtgggttatcttctgtgcatacaagttccacacctaccgggtcagttacattcagatcaaagatatgtagtccttccctttagccccttagcagtgggccatcttggagagggagatgcaggcctgtgtgtttgtgcgtcagcgcctgctttgatctcatgatgcttgtcactgggagacaaaccttttaaaaagccagttccccaggttatggatccttctgcttcaaccacagggggttgaatttgtcactgcgtgtgggaataggagcactcatgactcctgcctcttcccctctcagccctgcccaggctccttaggtctttccaggataaactggtgggctttgcctgcaccccatcaatgggtacagtgtgcggggacaggaaatgataatgtagtagggcagagtctggaccctgaaaggactcattgatcagctcgagggagtctagaagcctggggaaaccttcccaatcagaatgtctattctggccccaccccctcccaagttatagaatcgcacaagaatctgccctccacccctgacccctgcccgaggactcactctctcctgtcactgtagtggggggccacaagnnnnnnnnnnnnnnnnnnnnnnnnnnnnnnnatcccaaaacatgtagagagtctttgccatccattattccacagtgcagcacagtagcagccacttgagtcggaggagttcttaaggcgtccgtcccttttcatcttggtggcatccactcgtacactcattcatggctatggcattctcagtcactggggctgctggcctgacaaggtgacttagcaggcaaaggcaggcttgacggcctggttctatctctggcagccatcaactgagcatcatccatcaacttgaagccgctgtcccagagcccctccgaaagcccagagaaggcttcaagagcattttagatgtcaaggtggagaggcagggccttgcttcttctataaatagcttttaactcggtgttctctcagcaggagagggacctaccccacagggagctgaacaggttatgctctcatgcccaagtttgtttggttataagggatctgcctggagatgaccttgggttaatcagaaggcaggcaagtgaccacacatgccccttgttcaatcttccatttcccatgtctcctccatgacctagccccaccaaagaaggacaggacaggggggctcccgggccctggctccattggtgacagtttcacaacctggcctgccagccacggggctgcagtaatttctctgcaaacattggctcatgtactgttggcccccaagagggtcccctggcagtgagtgcaactgggtcaatatttggtcagagccaggaaaggcccttaatcttcccatgaaccacttggaagacagccgagagcggctggaggctacttgtttgctctaagggcttcagctgtgtggaagagcttttctctctcccttattcatctcccctgcgctttccgtacacgcaggcatgaacgcacgcatgcaggcaagcaggcaggcagcgcggccacagctcttgaatagcctggactgatgtgctgtgtgtgtgtgtgtgtgtgtgtgtgtgtgtgtgtgtgtgtgtgtgtgtgataatattatttatggacactcatggatcactgcatctttagaattagaagagttcctttctgtaaggtgtatgtgagtgtgtatctgtgaaggtgctgtgtgtacgtggggtacgctgatgagcacacatgtgttcaagtgtgcagaggctacaggaagaccctgggtgtgagctatcgctttccacataattcctgtgagagccttccgctgagactggagctgggctggcagctcgtctctgctccccattcccatgctgccccaagctctgggcttgcagactcaggcagccgcactcaaccttgtacgtgagttcttggatccaaactcgagtcctcagtgcttgtgcagcaggcactgtcactcactgagcggtttctgcactgcaggcgccagcacgacggtcgctttctattctaaggcctttgctttgtaggtaaaaagctgttaggttctctattcatgggaaatgttctgtgtgtgtatatttgtgtatgtatgggtgtatgtgtgtatgtatatatgtgtgtgtatatgtatatatgtatgtgtgaatgtgtatgcgtgtatgtatactgtatgtatgtgtgtatgtgtgtgtgtatgtgtgtgcatatgtatgtatgtgtgcatgtgtatatgtatgtgtgtatgtatgtgtatgaatgcacatgtgtgtgcaggccagaggctgacactgagcatctcccgctacctcttcatctacctcttcatcttgtttattttgagagacaaggtctccaactgaacctggctcttgatgattctgctatattgattgaccaatagagaagaacactgagtctagatgaaagccatgtgtgtgtacatgcatgagtgcgtgcatgtacatacgtgtgtgtgtgtgtgtgtgtgtgtgtaggtcagaggacagcatgcggaactcagttctttcctcgtctcctatggattccggggttctagctcaggttgtcaggcttggcctggtgtctgctgagtgtttcacctactgaaatataactattttaaaagttctagaaggatatactccaaattggtgaccattacacctggatggatattagggacatcgatgggaaggagacctagtcaaatggagaacttcaagctcatctgtgaaaaacaggataataattaaagggaaatctgaggagaggtaggaaagtaagaactctaaaataaaaaatgtctctttgcagttgttacagtaatggaaaacaacaggcttgataaatttgtatcaagaatgtatcttataagagaaagaaagtgaaaataataattttaagttacattacctcatttttcctagaccttcattctagatcattcctgtggaatgtaagtagttagatctcattataacaaccccagggagctatccaaattatcttgtcaaattggaatcttgtgttcagatattacttaaaacccctgagccaagcattggaagaggcagtccgttaactggcagcggtgctctggtcctgatgatgttgccaggactgagatggctgggttccaaaaccaagatctagcaagcctttccgatgataaaccctccgacgagtcctttaacctctctgtggccctgttttcttatcttaaagtgaagtcattataaagacccgtctcctcggatcatagaaggaacgaaatgatagattgcatgtaaagaaagccattggaaaggggagggtaaggttcttagagacgggggcagaagcttcatgagctcagagactggactctaggaggaggtaccggggctccccacgccaaccggagtcacaggctccttcctgtgcccctaatgcagacctcactttggccagatgatgtgcggtctgctcttctgctggagacgcagaaggcagagagaagatttcccttagagaaacaaatacttttcatctccactgtctaattaccaacctgcttcctccccgccatgctgttaggagaacactaggctttgtttttgtttttaaagatttatttatttgttttatgtatatgagtgcactgtagctgtacagatggttggttgtgagccatcatttggttgctgagaattgaactcaggacctctgctcactctggcccaaagacttatttattgttatatgtaagtacactatacctctcttcagacacaccagaagagggcatcagatcgcattacggatggttgtgagccaccatgtggttgctggggtttgaactcaggaccttcggaagagcagtcagtgttcttacccgctgagccatctcaccagccctgtgtggttttttgtttgtttgtttggttggtttttttttttttaaaggagttactggtctacagtttttctttacccttgttggtggcagaacatggaaggattccagggaagccctagaggactccattggtccctggtaattcctttcctactgggagctgacttcagctccttttctgtgcctctggggctcttaagtgaactccagcctatgtctttcccctggcaggtcctgcctgagggagggcgtgccagggcagggggatggctgtggagggatcggaggtgagggagaaatggtccagaaggtcattcagctcagggtgggaaagcagctgctaacttttcacttttgagttaccttgtagttgggtccactggaggtctttggagcagggggagctaagtccccctctgtcccatcccaggcacatgaggcttgctggttcctgtgcaggttctgaacccttgtccatttaggaacacctttctacagctggggcttctcagatccagaggggctcagaaccatcctgacttagaacacacagaaagggtagggcaggaggggacagcgttggagcgggttctcacacatctgtgagaaaagggaaataagacccagatgtgggctgaggcttgagaactgtgatcggagtcctgctctcaggagaacgttctagctaggctttccagatgatatgaagcagccggagctgtgcggctgcccctgcacctaggcttctccatagaaaccagtgagctccccttagggggctgtgctcattggatccaggcacccacctcttgggtgcaggacctagcagatgtcatggacaattgcatgaccccctccagccggttctgcctctgtcactcccttggctcttccctggggtcagggtggacttattaacccacgctcaggaagttctcccttagacaggaaaatcataacagaagttatggtgtcttttgtcttctcgtatgagcacagactgctcattgggtctaaacttctaggggacatcatgaatgaggacacagcggggaggggtattgcgtgtaccccaagtcctgcagaggtgctgagagtatgtctcggctggagaaattatctacatgtgagaggcacatgcttttcacaaacctggtgttagtattctcacaatggaaaaacaaacaaacaaaccctgttcactgtggaatggatagaattgtgttttatagtgagagccctttagagacaacaaaaggtgattagtatctgacattcaagttaccttgtcctagcatgcccacaacagacaacattcactgattacacattgtccctgactaagtctgtgacagacattgttaatcaaccatgagttcatatgcatctcagagtctctaaaagaacaacaccgggtatcttcacgatgtcactcatttagccaatgacctttgaggtgaagctgactggccaccttctgatctattcccaccctcttatttgataaatgagcaaattagaccccccccccagtctaattttggtgttgtccaaaaatcatagcaccaggggcctggggaggtggtggcccagtggtcaaagagcttgctctgcaaacttgaaggccagtgttcgatacctggatacccacccacatatgtgccaacgagtgtgtctgctcccctgtaacccagctttgggaagcagagatgggatcgccagagcaagctggctagcaaaactagccatgtcagctagtcttgattgacagaccctgcctcatggaatgaaatggaaaagctattagggatggtctatcccccaaatcaacctcaggtgtccacatgtgtccacatccacacatatttgttccgacacacatgtaaatatgtattcacagatgtttaaaaatggaaaaagagagaaagaaaacaaacaagactgtccccaaatcatggcaccaacaagtcagtaagacttgggggtgccccaccccttccccaccccatccccaagcttctagttcactccagttgggatctctctgattttggtgaggagggcgggaactcttgatgccgcatcattgaaggctgctaatgggggggctgggtgcccgctctcttgactgtgccacgagcagaactctccgaggcttctagaaaggtcttcccaagcagtctgaccttgggctctggtgctgcctggccctcagcccacaccgcctccctcttactgaacaacaaacccaagctccaccagggaccaagtctgcgtgagtcagcgcacaccacctgtgcctgcttggagcagcacaccttgtttagctggtgtaaggtgtcctgctggggtgtgtttgggtgttatgcgcagggaggccttggaatgcagttgccgccccacgaacctccctccttggttccaggcccaaaggcttggcctagaaaattcagtttgtcttcactgagcccccgtgtacccctctttggagggaagccggcacttttgcgtaaggaggtggctcaccactccaggctggaggatgaagggaaggaaactctttggtggtcaggtgagtgtgtgtgtgtgtgtgtgtgtgtgtgtgtgagaatgtgtatgtgagtgtgagtatgtgtgtgtatgagagtgtgtgtgtgagtgtgtgtgtatgtatttgaaagtgtgtgagtatgtgtgtatgagtgtgtgtgagagtgtgtgagtgtgtgtatgtatgaatgtgtgtgtgagtatatgtgagtgtaagtgtatgagtgtgtgtgtgtgtgtgtgagtatgtgtatgtgtgtgtgagtgtgatcagttcattctttacctgccagagataatttcatgtctgtcttggtacctcctgaggacctcagggaaagaggccggcctacagctctggtttaagtggaagcatcagccagtggaagatccaagtaggacagagttgccttggtgacgatgcacggagtggagtacccatatgggcctgtgtgctatagcatcccatccgtgcaggtgtttcctatcggagacccagaggtcttgacattctgtccttactagctccagacagggcaaccattagttttgcttttgactctgatggaactatacatagggagcagctaggataagggatgacaacctgagttgtgggcctctagggggagagtcagcttgtcccttgaggagaagtgaactatatcaactctgcttcttagcaatcagcctccagggtccgagcctcagccgctctgcatccctggatctgagggatgcttgttcaagtgggactgtggcaggagttactgaagaactgcttctattaagctggagccagggaaaggcattcgcctccccggagacctcctactgttggatgacatctggctctcaagggcttgtaggattcctggtgccaaattcctgttgtcctgagtgtgtgggggggtggggggtggcagaagctcagtcagggttagactcacttgggtttgggcgttggccccacctcttactgctgatcgtctctaggccattgcttcacttctagaactctgcacaattgtatctgcatcactggtctttgcagaacctgcttctgtggctgtgaaatatttgaagggacaaagcacaggagatccacctcactgagcctggagcagccccaggggcattactattataggactgtgggtgtagattctctggaggagaattcagggtctccaggtgactgccagtgcctgcccacctagactcagggaacagtttccagctacaaaggggtattgggcatttctggcgccggggtgagggagtgttcctgggttggcgaggggatagctttcaaggcagccgaggcttggctctgtctgctaactagggagccttcatctgttgcctggccgaacagagtggccagttcagccttgctggaatgccggaggatgggggaagtggctaggcaccgaggggggtgggcttggctaaatagatgacattcagatttacaaaataaaattgaaaagaaggaaaactcaaacaggaagcatgtggctggtgtctgggccggccgggagatgcttgcagaggtggctctgtgtgtgacaagctggccattcttcccactgtgtctcccaagggcacctctgtgaaggccagcctgtctccctccccagtgagacaggcttcttttgtcttgggcttcctagtgcctctcgtctcaacttggagccataggaggaggactccctagtggaagggtggagagaacccttgggcatgtgcccagtgcctgctggctgtgcccactcctttccccatcagggccgttcagtggagttgcaaccaaagcagagggtctgagtagaggccaccgttccaagagacttgttcaggaggactcagatctatagttgccatctactgcatcataggtttttagtgcatgttgggaaaggatggatgccttcagagggcccttctttctctcccgggggagaatgacggtttactgccctctctggaccatgctgtgtctgggcccctgtgaatgcagcgagctaacagcgacctctcctacttctccctattctgtcctaatgggatcacctacctgttccactgactaacatcttccctgcttctctagtgtcatgcttgtcctcttgctaatttaacttaaaaaaaaaaaaatcaagagtaggcatttgcctagtaaacagagtggctcttggcagggtcaagctggaccccggattcccacagccccttgagttggcagccgcctgtgttgcttggcttcaggagcaggttttcagggtttccttctgtcagtgagtggaagctttctctaggcccagctgctgtcttcacctggagggtgacaccagagggtatttgcggaggactagctaggggcagatcgttgtgtctggatcaggccagagtggagacagctgggctgtagactgacctggaggcggatgacgtgtcaaacccttgtaagtagtacttgtgcatctatggtcccatgctcctaacccagctgttgcctaaacctttccccacatcctcccctctctcagcccttcttcccctcctctcagtttttgcaccatctctcacccagaggagcctcttgtttctcagggccacagccttcttcccaggtttctccagcattctagaaacgtccccgtactgcagtcagcttttttgatggcaaatttccagtctcttctagggctacatagtggtgagaccctgccgcagaaccctgtttcacccctgtagagtacgccaggcctcagtgggcctcttgcctagagctaacacgtggaacattttgctgtgttattgagaagtgtctgtagatcgaatgttagattgccttcctcctgccttgggtggagaacagtggtgggaggttctaccaagcagacagaccagcaggtgggaccaggggtggggctgaggattgtaaccctgagaggaggccgggctcagaggctcctggggaacggaagttcagaagctggggcatcttgggaggtgttgagtgccccctactgttgtggccaccggagtctggatcccagtcaggcctgctgacaggtgccagagatctcactgtccccgtgatggtctacccttgtacttcctcctgttcctcactctgggtggatcgatagccccgccgctgggtcaaccagaaggcagtgtggctactggaggggtgacctctatctagcctgcagggtgggctggaaggtccccaaatgttcaggaacattttccctgtagcatttcctggtacctggcgggaggacttttccctacaggaaagtctctgagccgggcccagctgggaaggtgggcaggcccagctcactgagtcattccccgggcaactccacccagctttgattttctctccgggatttctcttttcccatccgagttccattttccccccaactccccccacccccagtgtggacagactgcaagcagcccttgctgaagaagattccagagggagatgactggagactcctgtgggccggagatcagcctctgtatgcagagaagcccttaaatgcaggatcagcacagcttcgaagccatcagaccagctcataggagcccctgaggaatggcaagggattcaaggccatttagggaccacacagacccaggcagacaccaaaggcccaacacaaagacagctgcctcttcctctcagaccaccctcagaagacggtgcagctctgacggctctgtgcccacccaggcagctttctgccaaccacacttctcctcctcagagtgacagaggctgtgtcataccatggaccttcgtataaccattctgtgagacctgctgtcgtttcagaacgaactcttaaactcctgccccaaccccaagtgatcagttcatgtgccatttctaactgatcctgtttcttctactgtcccccagatcctgcgcatgtgcactcaaacacacatataccacacacatacacacacatgcatgtacacttgagcacatacacgcatgcatgtgtatacatgcatgcgcacgaacacacacagagccattgtccagacatgggagcccagcactaccccagagccttcacccctgcccccgctgtactctctcctctaacccccttccccacatcttacagtggaccccctaagcactgaggccttgggtcctatgtcctgtcagtgagacctcctttgaccacatctgcctaccttgccttcaaatcacttgtctcagcctgttatcccatcagccatttgcttactctgattttccccacaacgtgggaacttcaggagaagaaatagccccaaagctttaattttttttatttttccattctctagaacagtgtcagctgggaaatccttgtcagtgacttctagagagtgtgtgtgtggtggtggtggggtatggggtgtgcagagaggggctgcaccctcttccaccttcaaaggcaggtgtgttcagtttccactcctccgggcagctcttgactttgtctacgggcagctcccaagtcacttgttagagagctgatggaatccttaggggtgaagaacattagggttcctcaagttcgcagcgtgtggaaccactcaggccgttctgcagataccggtttaggtgtagcagtgtgcagggtgatgctgcatcttccaggctcttagctgatgtccgcactgctgttctcaggaccgcatcttgaacagtgactggggtccctgaaggaccaatccaagcccctttctccatcctttttgttgtttcttttttctgttcaagtgtgctctttgggcaagctgattggttgatcgtggtgataaggagggaattggacctgggggacctgggggatctagaggctgcccagggaagatgtggactgccttgcagaaatggtgggtcacacatcaggagtgtggtgcctggctgaggaggaaggaggtggccagcccctccctccagttcagctttgtgtctcagtgacaggcttgtcagaccaggttctccagctgtggcgtgttcacatctggaggcagggcaggcaggggctaggggaaggatgtctggccttgtgctgaaggaggttcagtacaggcactgtgctgcctcattgctgtgggtccagaacatttccagaagaattctctacatttcccagtcttcctgctttcaaagtggtttcgggggaccttgattaaactccttgtgttgggataatccaattgctttctaacaagtttttagtggcttaccataagaaacattcattttctgttcacatgagtcaacggagggttcagctccaggcagccatctgcagatccatcttccaggtggaagttacaaaggagaatgtggggaaatcctgggagttttactggttgtgcctgggggaggttgtgtggatctcacttctgttcaagttccaccaatcagggcaaagtcatgtgactgtactgccagcaagggaagatgggaaatgtgggttagttgtgtccagttgtgttatggccaatgtggtggactttgggactttcaattctgagacctaggtattgacaggtggacaggcgtgtgaaccgatccttgtgacaagagtgacgttccaggagcttgcatggccgctctgcagaagccacctgcagagggggggagctgtggggcagtgtgctaatgaggaccctaaacagccatgcagtgcgagacgcatgggaggcaggatacatgacaacgcacgccagcggtgcagaggtggcaaacatgctatgttggtgccacgtggatgctgggagcccaaggccgcagcctgaagagctggtatttacttggcaccgtgattactgggacattggtgacatttgtgtggttgtgaagtttgtaatgggagaaaggggagcattggagaggtggcctcctcaagttactagttcagacagtggccctggccagaactcagatggcctatgtgtccttcactggacccccctgtctgtacagacaataatagtgtctttgaggcagacttgaaccttatgctacaaccccggcgcttttgctgcctagaaaggcttggttgggtctaactcaccgccacagctgctttctaccccaaggcaaagagaagcgagctcccggaaagctaaggttctcgtttcaaggggagagatggtgggagctggcctctgcccattccacccttgccctctcttcagcctgttcttcgtttttccttttgcaccggacatttgtggggaaagagctcttaaagcctggaaagacctccacccttgcctttaatctcagcgctcggggagctagagggaaacaggtgagttgaaagcaaacctggtctacatagtgagttctaggacagccagggctacaaattgagaccttatctcaaaacacacacatgcacccccccaaaaaaatttggacagagttacagcagggggaagaagccacttgaatacagaaagaagttgttttgtcatttaaacatgtcctgccttggcctcttcccatcagggggcatgttacagaccaggccagaatgtcattgccctggacagcagtttgaccccagggattggccttggcttcatctctgctctctgtcccaaactctgggcaggatttgatcctgtggtacccagggcagtttgggaaccacagtcttggccatatggaaggtaaggatcagaaggtagggcttggggagggctccatgccattcaccaccacccccttctcccatcctcagggcctcttttacttttactttttttggcaggggtagggaatattctggaaggttcatgtgggagagggaattgttggcaactttgggaagagttaagagaggtctctggcaggttaagggactgcagacccctgggggggggtggagctgggtgaccacagccttcacccagcagacttcactctctgtgtgcttgtaaccagccttaccctgacctggcacagcgttcctctggccatctgctcccttcccccaaatgtctcttttaccgccccccagcctatgaagaagccagatgtgtctttctagaattccactttcagtgtgttcctcctccgctccgagtcctccagggactccctgctgccttgagcaggaagtccaatttcctcctctcagattcagccctgtcctcaccctgcccagcgcacccctgcctgcctgccctccttaggatcaggaccctccagcacgggccaccttcctaggattgaaggaggaagagcctgggagtgccagcagtggctcactgcaggcttgggagcggggagggtgcatgctctctagtggttagccatgctgtggcctgctctctcctcccaggccaggctggaagctggacaagtccacacctctgcctaccagctttcctagtgctctactgccctagcattatgcctgcccttccctcttggccaaggacagctggagttgtgtagactaacgtgctgggatgaagctaagagttttaggatgctaagggttgtcaagtcatggaggattttcctgaaagctaaagggttatactagaaatgggatggcaccaaggaatcaggagtcagtcttcaaacagcccagtaaatctgcagtagctcacttaacccacacaccactctgatgctggctagttttatgtcaacttgacagaagccagggtcctcagagaggagggaccctcaagtaagaaaatgcttccataaggtcacactgcaggcaagcctgtagggcagtttttagatcagtgattgaggggggagggcccagcccgttgtgggtgtggccatccctgggatggtggtcctggttctatgagaaagcaggctgagcaagccatgagaagcaagccagtaagcagcaccctccatggcctctgcatcagctcctgcctccaggttcctgtcctgccctgtgttcctgcctgcactgcttttgttaatgaactgtgactgactcggaaaacctctgctgctcaagggagagggaagggataagataatgtgcctggggttcagcagctctttctggaatgtttctgttacagcgtggatatggacacagcagctcaccagtggggttcaccagtggggctcaccagtggggttactgatgcccagagaggtatccggggtcagcaagtcctctacaggctggagctggaaccctcctcttctcgactctttctcctgcatgtatgcagggaaaatgagcccacgggagtagactggggtagccagcctgcttgggtaccgtactttaggctccagagcgaaggctcacagtctagctgggataatactgtcagctagccattgatgtccttcttctcagcaggtgctgggggattggcccagcctccaccatgttaaatgtaacacatgacgtggccaaccctacacactggctgaactcctgggatgcgctgaggtctcttctcttgagtctggcccacacacaccagctgggcagctccctggggccctggatactcacagctaagtagggcctggcccagacaactcccaccatctgctccccagtctacccattgcctcctggacctcagattggagactactggtcagactgcactgctgtccccgcctaacagacagggagaccaatctgtgtgtgcctaccatcgcagccatgtttattcttcatgttaactaaattgttgtgccctaccacggtgactccagccaggcctgtgggaggatgaggagcaggccaaacgttccctttagtggttacacattgtcttaaggttgtgtgtgtgtgtgtgtgtgtgtgtgtgtgtgtgtgtggcggggagatgaagagtgatctgtgcccattctgtacactgatgcgtaaaccgcaggacctcaggacgaccgtgtctggaactagagtccaagtaggcgtgattcattgagatgaattggaataagtcaggcctcctgtgcagcaagactggcaatctcctaaagggacactgggccacaggcagaggcatgtgaagacaaaggtcttcgacagccatggagtgtcttgtgtggcctgaatcaccggaaactggcagctgagtcttcctcagagccctgacaaggccaagtcctgatggcaaaataacacagtcaggcctggtggcctggtggcctgggggcgtaactcagttagtggagagattgcttagcacattcggtgtcctggcttaaactccagcacaatgtaaactgtccgaggttgcccttgcctgaactgagaggtggaggcaggaagagcagaagttcccagccatcctcgattacatcacgtggtttagaccaagccaggcttggcctatgcaagactctgtcacaacacactaccacgttggaggtgacatgggggggagagttatgtgtgaagtgagagtggcctctagaagctgacaagacatgggaaggttgctttctggagcctcaggaggcgacagctccgttcagctccgcctgactgggtggagatagctgttcagtgagccttgctgctccagcaggctctgaagtaagtctcctactactctgaacccccagagcccccaacagtgagcagcagtcccctctagctgacttctggcaatgacttcctctcatctcttcatggctagagtgggtctctcttgccagtggagaatgttctagtactctgtattttgtatttcgactttagcatgttatgggcctatgacccaacaaccaggtcatccttgccagggcagaaggaccccctctgctctttcccctttccctggcttccttactgtttgcatgagtgttaggccagctgcacgaagtgctgtaataatgttgagtgcttgtatccaccccacccgccataccatcctcagccctagcatctgggaactctgagtgacagctccacttgaggctgcccctttctgccctacagagcacccagcactgccatcttctccagtcttttgtgagttgcagcatcttgaccatttcttggactgtagagggtcacctggttagccagtgtggttctggagcccaggttacacgtgtctgttctcctttgcgtatatgtcttaaagaatgggggctggggtatttataaatacacctcagggagaggcagtgttagcagcgttccctccactccacttgcccggttcttctgtcctatggccttgctctgcctggctctcattctagtcagtgttaagatcttacttcctccttcccttcctcctctccttccccctatcctttcctgcctcccacttcctctcttcatttttactgtattgtggtgagatatactaagcacaagatttacccttgaacctttgcgagctgcatagttcaggggtgttaagcgtgtcccctcgtcgagcatccatcatgttgtcttcctcaggtctttttcttattttcacctcaagggtttcatgacttatcctatccagggattaagttgttcttcaatgagaaccctgacaaaggtccaaaggtgtgcatctcttgagacatctctgagtctgtttataacttcatattggttgtgaagtcaacagtttcatttcttccttcccagccttttcaagaagcccgtgctgaaggctgaacccagggcctcacactcgataggcatgttcttcctttttacactttgttttgagactggatctcactaagttgcccagcctggccttgaactcatgaagtagcacaggcaggccttgaactttcaatctttctacctcaacctcccaagtatctgtaccatcagacccttctagagtttaatgtctctcaacaactcaacaatctcaatctctttctctctctctctctctctctctctctctctctctctccttccttccctcccttcctctctctctccctctatgtgtgtatacaagtaacataacaagtgaaactatgtaaaatcttcattgacaatactagctgcccaaattaaaaagtggaatctcaattgttaagataactgttatgagggatgtgatagcacgcctttagtcccagcacttagggtgaagaggcaagtggctctctgagtttcaggctacctgctctacagagcgagttctaggctagcctgggccctgttttacaaaaaaaaaaaaaaagttatttcccctgaattggggtgtgaattctatgggttccttcctcccccacctcaggagcttttattttatgacagtggttctaaacctgtgagtctgaccccttagtcacagggatgacctaagacttatcagaaagcagacatttaattacaattcataccaatagcaaaattagttatgaaggagcaatgaaaataattttatggttggggggtcactgagacatgaggaactgtattaaagagtcgcagcattaggaaggttgagaaccactgttttatagagattaatcaacctaaatttttttaattgcataggatctagaatgactaattttgaaggagagagacttattttaagacttatcaaaattctacagaaatcaagaaaataatatcaggccatggaaagcacaaaatcctgaaatagacttgagttaattgatttttgacaagacttgggctaatttagaaggcaagagagccttctcggcaaactgctctgaggcagtgggataacgaattctgaaatgtatgttgacatttgatgtcagatctaattggagcagagaattcttctgcactcccttgtctccccaataagaggatttgtggataatcactttagaggcactcagtccctccctgtctgctgtttgtatagcttcagtgggtcaacaagggtgcctaactgttcaggggcaaagagtattccctcctcaggacttaagtcaacaagagcaaaccacaggctgtaactcagttagttggtagagaatgtctcacatgcccaaatccctgactttgatcccaagtaccacaaaacaaaacaaaacaaaacaaaacaaaacaaaacaaaacaaaacaggattggttgtgcatgcttggtaacctcagcaggtggagacaggaagatcagaagttcaaggacagcctcaagtacatagtgggttccagtcttgattgatctctataaactctgtggtctcttaagagggatggggggtggggggatataaatcacaaaaggctgtgtcaattagtcaactaggataaacaaataggaagtactatcaaagaggggaggtggtaacctttgcctgggaccatcctagagggctcttagggcaggtctcaccaggaaagctgcacttgctatcactgtctgatctaatttgccctggagtttttggagctagccttggtaagtggccaaggctggccttgaggtttcctgcttctaaagtgctgggagcctctagcttgtacttcctaccgctgtctctgtgattctcagagaccccagcatctaacattggagctgccaagtccacagtgggcaccacagacagacaaatggaccctcaaggcttctttgctcttttttttgtattggaatttgtgggtcaaagagctcagtagctcccagcaatgttcttttcgtcccttaggtagaagagggactaaggttgaaacactggagtttaactgggcaaactcactggaaactcctccctcccagcaggcgggcgagcagttgggcctcttaggttacaaacctaagttgggtgggacccacctcctcctctctccccagtgtttattgctgcagagccctgcccaaagggagctgtctaatcagctttcccaggctgagacagctcctggaaccagactgtccagtatctctcacgacctaccccttagataaacagtcctggctaaagaggttgcagctggttgcaaaggctgcactagccaggaacctctctctccaagaaggacccaggcaatgagatctgcttttcttccggcctgactcagggccttctgggagacgggggaatctactagcctggaaagatggtcacagcagaactccaggctgagtgaaacccttctccctgtccatgttcctagacttcctcctcatgaaagcctggccaggtctgtccagggcatagcccctcagtatgcttatctccgtggagttcaaccttacacatcagacactgcagcttggctatctagcacagatggccccactgcctaccatccagccatcttaagcttagacctttaactgctgccgtttgagacagcacactgtgggcgtcacatgctgctggcttaactccattaggctgcctttatttggtttgccctggactcagggccagggcttttgacttctttgaaaggcaacctgcaaacagtgggcatccctgactggttatctgggctttgcgttcatggcacatggactgtgtgattcggtgactgggagagcccactccaaggttctgttagcttagctgaggtggattaggtgtcgggtacctgggctctatacctgagggctaccagtgtggagtgagcctgccagaggctcacagctttggggaagacctgtggacccagaactcagcagacggtctcatcttggccggggtgccaagtgggtgtgctggactaagccagaggtataccaagaggaagagctgcttgctatataggaagagggagccagtgagcccctgcaagggtaccctcaccccctaaagccatcgagaggaaacctcaagtctgtccctactcttgccaggctatcagatgaccctgcatccctagaaggtacataaacccccagtggaaatttagattgcacttcagccgggaaggcaaccgggatgtggctctcattgtcaagactgagtcagtcttcttcacccagaagccttctcctcagcagttgtagagctctttccctggagccgcctccccagctccagtgtatacttttgagaatcctgtaccccggaccagtgctgttcaacaggaagtacgacatgagacacatacccaataaaagtaactctggtagctagtgaaattaatatttaaactagttttatttgggagctggaaaggtggctcagtggttaggcatgcttgctattcttgcagagggccagagtttgtgttgtattcccgcaagcatctgtaactctaggccaggagctctgaagccattggtctccactgacacgtgtactcatttacacactcacatgcacacgagcacacacacacacacacacacacttaaaatacaacaggtgtaaatattttatttatatgttctggaatattctcgacatacaatcaacatcaaattcttcttttaaaaaatgatgtatgtgtgtgttttgcctgaatgtgtgtctgtgtatcacatgtgtgcatgcctgaggaagccacaagaaggtgttggatcccctggaactagagttacacatggctgtgagctgtattgtgaatcaaacccaggtcctctgaaagaacaactgggacctttaactacagatccatttcttctgccccagtataaaagtcttaattttataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgtgttttacatgtacagcccatctcgacctgtgctggttgcattgcaagtgggcagtgtcatgtgtggacagagtcccctgtgggtaatgcaggggtacagctgtgtaacagacagtccgcacatcagccacttccatggcacactggagccggagagaggggcctgggctctgaaccagggctgcatcctcctggctcacagttgcctcctctgcctgcacaggcaaggctgtgtaaccccagcgtgagagctccctgctgacatctgactccagcctaacatagagagggcctgtcatctagaaggacaggaatgaaggcatgaatatcctgtgtccctccctgcccacttctcctagccccacattcccagtgcacagttagcgtgagtcagaatctgagacccaaaagacaaggttggagtcagagactctacaagtggtagagctggagggtaatttaagtttgttccacaaagagaaactagaacttacaaaaattggggcacagaggagaagggcagtccaaagggaaagaaagccaggaacactgagagttccaggccagtctgggctgtataatggccaggcttgctgtataagaagaccctctcacttttctcagtggtacagccacttaaatgagatcctacatcttattgtgacccgtgcacaccctggatccagagagagtcagttcagagaagcatatccctccatacccaggtgtctggttgggccttcctgtgtcctcagagctccacctcagacaccttgtggagtcattacctggaggccccaggtctggtctatgcatggtattatctatcctcagtattttgggggaaaaatcacttataaatacgcagaggatgaaattgaaaagaatattaaggaagcatttcaagacatgtggtacaaagatgtttattgtaatgctgtatataataacaagaggtgagaaacagcatacagcaatggggtgatgggtgaaatgagctgtgagccagtcagacactggaattctctgtcataatttaaaaaggcagtatgatcaggcattgtggcatatactatatacacaggtaatcttgtatttgactgggtggctagcctgagctacatagtgagaccaacagaatgttgggcgcttggagagatggttcagtggttaagagcaccactgactgctcttgtagaggtcctgagttcaattcctagcaaccacatggtggctcacagccacctgtaacaggatctgatgctctcttctggtgcgtctgaagacagtgtcagtgtactcataaacaagtctttaaaaaaaaacataacccaactggaatgttgatattgacataagaactgggcatgtagcccagaggtaaagctcttgcttagcatgaacaaaaatgctaatatagaagtatgcatctgtgtggaaaaaaatgttcaatgtgtggcacaggaggattgatgaggtcatcttagttacacgcatagcagtgtgcgtaaaaggatacatgctgcccccccccaacattagtgttggtttttaggggaactaaattaagtgactctttttcccctttaaattttcttgatcaatttttgtttcttcatttgtgttttcctgagacacaatctcgttatacagcaagaccggccctgaactctcaatgctcatggcttggcctcccgagggctgagattataagcgtgtgcggctgcatcaagcttccttcaccacagaccccacacatggctgcttttgtaatttctagtttctccacactgagcaagaacgactccggtggtacagagggaaatgcacaaaagcacaagaggggtgcagaaatcaagggttcgagcctgcgatatccatttcgaaacgtatcccagaactcccacgtacaggcttataatgctgtactccgacagttgtatttaaaggcagcaacaaggaattattaaatgttccagagctgaagttagagcattaaaacccatgagccagctttggctaaatacctatttgggaagtgaaagttgactatggtacaatcttgctctgagtggaatccacctaactcttcctatgtgggctctaaatgctccatggagattaagtaatgattatgaaagagacagtcctaaaaccatgtgttaaagctgataaatgaatggacattcatgcgtggggcaagcatgctcgcgcaggcgcacacagacacgcatgcacccggtcctgcctcatgcatcctattgccggtccctctgcccgcctcacaccatgccagccacactggctttttccagtggtttgcactaagggttcccttcctggaacgcatcttacccatagtgctctgcttcctcacctcctgggggtctttgcctgtggattggtaacatcttcctcagcaccccaaacaaaagggccatgtcttacatagatatttcaactgtcttccttcttctttatatcttccctgacaaatgaccgatttgtttattgtcggtcttcctgcaccagaatgtaaaacaccctgcgggcaaatactgctttctctaatgtcccgtgtccttagtccccgatcagcgagcatctgcagacttgggaggagtgaatggaccttagggacgagtgacagatcctcaccctgccaaggaggaacctgatccaggtcacgcagctgccatccgggctgcagccctcagcatcagccgctcacagggagggacccagccttgtctgtcctgcttccctggattcttccagttcacacagaacgtgagcccagaatagcaaagggagaaacagctgttcccgcagggtcctggaagccattccagagggctcgtccctggaaaaacagtagtgagctcagggtgggaaggaagaagcggagaaaaggggtcccaagccgcgagggccatgcaatagctcaggttctgtggttaaaataacatctgctcctggggtttcagagcagctctggaaggtgggtggtctgtctggagtatcaggtgggcctttcctccattcctggcccaggaaggtttgggatatgcaggtggctgaagtattcacccaacagacggatgcagtaggaaggcactgggcccaaaggcgcatctggaaaccccagtctggcctacaggcctgttggtctccggcccaacctcactctccggcgtctccagccccctcccctttgctgagatggtgcaggcatcctctttgatgcatggagagctctggccttctctcaagctccatgtggtttgttaatgggccgtgaaacgagggatttttttttttatcatccgtgtgagcacactggtggggtgctgatgctgctcagtgttctcaagcctgtctgtctgtctgtctgtctccccagatgcagcttctggataagtttcctattgaaggtggccagaaggatccgaagcaaaggattattccctttcttccaggtaagctccccgtggccccgtggagggctggcagggactgggagaagcctcccccagcaaggccagaagaggccgcctttggcaggggttagccacttcacaaaggatctgcaagcctcaggtttgaagaccactgtcctccatctcggttccctggccactccggaatcatttctgccagcccctggtttatactttctggggagtttctgaggctcttgaacttgttatcttcataaaaaggctctgtctgagaggatgggatgtgtgtataatcccagtactcaaaaggcaggcagaggcgggaggatgaagatttggaggccactctgaacttcatagccattcctcagcaaaacaaaacaaaactcccaagctgagcatgggcccagtgaggtggctttggtgaggatacttgccaggcgtggtggcgcatgcctttaaccccagcacttgggaggcagtggcaggcggacttctgagttcaaggccagcctggtctacaaagtgagatctaggacagcctgggctatacagagaaaccctgtcaagaaaaaaaaaaagacacttgacagcaagcctgacaacctgagtttgatgcacggtggaagtagagaaccaccttctccaagctgcactctgacctccgagggcgaccccacccccaccccatgcacatacaatacaaatgaaatagtagtttaagatctgccttaggaacatagtgggtcccagactgggctacacgagagactccttctcaaataactaagaacactgggtattcttccagagggcccaggttcaattctcagctcccacagggcagctcacaaccatctgtttcagatgtccagtaacgtccctaccctgcccccatgacatccagattctctcccagcatccttgggcttgaggcacacagatgtccatgcaaacaaaccactcatactcatgaaaaaatattggtgattcagggtttttctgtgtagccctggctgtcctggaactcgctctgtagaccaggctggcctcaaattcagagatccgcctgcctctccctcccaagtgctgggattaaaggcatgaatcaccactgtctggtgcatatgtctgtgtgtgtctgtgtgtgtgtgtgtgtgtgtgtgtgtgtgtgtgtgtgtaattttaaatatattttatatgaaatatatattatatatacacacacatatatataatgtatatataattttcttaagttaaaaagtatcataaactaaccaaacaatgcagaatcatagagagacttaagttcacctgggaaaggattgctaatcacaagaacaactgctaccccccttaaattgagcatactccccaattcttgatctcccataggcctgatgtgttgtacttccctagcacacctgtgaggtagcagagacaggatttgaacccagctcggtctagccagtcactgcaacaccgtttggaacctgtttcatgcaatcaattatgtgtattttagaaaaaaatgtctctggtaagccgtgacctgctgttactgggatgtctagagtctgagtagaggcctgtaatgtgattatagcacacttcctcatcattactgcagagagctgttcctactgagagctgtattatcgcttctcatgatgggggatgctgctagaatccagacaggttaattaagtacccttgaaaatggcagagctaggcatgaactcagggctctgccccaaaccacgaggggacactgccctctggttttctgggacctcaaggcagtagattctgctggttctcaggacagttcccttcacggaggtcttcctactagattaatgctgaccctggaccctcacaggccagccacctggatgagttgtcagttagacattagtggcccacggtcattcccttctgttgattgagagcaggtacctcacatggggagtggcctctaaaggccctctgaagggtgttcttacccgacccttacagtgggaaaagctacacatcttcagggcctcatactaggcttatagagaaggaaccggctctggggatccggagctaagagcctatatagtttgggcaagacaagaactgacctttgagagcaagtgtctcacccctgcttcctccatcggcctctgagtcacaagaccagacagcgactttgcactgagtccagggcatttagggtgtccaacatctgggtctgcaacatccttaaattcttgcaacagtttggatgctacacccacccagggcagggctgtccagctagggtgttataggtgaacgtgtcccataggaacatgaggttatcagtatcacacgagtgctggacttggccctgggacctgaagctgcctattttctcaggaaggattgggggtgggggacttctactctgtctctggccaatactacaaggaaagagtttgtcattctgccagtcatgcttaggaggggagctgactatgccgggctgaggggctagggtgagggtatcccagctacttcaaagatttttttttccacccaaggaacccttgaaatagtgagagacacgagcatttctaccataagaatgacttaaagtggagagtggtggcgcacgcctttaatcccagcacttgggagggaggcagatgcaggcagatctctgtgagtttgaggccaccctggtctacagagtgagttccaagatagccagggctacacagagaaaccctgtctcaaaaaaaaaaaaaaaaaaaaaaaaaaaaaaaaaacaccaaaaagactcaaattaggatgtgactctcactgttgtgtcactatgtgataccgagtgtgaccccatgagaagcacagagggaaagaacctgtaagctgcgtgaggaagtcagaagaggcccaaggaaggggcctgagacttgatgtggggctggagggcatggcttgagtaccaccaacttagttccatgtctcagactgcctgcattcatccttggaaacttaagctctgccagttaccagctgtagtaactttgtgcctcagtttactcatctggaaaatggggtgataatggcatctactccatgtggcagtgggaaagggaagaatggattaatgcagcccaggtgctcagaactgtggctgtcccctagcaagggtcaataaatgttagtccttattgttaccatgccccgcattgcctaggctttcccacctcgcagtcacatacataatttgatgtgacctgaagttattgtttctgttttactgactaggaactggaagctaaggcatgctgagcggtttgtataaggactcacagtctggttagccaacaccaggactcttttgtctgatcttttggtggtccttatttgagataggatctcactttgaatcctaggttagactctaattcactaggtagctcaggctggccttgaactcaaagcagtcccgtcccctcatccttctaagtgctaggactacagggatgagaccccatttctggcaaacgccagactcctttgtccctcatgctgggggaacccagctcaactgaggccccattgaagtccagttccattcttaggacttgagtgaggactcaggtcacgtgaggctcatttgcatagtgcctgcctcatggttaattcccagagaaggtggctctttaaagagaaagggagaggtacagccaggcacctttagtcccagcgctcgggaggaggcagagacaggaggatctctgcgagtaccaggccagccagggctacatagtgagaaccggtcactcaaagaatacattataaaacaagttttagaaggaggtgggtgttgtagagatggtcttgcagggacccaagttcagttctcagaacctacgtggggcagatcagtaactcgagttccaggggatccaaaacctggcctctgcagtcacctacacacagataccccaccccgtgagcataattaaaaataaaattaatctttgaagaaatttgttaatttcctgtgagggggtgggtgcatgccatggtgtgcctgtgggatcggaggaaaacgtgaactggttgtctctttctagcatgttcttcccaggtagtgaacgcagtcttggcagcaggtgccactacctccctgagtcacctcaccagaaaagtcacacacaagatacctttcaaccaccatataaacgtgaccatgcatagtagggagtgttgtcgagagaaatgggggttgaccagttccctgaaggaaacactgccttttcttagccctgctccctctgagcccacctttcattggctctgtgccttggactcctggtctttgtgcactcagtctccagggcttcagactgggctagcccctgggcagaggccactgggaaagggcctatttagtagctggatacctgttttagcttgagaggtggattcaaccgcgggcgactcgggaatgctctctcttttgtgaatttcccactgtcgcgtcacccgtctcattgtaagagtaggtcttgtgtgtgtctctgaacaccaagttgtttctcctccttaccttttgagacggtgtctgaggtcaccgctgattctcccagagttgggagggtgggtcatcctattggcaaaggcttaacaaaaccgtaagggtgcacacaccccgtgcgcttcggacggccacaaggagggctctggcagcattgtgtctcacctgggatttcatggtaaggattcatggttaggaaagctccagggaggagctcagttctagttccagagttgctggggccggggcataccaagcatttgtgctgcccgggaagggtttggagtatatatactccaagctccagtccagctacctccttctggcccacctgactgcaggctcatggctggggacttgaagggtctggctggtagctgcaaaaggagaggaactcaaagaactcgaggctttgctaacatgctcactcagctaccaggccaatggtaggaagtcctgcacaggagcaatgcatcttgggatcgggacttaggctggggatgtgtccggccaggtctggcacacctcgtgttcaggccagtctgtgggtttgcaaggtggtgagcacccagtgtgcctatgatagaatcttcatccgagagaagttggctcctgatggtacccagtgcctcttaggggacaggcaggacattatacagcagcaccaggccaggaatagggtttaggggaaggaggtccgtgagtagagccaatgatgtggtagaggcagggtttggccagtgcctgatatttgaatatcaattaaatcctgtataaaggttggaggtacatgcattgcctgtaaggctccccaagttgttttcacctgcgttaaaacctgtttgctggattctgggaatgaagagcccatggaaggaactagaaggtgtggaacccacaaacaaggggcagctctccggtacgtgtcccggggagaaatatgcacagctcaggctgagaaagggcagagtgttatttggaaacttgggcatcctgagaagggggtctgaggatggactcccctaagctgaacctccaaactgaattgtgagaatgagggagccactcctatttcctggctgacctctgtggcttgctctgagccaaggccctgtcctctctagctcttaccatgtttctgttgttgggcgggacacgtggcatatgctgcatttagatttgttcatcagtttccttatttacacacagtttaccaactactaccgtatgcctggacctgtactggccactcctcatcccttcctccagggtcactgatggctttcatccctaggttagagaaaaatcaactctgggaagaaggctcagtggcacctgccaccaaaatgagtttgaaagacccacaacgtgaggactcccccacattctgactcaggagaggcgacaccccaaaatcaccaacgagaaacggtcttgctgcaaattgcaagaggatttttattcaagagcgctctcaggcccacggtcatacaccacgcagggtagaggaccgtggcgccccgagtagctgagtaagggggtatttaaaggaagaaaccacaactcaaggaggtgggaagggcgttgttggaaaataccaaaaataccagttaagagtcacaaggaagtgcaaagttacaagtgtcaggttatctctcaagaaagtttctaagagcccctaacaatagcacatttgcattgcaggttccagtaatggtcagggtgccattctttgaattgaacccaggaagcgggtgggtggaggaatgtggctatctgttttatgattagcataccttggagcacagagtttactactctttcaagttcaatccctgggatcaatgtggtggaaggaaagcgtgggcgctcatgagcacgtgtgtgtgcacacacacacacagacatggaggaaagacagacagacagacaggcacagacacataggcagacacacacacacacagaggcttacacaccacacacacatatttaaaaagagagaagtcctcccgatcctgccccacgtggtagagcttcaccctctgattcgctgtctttccccggctaaggagcaatctcacggcctgcctcagcgaggctccgctctgtcttcccctgctgcctctgtacctgccaagtcaggcccaagaccaagcacaagtaccctcggcccctccctcagctgtcactgtcactcaagtgttaggcatatcctgtttggggtcaggtgacctggaagggcctcccacgtgccttaagcggctgaggtccttggcaccaagtaattattttgtgtgtgtgactaaactatttagtgtttttcattttgtatcattacacatgcagaactctttggggtccgagagcgccatagtccttcagttatgaacctgacaggactggctattgactttcttttataaaatacccttccctcccttctttttgaaatagggtcttgtcttagggtttctatcgctatgctaaaacaccatgaccaaaaacatcttggggaacaaagtttagcttatagctggcaggtaactgtcccatcactgagggggtcaggacaggaattcaagcaggatgggaacctcaaagcaggaagggaaacaggctgtgggaaaacactactcactagcttctaatccaggacttgttcgcctgcccccaggaccaactgcccaggggaacaattgactatacacacacaccctccacctgcctaccacatttataactgattaaaatgtccggtagacttgcctaaagaccagtcttacagaggcactttctcaattgtggtttcttctgttctgataactctagttagtgccaagttaacaaaaccaaccaggataggcctgccggagcctgtactactctgagcttgccgtgtagctaaggatgacttttcaactctttcccttcttgcctttgcctcccgagtgctgggattacagggatgcacgactgtacctggctttaacttttaattttgaaataattacatgctcatgaattgttgcaaaaataccaggcaccatactccctctctggcagttccaacaactgcggagtaggtagctttgttacattgtaaggagggtcaggccagacattctccaccaccaaattacttcccacagttttttttctttaaaattatgtgcatgtgcatgtgtgtgtgtgtgagtgtcagtctggcgtatgcatgcagtgcctccgtcagattgccctggaactagagtcagaggcagttgtgagcggcgcagcatgggtgctgggaactgaacttgggtgctgtgctctgaacggccgtgcaccttcttcagtcctgggacatcttagataaataagatactgagtatgttatcaaaagcagagtattactgttggcaccttaattgagcttgccggttgccctgagcgactgattttcgtatgaagcatatggaaatgctagtgagtgtgcatggcagctggccggggaggagggcagctgcccatgcgaagctactccacagtcaagtgccagcactgctgtttccagcaaagagctatgggaagaacttgatttgtgtgaagaaactggcttgaagcctcctaaacaaattctgtgggataaatgccaccatttcagttgccctcgatgggtttttagtttttttgtttgtttgtttgttttggtttttttttttttttggttttttgttttatttgaaataaggtccctcgatgtagtcctgattgtcctggaattcgttgtatagaccaagctggctccaaactcacagagatcctcctgcgtctgcctccccagtgatggaaattcaaggcacgtgctacatgttttattaaaaagaagcctatgtgccaggcggtggtggcgcacgcctttaatcccagctctcgggaggcagaggcaggcggatttctgagttcaaggccagcctggtctactgagtgagttccaggacagccagggctacacagagaaaccctgtcttgaaaaacaagacaaacaaacaaaaagaaatatgtgataaattgttacaatacctctgaaagaaagttcttgaattgaggtggtgcttgcatgttaacccatcactttatgaggctgaggcagacagatgatagttcaaggttagcctgaactacatatgagttcaaggccagcatggatcatgtattgagatactactagtagtcatgataatatcatttattgttattattaattattattaatagaatctgtggcctctgggttgctgaaaactggacagatctggagctgggagactaggaagtcaccttgacctcaggctttagggataggaacagcgtcgtagagaactgtgaatggatcaaggtgtggtactacaagcctgtcccagcacttaagcagcagaggcaaggggatcaagacttcaaggccaacctgggctatgaagtgagatcaagaccagcctgggctacatgtgacatggtctcaaaaaaaaaaaaaaaaaagcaaaaccaaataaacaaacaaacccacacagggtatctggtcgcaccctatttgtgagccagtttatcttactgacttcatggctaaccgtgtaaaatataacattcttgaatcagagacgtcagactttattacagcccacgtgagtggcgggggcatctttacatctgttcatcctccctccctccaagtttctgtgaggtgacaagattgtcttgagacgtcatgtgcacgtgccatgggctgcaaactaggaagggagcctagacattggagacattagggaaccctcatttttattacaggcaggaagcaaacctgttttttttttttttaaaaaccatggggggggcggggcacaggctgttatctctggaaagataatccaaaacaaaaagtctgctgcctgtttaggaggcctccacctgtggcagttagagagccagggacagtagtctccagggtatatccggctctgcttggaggggtaggcagaagtgttttttgggtacttacctcttgatgcagcctgaagtttacatggaactctctgccttgtttgaaaagactactgtggaaaacccatctcctgttgcccatcctggggctggagtctatttcctgtatatcctgagtttgctggcccaaggagcctccgggggaggaaatggtcactgcagagcagggaggagtgaatatagccactgatgtaaaaagcaaacaactgtgaccagggcccagggacctcagaagccaggcagtggagcagaaagagctgtgcttagtctgcccaggtgatgctagggtcaccttcaacttacgagctgtctgtgactctatgccagctcactttacctctggcctccagaaagccctgtggtcctgaggactgagtcagccccctcccaaggccccttgcatctcctggtgaatgagattatggagctataagatggcttgggccaccaagcaaccccataactataaacaaggtaggaaccggcagcctgaaggctgcatgctgacctctttggctcacaggatggtatttttagacagcagccgtgctcgctccttttgtactggctggacagtttacataccagttcctcaataaagaggccgtttggagccagagtgcaggagtgtgctgggtgaaccagagaccctggcttatgtctcccttacccaggagccctgtgcaacagatccggtgtttattcagcactaaaggaagcaggggggagggacaggttttagcctgaggagggctgaccctcttgcttaggtctagatgtttcccttcgtctccaccaggcactagtctaagaagcctttccccaaaggatctgggagccaggacaagcaatgactgggctctggcagggacgtgacatctaagaagtttccagaccctgctggtagcctgaaatggcaggggaaagacagacttctgtgatgaggataggacagacagtgtcttctgggaacactgaggtataaaagctgtcaacagaattacaggtctaaatcatgcacctccatacttctgggaagcgctgggtctcctcttgtaatcacagctcccactctgtatgctgaggcccgtggctcccaaagcccgctgtaagcgtaagcgtgctgctctgagcttggctgtgttcatccattcctttcctgccgcaggtatttaatcaagcacctactgtgtgccgggatcagctataggcacttacatagccaagaacaagtgccaacaggaagtttatcttctggtgggggtgtggggatggtccagaaaacaaataaatgagcaattcccaatcgtgacaggaatcaggaagaaacagaactgtgagtgaggtggcccaggtggtctgagatttgttagccaagaaaggcctctgcagaggtgacatctgaactgaggcaggcatgggtaggtcagggtccagggatgccaggctgggaagatgatccaagggggactaaggagtgtgtgtgaaaatcagcatgaagcagtggagaagggaccaggccagctgagcactgagagagttgggcagattgaggtggggccaagaaggctacccctgaagaggggtaccagctccacaggagcgtgtgaacggtgagagccctccgtgtccaggcaatgtgacaggccccagaggcttccagccccaggtccccgaggtctacgcaggcagcgatttcacagggggtctttctgctcttgaaaatgaatgtggatcgggccctaagccctgcccctactgcatctgcactttcagggccaggaagaactagccactttgtctgaattttctgtttccttcatcccttgcttagagtccccttcagaagggagtcagcctcccgagcacctgccccaggtctgtagtcctgggctgtctcccaggactcttccccaacaacgttcggttgaagcagatgcccacactctcggacagcccgggccattggacatgcaggaagtgtgctctagcctggaagcagccttgaggtgcagcccggtcacctcaaggacatgaggtcactactcatgtctgtagctccataattaagctaagccaccagccctccccttgcttgctggcaacaccatccaaagtgatgggtgtgacttcaggcccctgtcacactcatgaccttccccaccctttcagcctggaaataaataatttccttatggaagcccagcgttcttttacaaggtcaaaccgttttcctctgtgcttagagataacagttacatgccggtgtccccgggagtggtggtgtcggcaaactcacattcaaacaaagttactcggcctaggtttgatggtgtcagaggggaaactaaggcaggagaaaggagatgggcttcatggggtctgtgagagcagggatggactaagctgagcctgcaatgtcgggccacacagagtacaaggtagggaagggaagaaggctgatgacctccacagggttgagcagagcaagtccccagaggtcatgctacgggctggggatttatcccttctcgctgagatgttttaggccgagagatttctatcttgaaaggctccttcagtgtggcatgcggaaagactggaggtgactaggcaggcaagggatgaaggcggcttgggagaagccgagggaagaagacagttctcaggtgtatattacagggagcatcagttaaggaccgcaggtggggatcagggaggggtcaagggtgatgaggtcatagatcagggtcagggtcagccctggtcaaaatataaaccagcatgttacaatggccccatttcagacctaccctgtgtttaccataaagggggaagaagatggcttcctctcctctcccttctggtagccactgcctttggaacgtttgaaaggtgcttttgtgactatgttgttcagttggcagagtacttccctggcactcacaaagtcctgggtttgattccctgcactgtgtgcgctgggtgtggtggttgtgtgcccgttgtcccagcactcaggaggcagaaagatagaaacttaggctcattctcagctacatagcaagcatgaagctagcctgggtcaccctgactggacccaggcccaaagacagagccccagccttccctctcctctggcagggtctgagttggctcttagggtcccatcctaccatataaagtgactcaccattcatcccgggctgcttggcatcatcagaccctggaaacctccaatactggcatccactgaagaggcttaggctgtcaggctgcctggtccccaaaccacagatctggccgagggggcttggtatggcctgaagatggagcctgttcacctgaatgaatgtgcttccaggagacagggaggagcctgggccaggctgttacaccaggtttatctctaccatcacaggctgagtagcccagaggagaaagtcctatttgtttccctctgggacagagcacaaggtaccaggttccaccttagagagaaagagcttggaaggacttggggctcagatctgctcttaaacctggggttccttctcaatgctactactggtctgagtataaaacacgacttaaagggcgtgtgtgtgtgtgtgcgcgcgcagaaatgggcaagcactatgaagtaattcatcacggggaaacttagagtcaacatacttggggttcaaatctcatcccggactcttcctagctttatgaccctgggccagttccctgcagcatccctgcaccttcagggtggcccagcctcaaagggaagtccgcagtagaggcacagtgagcacccccaatgccgtggtgagcgtggttatgaccgtgtgctgagcctgctctctgggccagtgtcaatgcagccttctggaatcttctccaggcatggtggctcttctgagacgcagacctaggcacttgaacattggctgctcaaaatgtggttggtctcttgggcgttgtccgggagctcattagacatgcagtctccaccccagacctgctgaatcaggcctgtatcttaccaagagccgggtaagggatgagaaacacttatttaaggccctcggagcctcttggtgggctgcccacctgcattattgttaacacactcttggtgtctagctatgttcggtcccttcatgtattataaactgctcacgagcacagacagatgtagctctgagtcaaatgctcagggaagcagggcctcatgttcaacttgaagaggactacgatttggcctgtggtcctcacacatcctagagatgtttacccgcttaggagagctacatccagggagaagggttcgtgtaacagcacagccactgttcatcatagactaagcaggaggatgccgggggcctgttactctgcattctctccctcctatccaaggcagggggaaatgtggagccagggatattgatacagttttggttttagaggcttctcctgctagccagatgctgtaatcccagcacacgagagcctgaggccacaagactgaaagcattaggccagtgtgagctttatatcttcataagacctggtctcccccaccccttctccctaaaaatgtgcctgtggaaatggggaagcccagcccccaagtctccaggccctctgtgggggacgtgtaaaagtaagaacagtgttaggcttcctaccgtgtggacgccaaggattatttggcctggaggcaagtgcatctacccactgagccatcttgccagtcagtggcatgtatgagattgactcaggcctaagcattcactcatgtactgcagagagggaaggaggctgttatgggagtctggggcagtaacattaagatgagatttttttttttaaaggaatctgttttgctctaataggggcatggtagtgaatatttgtaattgcaagactctgtctcaaacaatccaccactatcacaaatcagaacttcaaaataatgaagccctggaagacatttaagaccaggaagtagctggcagcatggtggcctgcccactctcctgaccttgcacttctgggctgggttgggaatggcatcagtggatctagtaggtggtaggatcttcttgcttactgaacaagtacatatgcttgcaagatagagcgtagctgttgttcagagcctgtgcttgggggaccaggggtaacttttattgaattgactaaatggaaaaaggtctaaatggaaaagccttccaagaagctgtggatgtggggatacacacacacacacacacacacacacacatatatatatatatatcacacgcccttcctagcctgtgagtcttcatctgtagatttattatcattaaattggatgatattgggggagatatacacttattaagtagtaactgtaatcctttggcattaattttctcatatgtacaattgttatacacacacacacacacacacacacacacacacacacatataaccggcctcatgtgtcctggaagtgcttgctaccctatgaaacaactgagattatcagttgaggtttggtgtaaaacaatgggacattccttactggagggctttcttaattatgtaaaccttgtttcaagttttatcctgtgtttttagaaatatagaaattagaggctgatcggagccttcttttcagtcacgtcacatgcctacagttaattttgtctgattacatttttttaatttttattcaccacttagtggcagatccttaaattgcaggtatagtaccccacagggaatacttactaactttctgtaggaaattatataacaccacaactgctgttcctaaacacagtttcatatagattaaaaatgggggtaaaagtaacgctcagagtttaagagcactgactgctcttccagaggaccagggtccaattcccagcacccacagggcagctgaaagctctctgtaactgcagttccatgggatctgacacctttacacagatatccatgcaggaaaacaccaatgcacatgaaataaaaaaaccaaactatttaaaagaaaaagaaaccctttttacctttgtttttctgtcggatggtaaatccccaaatttccatttggggcaccaaatagaatcttgggaaatattcaattcttgtttttacttgttcattcctaaacctcgaaggggcctgtttttctgtgtctggtagcatatccgtcgacagggacatggcccctgtgcctcgtagattcccattcattaagccctcacatgaggatagtcccagcctgagaccccatgaccgtgaaatacaaggatcgacctgttagtatatgacttttttctaaaagccattaagaccaaaggactaagtgaccagtgatggaatattatgcaaaaggaaaaacatgtcagggagacaggggtcttctagccccgcctcaaatccaaccatactggcagtatgtggctgcctctgcataaggccagctttgtgcccctcttagccccctgtccccagtcactcccatttcctttgaaaggtgcagaaagcccccttgtctggagtgttttcctgcaaagagcccctactgaaagactccacacacagccaaggctctggccttcacctttgcccccaacttattctgacaaagagttcctctcttccctcctaagctttttgggagacgtggctaaggctagcaagaattgaatgaaaatataaatagaagtgtaacgcataaccaatggtgttccccaaatatctggagacatgattgtcggtcaagcagcaggcagccaccaaaccatgcaggcgtggtggctagtgtgggccattcagtcagttgagtgtctgcagggtgcttccagcatgtgaacggcacggcggcatctggtgaaaaccttgctctcggttacctagaacaccctccttgtctgctctcttggcacccatcagccacatgaccaggcgcagacagcaaagttaagccacaccacctgggcccagatcagccagtcatccgatcagccgtgtgactccgggacatctagaagctgcctctgaggttttagtctcttcagcgttggtcatgaaaactttagaagcttggtttgtagagagcaggagccaaaccttatctcatcttgtgaagtagctggggatctgggaccgatcgcctggggcggatttgttcttggctctccgaaacaatgtccttggttgtagttctcattgctgggtgaggattgagataggatttggacagagggaaaaaggccaagttggagaccctgggcaatgtaacctctaactgctccagcctgcctctcaccgactttgtgaggttggttaagtcatttctataaaccaagctttgacctaagaagtgaggctagcatgagatggcttttggaccctctcagtttttacagccaagatccatggggtcactgtggacaatgccgagacccaaactgagctctgtagtgtcagccggccccatcccaggcttcggatgcgacgtgggagaactcggaaggaactctctcctgttaggtgaaaagtgtgattctgcaggcatgatgctgcgtgcgtgtgtggaatcccagaactcaggagaccgaggcaggaagatggagagtctgaagccgtcttggagcaaaataataaaagttacaacaacaagaaagaaaggaaggaaggaaggaaggaaggaagaaagaaagaaagaaagaaagaaagaaagaaagaaagaaagaaagaaagaaagaaagaaagaaagaaagaaagaaaggtttttaatgtgttgagacaaccactcagtagtacgtgcctttttagcatgtgtgtgaggctctgaattcagtcagaggtataaaaacaaataactagtggtccttggtcttaaaggtccaggaattcaggtgttttcactctcggtggccacctgtgatcaagctgttacccatccagcttgttcttacacattcatgacccaccccaggatgttaccctagtcctccctttcctcaacgtaaatgtaccccactctgcagccaccttgagcttacttcagcttcttagatgagcctggtcactctcatcattggacttttttgatggggttcctgcctctccctggaactcgcttcctacttctcttcctagctccctctcatgtgaccccactaaagctaatctctctctctctctctctctctctctctctgtctctctctctctctctctctctctctctctctctctctctctctctcacacacacacacacacacacacacacacacacatgaacctgcagcaggtcactcagccttagaccgtcaatgtacccatctgtaaaatgggagtaactacagtatcttgtacctaactaaattataaggttatatgagctcaaataacaatcagtagaaaacatggcgtgcgcacatagcccagaccacgtctggcctgtcttcttcctatccatccttgtagaaggggtgtattatgtaggtttggaagttactgaacagaccgactgtctgggatctgtattgcagctgagccagaccccagagaagtaggccttggggtaatgctctgccccaacagagccaagcaaactcccttctggctggccgggtctagctgtggtcctgaggtttccttgcaagggaattcagaccaaacctcccaactgctcagaggctcagtagtgaacaaggccactgctgagcagggattgcggtcccctgctacagaaggcaggccattctcttgtggccctccaagcctgatgcctggccacacactgtaggccatgccacaaagagaggcagccaggaagctttggccaatatccctccacccgcttctggaggacagctccccacaggggtggagttgaggcagtagagctgaatggggccctttatcccctgctcccactgggaggccgagccactgccctccacacccaccacacccaggcccaggaggacactgtgacctcagcaccagcctctctattaagcaggctctctggccccactgtgtctgggtcctggaagatgagtcccgcccttgcgtccgagatggcagccccagtgtgaaaggaaagagtgccgtgtgtgtacatacatgagtgtgtacacgagagagaggctcatagcaggactgtgtggacacacactcattagtgtattggctgcacttcagtacaagtctgttgcctgctgctgcatgcaaggccttgtgctgagccctagagacacgtctgttagtgttgtgcttgtagtctgttctgcggcaatactacaaagagtggcccatctgagcatgaccagaagtggtgcactctgggagtgaattgactcccgcaaggtttagtctgacctacatgcatgcacacacagagacagacagatggacggacagacagaggcagagagaatatagtactagtattattctgaagctgggcatgatggtacagatttataatccaggctaattatgaggctaaggctggagaattaccaccaagttcaagctagcctaggctacataatgagtgctggcctgggctacaaagtgagaccttgtcacagcaacaacaaatcaccacagcaaaagattattctggccgctagaaagtggaaccagagacatgggctcagtgcagcatgcccagctgctggggaggctgagatggggagacattggagtccagaggtgtgaggaaagacagactggcttgaaaaataaagaagatgggaggagggatgaaggcaaggaaggaagatggacacaaaggttggctctgcaggattcacataggcactggatagcaagttagccctgcctagcatgacagcactatgtctatactctgtaatccattgtctagtggtcctactgggtggacgagaaggctgatatatagaaagcatcctgtgtccaagaacatagtggtgtgacagctgacacccagcttggtggtcctaagttgtaaagcctcttgtgcccttgagcccagttctgggagctagaaatcatcaccccacttcccaagatgccacagcccttctagccgtgcacgctgtgacaacagcaaagtgaagcagggcctcactctggagcccggcctggcctggaacccacggcagtcctcctgcctcaggggtccagtgctgtggtccagacttgtgctatcactcccagctaatgnnnnnnnnnnnnnnnnnnnntagggtttctttgtgtagccttggctgtcctggaactcactctgtaggccagggttatcctttcaatccatagtgaaacgtcaccatttcgcaagtctgtttccctgtgtgtaggaaccagggagttggacaaagggctcgcctcgcatgcataacgctctgggttgatccttgacaatacataactgggtgtagggacatgtacctgtaaccccaacatttgagaggttctcccctgtaattttctatagaggattcattgtaacctccaaagacacatgttcaagtcctaggccgtacaacctgtgaccattatgttcatttggaaaagggtctctgatgggtgattaagtgaaggacctcaagaagaaaccagggcaggctggagaaatgatggctcagtggttaagagcaccgactgctcttctgtaggtcctgagttcaaatcccagcaaccacatgttggctcacaaccacccataatgatatctgatgccctcttctggagtgtctgaagacagccacagtgtacttacatataataataaataaatctttaaaagaagaagaagaaaaggaggaagaggaggaggagaaggaagaaaccagggcaggcaagatggctcagtggttaaagacacttgcctctgagcctgatgacctgagcttgattcctggactccatgtggtccagcttctgagtatcccctgacctcccatgacctctgcaatgtgtgcatgtgcaatgtgtgtatgctcatgttcatgtgtatgtgtgt

SEQ ID NO: 1326 - DNA, 3728 bp, Mus musculus
cgggcgggcaggctagcggagccggcggcgcgcgagggaaggggcgccccccaggcccacgggagcagcctgggacgcacggagccctcgtgccctccgggacagtcgcctgccccggagcctcagctgtaggcgcccggagcctcggcggcgagtagcgcgtgggacaggggtggcgtgtaactgcaggaaccggggcaaccggagaaggagccggaacccggccgggatgagaaggtgacgccgccggggggcgccactcgctttgtggggacgatgctcgcctactgcgtgcaagatgccaccgtggtggacgtggagaagcggaggagcccctctaaacactatgtatacattatcaacgtgacctggtctgactccacctcccagactatctaccggaggtacagcaagttcttcgacctgcagatgcagcttctggataagtttcctattgaaggtggccagaaggatccgaagcaaaggattattccctttcttccaggcaagatcctcttccggagaagccacatccgcgacgtggctgtgaagagactaaagcccatcgatgaatactgcagggcgcttgtccggctgccgccccacatttcacagtgtgacgaagtcttccggttctttgaggcacggcctgaggatgtcaaccctccaaaagaagactatggcagttccaagaggaaatcagtgtggttgtccagctgggctgagtctcccaagaaggacgtgacaggtgccgacaccaacgccgagcccatgatcctggaacagtacgtggtggtgtccaactataagaaacaagagaactcggagctgagcctccaggccggggaggtggtagatgtcatcgagaagaacgaaagcggctggtggtttgtgagcacatctgaagagcaaggttgggtccccgccacctacttggaggcccagaatggcacacgagacgactcggacatcaacacctccaagactggggaagtgtccaagagacgcaaggcacacctgcggcgcctggatcgccggtggaccctgggcgggatggtcaacaggcagcacagccgagaagagaagtatgtcactgtgcagccctacaccagccagagcaaagacgagatcggcttcgagaagggtgtcaccgtggaggtgattcgaaagaacctggaaggctggtggtacatcaggtacctcggcaaagagggttgggcaccagcgtcctacctgaagaaggccaaggatgacctgccgacccggaagaagaacctggcgggtccggtggagatcatagggaacattatggagatcagcaaccttctcaacaagaaggcatctggggataaggaggctccggctgaaggcgagggatccgaggcccccatcaccaagaaagagatcagcttaccgatcctctgcaacgcctccaatggcagcgccttggccattcccgagaggaccacatccaagctagcccagggctccccagctgtggccaggatcgcccctcagagggcccagatcagctccccaaatctgaggacaagacctcccccgcgcagagaatccagcctggggttccagctgccaaagccgccagagcccccttctgttgaggtagaatactacaccattgctgaattccagtcctgcatttctgacgggatcagctttcgaggcggacagaaggcagaggtcatcgacaagaactcgggtggttggtggtacgtgcagatcggggagaaggagggctgggccccagcctcatacattgacaagcgcaagaaacccaacctcagccgccgaaccagcactctgacgcggcccaaggtgccgccgcctgcgccccccagcaagcctaaggaggctgaggagaatcctgtgggtgcctgtgagagccagggctccccactgaaggttaaatacgaggaacccgagtatgacgtccctgcctttggctttgactcagagcccgagatgaatgaagagccttcaggggacagaggttcaggtgacaagcatcccgcccagccccgaaggatctcgcctgcctcttccctgcaacgggcccatttcaaggtgggtgagtcttctgaggacgtggccctggaagaggagaccatctatgagaatgagggcttcaggccatacacagaagacaccctgtctgccagaggctcctctggggacagtgactcccctgggagctcctctttgtcccttgccgtgaaaaactcccctaaatcagattcccccaaatcctcatcactcctaaagctcaaagcagagaagaatgcccaggcagaactggggaaaaaccagtccaacatctccttctcctcctctgtcaccatcagcaccacctgttcttcctcctcctcgtcgtcctccttgtccaagaacaatggtgacctgaaaccacgttctgcctcagatgcaggtatccgtgacacccctaaggttgggaccaagaaagatcctgatgtgaaggccgggctggcctcctgcgcccgagccaagccatccgtgagaccaaagccagtcctgaaccgagcggagtctcaaagccaggagaagatggatattagttccttacggcgccagctgaggcccacaggccagctccgggggggcctcaagggctctaggagtgaggactcagagctgcctccacagatggcttctgagggatccaggcgaggttctgcggacatcatccctctcacggccaccactcccccgtgtgtccccaaaaaggaatgggaagggcaaggcgccacctacgtgacgtgcagcgcctatcagaaggtccaggactcggagatcagcttccccgaaggcgccgaggtgcacgtgctggagaaggcggtaagtgggtggtggtacgtgaggtttggggagctggagggctgggctccttcccactacttggtggccgaggagaaccagcaacctgacacagctagcaaagagggagacacaggaaagagctcgcagaacgagggcaagtcagacagcctggaaaagattgagaagcgtgtgcaggcgctcaacactgtgaaccagagcaagagggccaccccacccatcccctcgaagcctcccgggggcttcggcaagacctcgggcaccgtagcggtgaagatgaggaacggggtccggcaagtggccgtcaggccccaatctgtgtttgtgtctccgccacccaaggacaacaacctgtcctgtgcccttcggaggaacgagtcgctaacggccaccgacagcctcagaggtgtccgcaggaactcctcctttagcaccgcacggtcagcagccgctgaggccaagggccgcctggccgagcgggctgccagccagggctcagaatcgcccctgctgcctacccagcgcaaaggcatccctgtctcccccgtgcgtcccaagcccatagagaagtcccagtttatccacaacaacctcaaggatgtgtacatctcgattgcagactatgagggggacgaagagacggctggcttccaggagggggtgtccatggaggtgctggagaagaaccccaatggctggtggtactgccagatcctggatgaggtgaagcccttcaagggctgggtaccctccaactaccttgagaagaagaactaatagcacagggtccttccagactcaacgtgctgccttggctgccactggatgagctgcggcacgccagacacgggccg

SEQ ID NO: 1327 - DNA, 3375 bp, Mus musculus
atgctcgcctactgcgtgcaagatgccaccgtggtggacgtggagaagcggaggagcccctctaaacactatgtatacattatcaacgtgacctggtctgactccacctcccagactatctaccggaggtacagcaagttcttcgacctgcagatgcagcttctggataagtttcctattgaaggtggccagaaggatccgaagcaaaggattattccctttcttccaggcaagatcctcttccggagaagccacatccgcgacgtggctgtgaagagactaaagcccatcgatgaatactgcagggcgcttgtccggctgccgccccacatttcacagtgtgacgaagtcttccggttctttgaggcacggcctgaggatgtcaaccctccaaaagaagactatggcagttccaagaggaaatcagtgtggttgtccagctgggctgagtctcccaagaaggacgtgacaggtgccgacaccaacgccgagcccatgatcctggaacagtacgtggtggtgtccaactataagaaacaagagaactcggagctgagcctccaggccggggaggtggtagatgtcatcgagaagaacgaaagcggctggtggtttgtgagcacatctgaagagcaaggttgggtccccgccacctacttggaggcccagaatggcacacgagacgactcggacatcaacacctccaagactggggaagtgtccaagagacgcaaggcacacctgcggcgcctggatcgccggtggaccctgggcgggatggtcaacaggcagcacagccgagaagagaagtatgtcactgtgcagccctacaccagccagagcaaagacgagatcggcttcgagaagggtgtcaccgtggaggtgattcgaaagaacctggaaggctggtggtacatcaggtacctcggcaaagagggttgggcaccagcgtcctacctgaagaaggccaaggatgacctgccgacccggaagaagaacctggcgggtccggtggagatcatagggaacattatggagatcagcaaccttctcaacaagaaggcatctggggataaggaggctccggctgaaggcgagggatccgaggcccccatcaccaagaaagagatcagcttaccgatcctctgcaacgcctccaatggcagcgccttggccattcccgagaggaccacatccaagctagcccagggctccccagctgtggccaggatcgcccctcagagggcccagatcagctccccaaatctgaggacaagacctcccccgcgcagagaatccagcctggggttccagctgccaaagccgccagagcccccttctgttgaggtagaatactacaccattgctgaattccagtcctgcatttctgacgggatcagctttcgaggcggacagaaggcagaggtcatcgacaagaactcgggtggttggtggtacgtgcagatcggggagaaggagggctgggccccagcctcatacattgacaagcgcaagaaacccaacctcagccgccgaaccagcactctgacgcggcccaaggtgccgccgcctgcgccccccagcaagcctaaggaggctgaggagaatcctgtgggtgcctgtgagagccagggctccccactgaaggttaaatacgaggaacccgagtatgacgtccctgcctttggctttgactcagagcccgagatgaatgaagagccttcaggggacagaggttcaggtgacaagcatcccgcccagccccgaaggatctcgcctgcctcttccctgcaacgggcccatttcaaggtgggtgagtcttctgaggacgtggccctggaagaggagaccatctatgagaatgagggcttcaggccatacacagaagacaccctgtctgccagaggctcctctggggacagtgactcccctgggagctcctctttgtcccttgccgtgaaaaactcccctaaatcagattcccccaaatcctcatcactcctaaagctcaaagcagagaagaatgcccaggcagaactggggaaaaaccagtccaacatctccttctcctcctctgtcaccatcagcaccacctgttcttcctcctcctcgtcgtcctccttgtccaagaacaatggtgacctgaaaccacgttctgcctcagatgcaggtatccgtgacacccctaaggttgggaccaagaaagatcctgatgtgaaggccgggctggcctcctgcgcccgagccaagccatccgtgagaccaaagccagtcctgaaccgagcggagtctcaaagccaggagaagatggatattagttccttacggcgccagctgaggcccacaggccagctccgggggggcctcaagggctctaggagtgaggactcagagctgcctccacagatggcttctgagggatccaggcgaggttctgcggacatcatccctctcacggccaccactcccccgtgtgtccccaaaaaggaatgggaagggcaaggcgccacctacgtgacgtgcagcgcctatcagaaggtccaggactcggagatcagcttccccgaaggcgccgaggtgcacgtgctggagaaggcggtaagtgggtggtggtacgtgaggtttggggagctggagggctgggctccttcccactacttggtggccgaggagaaccagcaacctgacacagctagcaaagagggagacacaggaaagagctcgcagaacgagggcaagtcagacagcctggaaaagattgagaagcgtgtgcaggcgctcaacactgtgaaccagagcaagagggccaccccacccatcccctcgaagcctcccgggggcttcggcaagacctcgggcaccgtagcggtgaagatgaggaacggggtccggcaagtggccgtcaggccccaatctgtgtttgtgtctccgccacccaaggacaacaacctgtcctgtgcccttcggaggaacgagtcgctaacggccaccgacagcctcagaggtgtccgcaggaactcctcctttagcaccgcacggtcagcagccgctgaggccaagggccgcctggccgagcgggctgccagccagggctcagaatcgcccctgctgcctacccagcgcaaaggcatccctgtctcccccgtgcgtcccaagcccatagagaagtcccagtttatccacaacaacctcaaggatgtgtacatctcgattgcagactatgagggggacgaagagacggctggcttccaggagggggtgtccatggaggtgctggagaagaaccccaatggctggtggtactgccagatcctggatgaggtgaagcccttcaagggctgggtaccctccaactaccttgagaagaagaactaa

SEQ ID NO: 1328 - DNA, 27827 bp, Homo sapiens
  misc_feature (17205)..(17256): "n" at positions 17205 thru 17256  can be any base
tctgggggtttgaaactgtcatcaggatctgggactctctcaccacctctctgcttgttggcaccattctctcatgatgacagcagtttcaagtacctttaagggacatcaccaaagaaagagcttctcctttaacacaagtcctaggattgtttccagctgacccagtagggtcacttgccatccataaaaccagtcacggtgggcgggagttgcaacactttggccaggccagggtccgacacctactccttccctccaggaggtggtgagcttggcctcacctaagccatggggacaaaggctggtagcaccaccagaggaagggcaaatgcacgctcgggaggaagcccccgcaggcctgcagtctacagggtcttccaccctctgctgtgtgtgcaatcactgagcaatccatggatgccagagagggactcgggtgatagaaaatccatccatggctgggcgcgctggctcacacctatagtcccagcacgttgggaggccgaggcgggcggatcacgaggtcaggagatcgagaccatcccggctaacacggtgaaaccccgtctctactaaaaatacaaaaaattagccgggcgtggtggcgggcacctgtagtcccagctactcgggaggctgaggcaggagaatggcgtgaacccgggaggcggagtttgcagtgagtggagatcgcgccactgcactccagcctgggcgacagagcgagactccgtctaaaaaaaaaaaaaaagaaaaaatccatccatgcaactcagctgaaggatgcaggaccccaggagtccaggctcagagaactgactgcactctttctgggacccgggtggcaccctttcccacctggaccaaacagaacttctgtgcatctggggttggattcttccctccacccctcccagcccagcagcctagcctgcagcttccgtgaaggaggggaacggcggactgtgctgagcacaggatatgtgcagcttgagtcagctcggcccccgccgagcaggtcagcaggctagatcaataaataaataaacgccctgtgtgttttccgcctccctctgcaccagctgggcaggccgcggacggcatgtggtattttcccaaagagatagcgactgcagcagcatattaaccatgacacgaggccacagctggctcaggcactcaaccaggggcggaaatgtaaccaaaacaggagagccctctcctctccttgctgggctcccttgagacacacatccatttttctccatttcagctgccagagcagataacactgggggtgggagctgttctagctctgtgggacaccctgccagagtgcagcgatgagcaacccgccctgccgagcccaggccctccagggctactgtgggagggacgcagctgggggcagctctcagggaggagggtgaggccataaggatggtcccacagtttcaggggtcgggggaccgcagagagtgtggtagaagacatcccagtcacacgaatgaaagttgaagcttcgagcatggttggattcaaagacttgaacatgattaataaaaagtgaagatcagctgccggcaaggtaatgaaaattgtgcaccgtgtccgcagtagtgatttcagcctgaaaccctccactgccaaagttcagcttctccctgaactctccacctgcaagagctagtaaggagccacagacagcttaacctcctctgtgtgagcaaggtggctcccacccagccttcaggtcttgctcatttactgcatattgactgatttgctaaacattccaagcaccatgcccagtgctgaagacacaggaatgaacaagacagacaaagccctgccttcctggagctcatattccagcagaggaaacagacacacactgaacgaaacacaataaataagccaaatacatgtcgtgttacaaggtaattcctagtatgggtggggggcaataaaccgggataaggggcatgagaatgccatgcatggaagtactgtataaggtggtcaaggaaggtgaactcgaagcacagattgaagcaggtgaggctgagtgtgtggcgctgaggagtttcagagggatcgagatctaccctttgtcctgtgttctgttgctgcttgcacagggctgtccagggctaggtcagggccagggggggtgcccagaaatctctgaaggaaatcctccctccgacgggcaagggcatcacggggattacggcatcccaagcctcttggtgtcctcttctgaccccagcttccttttgtccccacagaggagaagtacacagtcatctacccgtacacagctcgggaccaggatgaaatgaacctggagagaggggctgtggtggaggtcatccagaaaaacctggaaggctggtggaagatcaggtaccagccgctgccccccacggttgctgggtgggtttggggtcacgctgggtgggtttggggtcacagggactctggcctcacagaggtcggtaagtgattgcatctgggcgaagtttccgcctgaaccataaaaggatacttctcctctgtgttgtgtggcctccctccctacccatatccttccctaaaagtccatgataagcaaaactttctccaaacacactgaaccacagatagcagcaaccccattaagcaaggctagtttccacctccagatgtttctcataatgaggagttggaggccaaagctgccccatgtgagtgacagccccctcccgccccattctgagaacaagatggtgcataaacactcatggactgtaattcatcctaggctgataatctgccctcgtctctcaaagtccaatggtaaaagcagggcgtctgcattccaaacacctttcacagccctttcacctatgtgatgatatcagagcctcccaggcaggcagggtggccagctcgtcctgccttgcctggttttagtaatgaaagtcctgggaacccctccttgatcacccccaataggcaggatgtgaccatgggaaattagggcaagagaggaagccgaggtccctgcaatctagtgtctgcgctgtgatgtgtggcgggacattcgggccatttccaggaggctgagcatgtagcactgcattcattcattcattcaacaaacgcacaccaagaatctctgttgggcccagccctgttctgggagctgaggagtcaacagtgagcaagatacaatagctcacaccacctggtacagaagacaaactcataaacggtgatagagcagagggttggccatgttggagggatgcatggggactttggtacacagaagaggggctcctcagcctgggggtcaggaaggcttcctgagggagatctcagaacctaaatttgaagacggataatgatagtaatagtgtattagtctattttcatgctgccgataaagatataccccagactgggaagaaaaagaggtttaactggatttacagttccacatggctggggaggcctcagaatcatggcgggaggtgaaaagcatttcttacatagcatcggcaagagaaaatgaggaagaagcaaaagtggaaacccctgataaatccatcagatcttgtgagacttattcactatcacgagaatagcatgggaaagactggcccccatgattcagttacctccgcctgagtccctcccacaacatgtgggaattctgggagatacaattcaagtcaagatgtcgatggggacacagccaaaccatatcaaatagcaggcatgggcctggcacggtggctcatgcctgtaatcccagtacttgaggaggtaaggcaggaggatcacttgaggccaggaattcaagaccagcccgggcaacatagcatgatcccatctctacataaaaatcttttaaattagccaggcatggtgatgcacgcctgtagtcccagctacccaggaggctgaggcaggaggatcactcgagcccaagagtttgaggctgcgatgagctatgatggtgccactccagcctaggcagcacaacaagaccctgtctctaaaatttaaagacattagtttttttaaactttttaaaaaaggataacaaacatatattgaatagtatgttatcttgctgcataataaattgtcccaaaagttagtggctctggaattcagcagtggcttaattagactcaaggtctctcccgaggttatagttaggatgtcagtaagggctgcagtcatctcaagatctgactgatgctagaaagtgacagtcaggatttcagcccattcccttctcaccccagagcccagtcagcactgcacatcgcctcccatcttatggctctgtgtccccaaacaatgaactatgtcaaactgagcgtgtgggttatatacagcctggcactttctaattaggatattccctctcagagcatattttaagattgatagacactaaactgcagatttctacctccttttaaatttgcttccagtcaagagagaccttttttttttgcattaaaacccaatgctatttagttcttaaattaattcttgacaagagattcagccctgccattgggtctgttcaactttccccaaaggtctggccacctgtttttttgggttctggtaaatgtttaacaaccagctctccaaggaaaaatactctgagttacagtgtttgccagttgccatggtgcaaatactgccaccatggtcaatttcaagctatcagtgtgatgtcactaaatgtagagattgggagagatgtgcccaactggctgtcacagctggtgtgactgactgcagcacacccctggtctagattggcccctctggtcattgctgttaaactgaattctggccaagcgtggtggctcacacctgtaatcccaacactttgggaggccgagacaggaagatcacttgagtctaggagctcaagaccagcctgagcaacatagcaacaccccatctctacaagaaataataaatagctgggcatggtggtgtgtacctgtaattccagctacgtaggagactgagttgggagaatcgcttgagcccaggagttcaaggctgcagtgagctatgatcgaaccactgcactctggcctgggtgacagggagaccctatctcaaaaactgaatgtctcctgcagaggattaagagatgatgacactcattgaagtcccttttgggaggacactgagctgctctgtcagggtctcgatcactctgcggtttagtgatggccagctgccacttggcgagccctggacccagccctcaacctgctaatcccatatgaaagcatgtttaatctccacgttcatcagcgtgaacagatctccatctgtctatgccaggctttggccccagagctggggctgctgggaagaggcagcaaagcacagagattcagagcccaggctggtgccctgctggctgggtgggacatggtgggtgctgtaagaggggcaagtagaggccgggttggaaaggccttgaaaataccaagctcagggcttaggcatcatcaagaggaaatgcacagtgtgtgccaacctcttgccctgggcagtcacaacccgtcgttcctgctccctgggacctgtcatgtgattcccagtaggagcaaggcttcttcccttgggcctggcggagcagtttgacagcatccttcctcctcttcacaggtaccagggcaaagaaggctgggcccccgcctcctacctaaagaagaacagtggggagcccttgcccccgaagccaggccctggctcaccctcccacccgggtgcccttgacttggatggtgtttcccggcagcagaacgcggtgggcagggagaaggagctgctcagcagccagagggacgggcggtttgaaggccgcccggtgcccgacggtgacgccaagcagagtgagtgacacccgcccaagctcctgataatcagggcccctgtgtgccagctctgtgctcaaggcgtctcacatcgtccctcatcctcacagcagcccagctgctcccccatcctccagataagaaaacagaggcccagaaaccccgggtaacttattccagatcattcagcccgtgaattgcagaatctgagtcaagaggcattgctggccgggcacagtggctcacacctgtaatcccagcactttgggaggccgaggcgggccgatcacctgaggtcaggagttcaagaccagcctggccaacatggtgaaaccccgtctctactaaaaatacaaaaattagccaggcgtggtggcagctgcctgaaatcccagctacttgggaggctgagataggagaatcgcttgaacccgggaggcagaggttgcagtgagccaagatgcaccattgcactcgcgctccagcctgggcgacaagagtgaaactccatttaaaaaaagaaaaaaaaaggggaggcgttgctttcccatcccaggttgcattctttctgctatctcacagtggtcacactggctactctttttcaagcacctgctacatgccagaaaccttctaattagtctaatcgactcctcataactacctttgagggaattactactttttctgttttacagattgggagtctgaagggtgagagggtgtgcccaaggcccccagctagtagacggcaggggcggggacttgaacctggggagtgctgtgctctctattgctccatgtggcctcgtttctaagccagaggaagaagatggccttgtgggctctactccaacacagtgcctctcccatcttgcttttcaaagcctcctcgtgtatattttaccatttaatgttcccaacacacctgagagtagagttcattactgttgtcggcctggtcacactggctaccataccatgtctgcatgggcacgctggtgcccaggacttacgcacagtgcccatgatcctgtcttggccgtgcagggcaggtgaactctgttgagaaaggacttccagctacccacagagatgaggccactgcccctggcggggcttctccagctgtttttaagtggcagtgaacttcttgagtccgtcaaccaagtttcgtactttgctcagctgccctgagaagtcactgatcatgttttctcacatgctgtggcaggggttctggccatccccgagtttgtgtgattctaatctgtcaatcatggccaagaggttagatgtattcccattaactctagaggagcaaatgaaaatctgcagcctcaatgtctttgttagtatataggttcaggctgggcacagtggctcacgactgtaatcccagtgctttgggaggctgaggctggaggatcacttgaggccaggagtttgagaccagcctgggcaacatagtgagacccccctatctacaaaaaaaaattttttttaattagctgggcgtggtggcacacacctgtagtcccagctactagggtggctgaggcgggaggatcacttgaacccaggagattgaggctacagtgagctgtgattgctccactgcattccagcctgggcaatagagcgagaccctgtccctcaaaaataaatagatagatagatagatagatagatagatagatagatacatagatagatacatagatagattcagatgctaaaacaaagacacccccctaccaccactgaatatacacatatacacacatccaataaacgatctagatatgtatttctttctcacaaaacagtctgtgtatatgttcagggttaatatggcagctccaggcaatcaagagtcttattactccacatctatcttgttgccctcatccctcggtccagaacggctcactactagtccagccaatgaaaagcagtgcattgcactccagcctgggtgacaagagcgaaactccatttaaaaaaaaaaaggcgttgctttcccatcccaggttgcattccttctgctatctcacagtggtcacactggctactgtgtacacagctcagaagccacacactttctactttgtcttacatcccactgccagaactgagtcacgtggcaatacctggctgcaagggtgactggaaaatgaagtctatatagacagctaagtgtcttggccaatactctgttgctatttattctaacagaagacaggtaaatgggaatttaagggattagcagtctcctccgcaccccaacgccaaactacccttctgtatggacccgtgctgaacctggccaacattctgcctttagccaggagccttggaccactgcaaagtcctcatcctcctggccctgagacccagagccagggcagctgcctcgagagtataaacccctgagtcatcggcccaagtgtgtttggttcagtgtgtttgtgtattgttgcgtttgggttgttctagagcacaaaaccaggtgcagataacattcactgcatgcctgccacatgccaagagcttcacagatgtttcctttcatcctcaccgctgccctgggtgacacacattatgccagttctacagatgagggccttgtggctcagagaatccaatcatctgtccaatgccagcagctgtgagcctcagagctggattgggacccatctctgtgttattctgaagactttgctttttgccctttctggagaatttccatgacttgaggatccagcaccatcccctttcattcctgtgtagaaaagatgcaagaaaagctacgtcgagagagtcctgagccaactatgagccacgcgtgagcagctccttcctgcccaggctgttctcacagggagggttgcagcagcatgcagacgcctgtgttcaatcttctgcaggagaaaatagacccgacctggcacccagctcaggaatctcatctgtagcacaagatgtaataagctctcatttctccataggatcaccaaagatgaggcagagaccccctcctcgccgggacatgaccattgtaagtggatcctcgctactggggagtggccactgacttgagggctgtgaggggtgtccactagcccctcacacacccctcgcccttccagaaatgctctctttcctgtccacacaacagccttgtgaagcaggctgtagaaatgctagtcccactcgcaggtggaaagacggaggtgcaggcaggtgaaacagtttgcccgcggggccagagtgctcctgtgacagttgggcctcaggacctgccttctgctccctgggcccttctcttggtcttagatcagtcttctcaggcgacttgaggcccaagctgagatgagacacaaatatcatctgtggtcccattctgatattctgcgctcataatccattatgtaaaattctctaggtacctttttagccaatactttgaacccaatgggttgttgttgggttttggggttttttttatttgtttgcattggtttttgagacggggtcttgctcttttggggttgtatttttttaatgtctgctatttatcaagcacctgttgcgtgccatgcagcgtgccgattgcctcacaacattaactaatttaatacttgaagcaaccccaccaggtagacactgttatgcccactctgcaggagagaaaactgaggctccagaagggggtgatttgcccaaggacactcccaccatcagtgtttccaacccagatagatctactaataaacttaagctccctccacaaccctcactgcctcttatttcagagaatattgtcttgctccaaattctcatgattgtacccaaatgtcccgtgtttcttcccatcaccctaaagctgatgggccagtgaggtctcaccgaggagtgacaaactgcgtggtcctatttgtgttgtcccttagaatccaactaggtccccagcacccccttaagggtgattgcatgccccaggcccttagactccccctgacacagggtcgcaggagtgcacttagccttggagataaccctgtgtgtgatcgtaccagcctcgaggcctcaacctgccgaagccgcccatcccgccccaagtggaggaagagtattacaccatcgccgaattccagacaaccatcccagacggcatcagcttccaggcaggcctgaaggtcgaggtgagtggccctggtgttcctttgcctacttgtgattcctgattccaggcatcacctcctacttctcccctgtcacctcctacttcactgggtgggtggaggtggggcggagattaacagctttatggttcacataccatacagtttacaattttaagtgtaaaattcagcggcttatgatattcacagggttgcacaaccctcaccactgtctaattccagaacaaaaagaaactccttacccatcaacagccaccctccatttcccctcaacttgccagcccctaggcagccaccaatccactttctgtccccatagatgtgcctgttttagacatttcatatagatgaaatcccacagtatgtggtcttgtgtgactggctgtatgcctttctttaccacctcccacctccgttcttgcttctcctctctccttttcttcccactctctctgtttgtctactttgttccccagattctcttcctgcatttctctttcctttcctcatggggttagagcttcaagatatttctttctcatatttgcaagaaaacctgtaagtaaggggatggcagctagggccagggtttggaaacctttggcaaagatggttcttgagacactttcaaaagcaggtgagccaatcacaggtatcaccaaattcactctgtcatgtgtaagagttggtcagaccctccccacctcaccttgggaggccaaggttcaatttattcatctctgcaacaaataaaatgctcctggatctcctactatggttgtgtgtggcggctgcttttctaggccctgaagagttgtcgtcaccatcctctttcctttaaagaacacagctctggtccctggcacagagcactgtctgatggcacagggcagtagacaccattgatcagttcactccagcatacctctttagggcccctcccttccttcctggctatattccaggaaggactatagcctgcctgcctgcacgccttcattccttccttccctccttccttcccttcttccttccctccttctttccttccctccctccttccttcctccttcctccttcctttgttttccttcccttcttcctttcctccctcctttccctccttctctctttcctccctccttcctccttctttctttctctccctccttccttcctttcctccatcctccttcctgcctttcttccatcctcctccttccttttcccttactccagcttgccagcagctccaccaggcacaacatctggcccaggccttgctgtgtactacagtcgagaggctagttctgcatcctctggcccctgcttccagaggcattgaagtatcttcatgtttcactagaaggaaatccttttgtgttttcactttgctattatctgagtgaagggctaaagggatgagatttgggaaaattctgaattgtgttttaatccattatagaaaaatctgccccttcatactctttcattgtatacacatgtattgagtgcctccttttttttttttttttttttttttttttgacagagcctcgctcctctgttgcccaggctggagtgcaatggctcaatctcagctcactgcaacctccgcctcccaggttcaagtgattctcctgcctcagcctctctagtaactgggattacaggcgcccaacatgacgcccggctgatttttgtatttttagtagaaacagggttttgccatgttggccaggctggtctcgaactcctgacctcaggtgatctgcccacctcggcctcccaaagttctggcattacaggcgtgagccactgcacctggctagatgttgttttcttatgatagatccatatgctctgtttttctcttctccagttttgcttcctggctcattgcaacattatcttagccttcaaaattcattaatggaaccacagcattctagcagtagggctaccagtaacaccttagttacttgtctaggctgtttatcttcaggatgtgttatgataatgatgatgatgatgatgatgatgatataggcacctcttctgtgtcaggtaccttacctccttgataactgatcttcacagaagtcccaagaggtcaaaataccagcatcatagggttggttggttagtttgtttttcttttttttttttctatcagcatgttttatagatgagactcaggggggttaggtaaattatttgcctctagtaacacagctagtaagcaatggagttgtgaaaccaggtctttctggttttaaagcccacactcttttctttcccctcattcttgtgatctttttttttttctttgagacggaatcttgctctgtcacccaggctagagtgtaatggcatgatcttggctcgctgcaacctccacgtcctaggttcagacaattctcttgcctcagcctcccaagtagctgggattacaggcgcctgccatcacacctggctaatttttttttgtatttttagtagagacggggtttcaccgtgttggccaggctagtctcgaactcctgacctcaggtgatccgcccgcctaagcctcccaaagcggtggaattgcaggcgtgagccaccgcacccggcttctgatcttgcatttgcttttattcctagtagttcttggcttccctctagtaaatgaaaacgcccattcctcatggttcagaacacacatgttcagagcttctaccacaatactttgcaaagagtgtaagcttgacaaatcttactgatacatctaatattgattaccctattttcagttcctcacatacagacttaagtattagtgttgttgaattcatggatgtgctgacgatgactcgtatgcccagtgtggcctgtaatttttaccagagctatcaagcgttgataagatgccagtcatcctcacataaacagcttacatttatcagtggcctttcctggagattccagtgggactcattaagtgctgcctgtcaagtgcatcccgctggctcagtgacctccactctaatttaatcgcagcagcattatttaccaagtgctgttgtatgcattagctcttgcggctgcaaaaattctacaagtgggtgttaaattgttcttaccattttccttctgtgatgtggaatctgaggcacgtggcttgccccaggccactcaggcagtaagtggcagagccaagactagaacccaggactgcaggcccaggagcccagcatttgcgtcctggcgctgagtctgtggctgccatccctctcccagaagggccacaaagtgcccgcagccatctttgctccttctgcaatttcttaccccggacacagcccttctccaagcagggtctttttttttttcgagacagagtcttgctctgtcgcccaggctggagtgcaatggcacgatctcggctcactgcaacctctgcctcccaggttcaagcgtttctcctgcctcagcctcccgcgtagctgggattacaggcgcatgccaccacacccagctaattttttgtatttttcgtagacgcagggtttcaccatgttggccaggctggtctcaaactcctgacccaggtgatccgcccgccttggcctcccaaagtgctgggattacaggtgtgagccaccgcgcccggccaggggtttcttttctgagaggcaagattaggtgactctgaagcccaccccgctgcctttgactctcctccgatcgacggcccttctacaggacccgctgtgtgttcctcagctctcctgaggctccgttctgcatgcgtaaaatgaggtgacagttccccactcacagggtgtcatgagcgttcatcagatcttccgagtccagagagagcctaccagggaattgcagtgtacatctgtgatggctgccataacaaaataccagactgggtggcttaaacaactgcagtttattgtctcacagtttgggaagccagaagttcaagatcaaggtgtcagcaggtttggtttctcctgtgtcctctctccctggcttccatatggacaccttcttgctgtttctcacgtggtcatccctcagtccctgtgtgttttctaatctcctcttcttatttggacatcagtcatattgaactagggcccatgtattaggccattcctgcattgctataaagaaatacctggctgggcacggtgactcatgcctataatcccagcactttgggaggccgagatgggcagatcacgaggtcaggagatcaagcccatcctggctaacacggtgaaaccccatctctactaaaaatacaaaaaaaaaaaaattagccgggcacggtggcaggcgcctgtagtcccagctacttgggaggctgaggcaggagaatggcgtgaacccaggcggcggagcctgcagtgagccgagatagtgccactgcactccagcctgggcaacagagcgagactctgtctcaaaaaaataaataaataaatacctgagactgggtaatttataaagaaaagaggtttacttgactcatagttgggcatgctgtacagaaagcatggtgccagcatctgcttgccttctggggaggctcagggagcttttactcagggcggaaggcaaagcaggagtaggcacatcacatagcaagagcaggagcaagagagagtggcaaggagacaccacacacttttaaacaaccagatcccatgggaactcattaccaagggaaggacaccaagccattcatgagggatctgcccccgtgacccaaacacctcccaccaggccccacctccatcattggggatcacatttcaacatgagacttgggtggggacatacatccaaactcagcccaccttaatgatccattttaaccttaaccacctctttaaaggccccatttccaagtacagtcacagttggaggtattgggggttagggcttcaacatacgaatttgggtagggggacacaattcagcccataatagcgagcacacctttcacctgtgtgaattcagccacgcagtgctggacaaaaaagagacagagaacaagatcttagacaacatgagtgattccacccaccattccagccaacaggcgtgtatcccacagggaagtagggacacgatgaaaatctactctactccaccagctccaggtcccctgtatataaacacgagcatctctttgagctgactgtgattcctgtgttcaaagatagatatttttcaggccaggcacagtggctcacacctgtaatcccagaactttgggaggccgaggcaggcagatcgctagagaccaggagttcgagatcagcctggccaacatggtaaaaccccatctctactaaaaatacaaaaattagccaggtgtggtggtacatgcctgtaatcccagctacttgggagactaaggcatgagaatcgcttgaacctgggaggcggaggttgcagtgagctgagatcatgccactgcacttcagcctgggtgacagagcaagactctgtctcaaaaaaaaggtaggtctctttcatgtgttgtggactctataaatgccagctaacttcttcatccgatgctcagccaaagaagccaggatcaagggtagctctgacttctgccttgtctttagaattgtagcagacgctgccggtgcctctgatccacctgaattcacctgcgcctacacacaggtccctgcaagccgacagcttcccagaaggggagaggagttaataccctgggtagggaggagctgagagtcaatagataaatgcacgcatccccagagggacccgttctgaggcactgtctttgtggtctctcagagggtccctggcagatcaagccccatggccccgagcaataacttgctcataattggcctctccctttcccttctttctctgtctacttccttacttgtatttcctaggaccaactctcaaattaagtacctatacccaaggccacatctcatggactgctttagggggagtcccatacgacaagactctccccccatgtaagatattcccggaacatggtaacatctccattggtggtccctgtagaccttgtcagaggagctgctgagtacacagtgacagcttctagagctccagttgcacatgggttctgccaaaccattccatctgctggccctggcatcgtagccaagtgcctttctctatcctcccttgcaggtgatcgagaaaaacttgagtggctggtggtacattcagattgaagataaggaagggtgggccccggccaccttcattgacaagtacaagaagacgagcaacgcgtcgagacccaactttctggctcccctgccccacgaggtgacccagctccggctgggggaagcagcagcgctggagaacaacacgggcagcgaagccacgggcccctcccggcccctgcctgacgcaccgcatggtgtcatggactcggggttgccatggtctaaagactggaagggcagtaaggatgtcctgaggaaggcatcttcagacatgtctgcgtcagcaggctacgaggagatctcagaccccgacatggaggagaagcccagcctccctccgcggaaagaatccatcatcaagtcggagggggagctgctggagcgggagcgggagcggcagaggacggagcagctccggggccccactcccaagcctccgggcgtgattttgccgatgatgccagccaaacacatccctccagcccgggacagcaggaggccagagcccaaacctgacaaaagcagactgttccagctgaaaaatgacatggggctggagtgtggccacaaggtcttggccaaggaagtgaagaagcccaacctccggcccatctccaaatccaaaactgacctgccagaggagaagccagatgccactccccagaatcccttcttgaagtccagacctcaggttaggccaaaaccagctccttcccccaaaacggagccacctcagggcgaagaccaagtcgacatctgcaacctcaggagtaagctcaggcctgccaagtgcccaagacaagtaccttgttggannnnnnnnnnnnnnnnnnnnnnnnnnnnnnnnnnnnnnnnnnnnnnnnnnnncctcccaggagaggggcctggccgcgcccaggacaggacgggcaaacaggatggtctcagcccaaaagagatttcctgcagagcccctccgaggccagccaagaccacagatcctgtgtctaagagcgtgcctgttcctctccaagaggctccccagcagagacctgtggtcccaccccgcagaccacctcccccaaagaaaacctcttcgtcatccaggccgctcccagaggtcagaggtccacagtgtgaaggccacgaaagcagggcagctcccaccccaggccgtgctctcctcgtccctccaaaagccaaaccttttctctccaactctttggggggccaggatgacacgcgaggcaaaggcagcctggggccatgggggaccggcaagattggagaaaacagggagaaagcagctgcagcctctgtccccaatgccgacggcctgaaggactctttgtatgtggccgtggccgactttgaaggagacaaagacaccagcagcttccaggaagggacagtgtttgaagtccgggagaagaacagcagtggctggtggttctgccaggtcctgagcggagccccttcctgggaagggtggattccttccaactatctcagaaagaagccgtagccgactccctttctgcctagagggcccgctggtccttgctggctttacccacgtatttaatacgcctcttaatttatcattctccacgcagcttccaaggcagacagactctggggtactgtgacttcttgcctcccatgggtggagagtgagtttcggacacctcgggcgcccctgggcctgatccctcctatcacagcatcactggaggctcagaacccacagcctttgctttctgtccatgtcagcatccctgccttaagagaactcctcctggccaatggcattgccacccagcagtgggaccaagactctccaagacctccaggactggatcccattgcctggagaaactccagcaagggtctctcatggcttggacatggcacagtaaggggcagccaacccagtccatgatgacttttgctccaacttcttcatgtttctaaaagcccagtggctttattcactcctcctaaattgcctgctaccagaaggaacttcatcctgaagaaatgcattccattaccagttccagggaaagtgtccccttccccaaagcctcaggcccgtgggcctctgaggttccactggatgcggctcccccaggagtgggcctggagatccgctcagccgccctgcctcccaccttctatcttgggaccgtggtcagccctgaagggtggttccagccccgcgtatgctgcactttgctgctgcaggctccggtccctccagggcttttcaatgagagttcccaccccaacttggagcatttcatttttgcctacctaaagcaagaatctcaaagtttgtttgaataagaggcccattcacaagtcgtgcccttgtgagcacccctttgctgagtgcctcgtgggtgccaaacactgtacttggcgctttgcattcatgctttgaccctcacaacctccctttatagatgaggaaattcacgctccatgtgcccaaggacacaccagccaggaggaagagggaagaggatttgagtccaggcctgcctgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccccggactcaacagctgcgtctccatgacaggagaatgccagggtcctggtggttggcacagagccctgttccctgcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcgtctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcaacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccatggcagttttcctgagttcttgatccactttggtttaaacaacttttgtgaagctatgtgagatttgactgcatttcaaaagacaaaacacatgtttttttctgatttgctctttgcctttcagcgacgctttcagatactttgtgagtgtctactctgtgctaggtgctgagtagactgggatgtgtgtggctccatccctggctggaagagctttgagtcctgtctgctgacttcactgaaggagtttctctcttgcttcattccttcctcccgggggtcagctgggtaggagcagacttgccctgccttcctctaggcagaaagttttcctgcaaatgaaagaatctgccattctcttttgctatgatgatgatgattattctgacatgacccgcgggtactgaagccacagtcctctctgttcactgttctctccttgagtcatatctatggcctgaggacgtctgtatccagctccttttcctacaatggtagacacttccccaggcagtgggtgggtcagggtggccagtcactctcctagctgtccttgcctggggacttagatttaccccatccaggactgtggtcgctattctgtgagcgattgatggcgcatatgcagaactcccctggagtcatggctctagaaagtgtccaggcccatcgtgacaatggtgccaagcaccgggctggtgaccagtgcctaaacacacacgctcccttaatccttacggcaagcctgtgaggcggataggaccagccctgatctatagtgagaaaattaaggttcagagggagaaggtccaaatagtggccaagctgggactgagatctcgagtttgggtttgtttgggttttgttgttgttgttctttccctcgtgtccatgacttttctctgccattagcagggaagtgtgcggagggcttccagggaatcaagtgaccctccctctgaatttcggtgcctcttccccccgccccttgctcacacatttcagtaggtcacaggccaaatggcagcccaaaaggtgggcagagatttttttttcttcccctcacccctgcttattaacacaattgtgacaactactttaccttacatcccagggcaaacggacagcttgcggtacctccaaaaatttggaaaaccctgagtctaagaccacctcttgataaaagaggcctttgctcacattttctgctcggaatctttctttgccattggtgggtgtatgtcgtcccagctgagactgcgggagagctgagctccagcttaaaccgcttttaatggcccttccctactgggggatcgctggagcccatgccaggttacggtagtcattttaaacctctgccacaaggccacgccatagaatcaatttccaagtcaatgttcttggccctaaaatgtttgcgcccactgaggatttcattaccaggtggaagatgggggaacatatgccacgttaaagagcaagtgctgagtgtgccaggacttgagaaggaccttaggctgaggagtggacagtctggtatttatttcgcctctcccaagtacccagcacagagtgggaaaaagaagaaactgctcctgccttccagtagctggcaacttgacatcaagaacaaaaacattcgtagctggacccccgtcctttcatcgtgcccaagtcttacatgttggcttaagctgcccccttggaggccgtacctttctctttggactgtgacagtggacacctaacagcctgagccatgtgtggctgtcttatcccccaagggttgtccaggcccgttctgcagggctgttgtgtagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtaagccttcttagctccaatcagggatgaggggctcaacctcttctgtcctcaaagaggccaaacgcagtgccacagtcggtagccttcacttttagatgtcctattcatgtaaaaaagaaggtgcccccaccaggcttacatcagcaataagcaattctaatgcaacgatggtgtccacattttaccccagtgtgtgcccatgtatgcctttgtgcccgtgtaattattgttagcgcccctttcacttagaggggtgatgataaactgtggccaccttgattacaacccacatttcctgctttggggagcttccaagtaacaggccatttcttacctccctccaggaacagtgggcactgcccaccacctcgtgtctgctcataggatgacgctggagatccccacacttactctaccctcttggcaaattggcattccggtggtggtttttgtttcctttaacacattaaataaatgagtatataggatgtgaggggaggggtgagaacaactagctgtagcatgtgtaggctatatactttaccattcgacttctttcctttttttttttaaaataaaaaaagtgcttgactggtttcaagcttcatcatgaagatgcagtgtctatggattttatttggcaggagaaagggtacatagctttgtggcctgggatcttcgggatcaaggaacagaaacctatgccagctatgtttgggaactgtggagaaataggggcgacccctctctgggccatagtgcaccttcattctcttaactacaatgtccacaaaccaagggaaagcttcctttatgtccaaaggatggtgaacctcttgccggcattgcctcctgatggtcaagagtgtgctatggaggtccaggcccagtggctcacacctgtaatcccagcactttgggaggccgaggcgggccgatcacctgaggtcaggagttcgagaccagcctggccaatatggcgaaaccccatctctactaaaaatacaaaaattcgccgggcgtggtgtcgggcgcctgtaaccccagctacttgggaggctgaggcaggagaattgtttgaacccgggaggcggaggttgcagtgagtcgagatcacgtcactgcgctccagcctgggtgacagagtgagactcggtctcaaaaaaaaaaaaaaaattgtgcggtgggggtttggggtgggaaatgcagccacatttgggccgcagagactgcccaagccatctgctcctgggaggtggagcacactgcctaacgttttactactttcccaaaggcagtgcccaagcaaaatcaaccccagtgtggagcctccttgttcccaggtgactaacaggacaccaccaccccaccttcctaaggagagaagaaaaccagcagagtccccgaacaaaagaacttggagggaagggatatacatgcaatattcatgcttctttagaggaaacaatataacaaccttcttgcagaccttgcttaggaataatggtcattaatatattaatctgtgtccccattagaaggagaaaaacagaaggtgtggtggctcacccgtaatcccagcactttgggaggccaaggcaggaggatctgttgaacccaaaagtttgagaccaggctgggcaacatagcaagacctttcctctactcaaagtttaaaaaaaaaaaaaagtagccaggtgtggtggtgcacacctacaggcccagctacttgggaggctgaagtgggaggattgcttgagcccaggagttcaaggctgcagtgagctgtgatcgcaccactatgctccagcctggatgacagagcaagactgtgtcgcaaaaaaaaaaaaaaaaagaaaggaaaaagtcatgcggtgttctgggcccccataggagcaggttcacccaagttcttgcaaaccaagagtgcttaatcataacaggactggcaatggtatgggctttgcggctggggctggaggggcatccgcctcatgggatgggacggcaatgggaccatgatcagggaccaaacctggctttctctttgcagtctacttgccctctcactacatttctgtcccgtgaccttccttcaggtctcacctggaagtgtcacactcgccattccctatcatattgttttttgttttgttttgttttttgagacagagtttcactcttgtcacccaggctggagtgcaatggcgcaatcttggctcactgcaacctccacctcccaggctcaagcgattcttgtacctcagcctcctgagtagctgggattacaggtgtgtactgccagctaacttttgtattttttatggagacagggtttcaccatgttggccaggctggtctcgaactcctgacctcaggtgatccgcccgccttggcctcccaaagtgctgggattacaggcatgagccaccgtgcccagccccgtcatactgttttaaccacgccaaacatgatccagctgcctcaccttctcatacctgcaaacactccctcatctaaggtgagtttctgagtccaagattaccatcacgggggcacgcttctccaagtccttggtcttcaatgtccattccttctctcattcagtattatttgggccacatgagattcttcggcgtcttgcaactcacgcttcctaatcaatggctctcaaattttaatgaccttaatgattcaccagggagcttgtcgaaagacagattcctcagcttcactccctaaaagtcaaactcagcaggaatcagcatcctgagaaatccattctgaggaaataatccgcatgctccaccctgagaaatggccgggctttgcaccttacctggtatagtctacatgttcaaaaattatattctgtgctattattattattaccatttatttttatttttatttttttggacaagagtctcgctctgtcgcccaagctggagcgcagcgatgcagtcatggctcactgcagcctctgcctcctgggttcaagcgattctcctgcctcagcctcctgagtagctgggattacaggcgtgggccaccatgccaagctaatttttgtatttttagtagagacagggtttcaccatgttggccaggctggtcatgaactctggtcctcaagtgatccacccaccttggcctcccaaagtgctgggattgcaggcgtgagccaccgcgcccagccaggatctaacttttactgagtacatgctaatagttgagaagtttatagatgttatctcttttaatcttcactacagttcttacagataggaaatattacatccattttatgggtgaggaaattaacagtctgagagattaatttacccatggccacagctagtaagaggatgaacttgggcatctgagccccttaccataagttcccgaatctataatcttcccacttagcatttcccaaaatgtttttcagaacaaatgtcgataggaatttggaaataagtgttctgaaggtacattagtttgagaactgctgtttaaagtctattgcaggacttcttatgtaagcataatcagcctcttacatactagtgtgcaatgtgaatgtctgagagggggtttacttacactgggtttctcaaatgtatttgactgtgataccattcacagagcatctatcaggggcaacgtttcatgtaataaactctggaaaatgtccaattttaaatttcagctctgccttgcattctacctgaaccataatgcctgtctaaccttagccacatccttcacccaaattctgtttgtaactcactgcaacagagagctgctcactgacttcaagctttcctacttgctattgctctaccttggagttgtctgtaaggattttcccatacaaattgagcatcccaaaatataaagacccaaaattgaaatactccaaaatctgaagcaatggcatgacattcaaaggaaatcctcaatgaagcactcagattacagattttttgattaggagagctcaaccggtgtgtattctgcaagtattccaaaatatgaaaaaaaattgatacccacaacacttctggtcctaagcattttggataagggaaacacaacccgcagtgagattgccacatataggaaacttcagaaaacagccaccaggcagggaatttttctatctcctaaacacgttttcctttagagacttgtaaattaatggcagtgtacagaacatacatattttattaataaggcccaggttcatcccctcttaagatccaggaggctggccgggcacagtggcttacgcctgtaatcccagcactttgggaggccgaggcgggcggatcacgaggtcaggagatccagaccatcctggctaacacagtgaaaccctgtctctactaaaaatacaaaaaattagccgggcgtggtggcgggtgcctgtagtcccatctacttgagaggctgaggcaggagaattgcttgaacccggaaggcggagcttgcagtgagccgagatcgcgccactgcactccagcctgggtgacagagcaagactccatctcaaaaaaaaaaaaaaaaaaaaaagaataacaaagatccaggaggcccagatcctacaataaactatgtcctcattcccttccagctgcgtgaaacttggcctccaatacttctacagtatagtacagaatagtgaacttcagttttcattgcatacccctcaataaaaatgttaatatgtgaccaggtgcagtggctcatgcctgtaatcccagtactttgggaggctgaggtgatcggatcacttgaggtgagaagttcgtgactagcctgaccaacatggtgaaacctcatctctactaaaaatacaaaaaaacttagctgggcatggtggcacgtgcctgtagtcccagctactcaggaggctgagtcaggagaatcatttgaaccgggaaggtggaggttgcagtgagctgagatagcaccactgcactccagcctggacaacagagcaagactccatctcaaaaaaaaaaaaaaatatatatatatatatatatatatacacacacacacacatacatatatatacgtatatgtatatatgtatatatatgtgtgtatctatacatgttaacatgtacaaaatacatggattaataaataaatgtcatgtacaatattgttacgtgggaaactcttacatacacccatgcttggtttgttcccttccatgtgaatggagctgcaatcacagtaaggctccagctctctctctccctgggaaagagtgactgatatttaggggagcaggaagcaggtatgcacagctcagcctctctcctactagggatcagatggcccagggacgcatattccactgggcccctagctgtgggaggaggcctgtgcctgggtcagtgagcgtgtcttaattcttggattcgagcttgagacaccatgactgccaggcaccacacctaagccagattctcccacggccctctcaagaataaagctaacattttgttctctatctctcggatcccactctctcagttaattctgaactcaggggaggagaacagggagctatttattaggattcttaaaaactgtctactgaggatggaagtggtggctaacacctgtaatcccaacacttcgggaggccaaggcagg

SEQ ID NO: 1329 - DNA, 5504 bp, Homo sapiens
cacaaatctgtgattacctggcgggtgaaccgctccggtggcggggagagcgggctcccagcgctgggtaggggccgggttccggcgagcgccatcccggagcgtcagtttcccagtttgggaagtgaggagaacctgcctcgcccttccccgccaaggcttagggaagggactatggcagttccaagaggaaatcagggtctcgctctgttgctcaggctggattgcagtggcgtgatcatgcctcactgcagcctcgacctccctgggctcaagcaatcctcccacttcagcctccagagtggctgggaccacagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaagtcagacagcctggagaagatcgagaggcgcgtccaagcactgaacaccgtcaaccagagcaagaaggccacgccccccatcccctccaaacctcccgggggctttggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatccccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggagatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtag

SEQ ID NO: 1330 - DNA, 2823 bp, Homo sapiens
atgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaagtcagacagcctggagaagatcgagaggcgcgtccaagcactgaacaccgtcaaccagagcaagaaggccacgccccccatcccctccaaacctcccgggggctttggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatccccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactag

SEQ ID NO: 1331 - DNA, 24080 bp, Mus musculus
  misc_feature (8547)..(9492): "n" at positions 8547 thru 9492  can be any base
  misc_feature (20171)..(20641): "n" at positions 20171 thru 20641  can be any base
ggtggcaatcactgagtcagtgccagcctcgtaaaattgggacaagtgaggactcagaggatggaacggaagaggaatggcacccagaattgcctcccaggacctacgaggtgaagatctgtctgcctggtggcagctcatcaccattagggcactagtccttaaccactgtatgcaacaggacacgagggtacgaacggggtcagtcacagctgtggagatgcaaacagatgaccttaatgataactggccatttgccatcccagttctcagaaattgcacaagccttcgcatgcctaagccttcccaaccagttcccaaccagtacgtggacacccatttctcagactgaaactcaggctcagcggcatcgggaggcatggtgtatagccctaggtaagtcacctgagctctctgggattcatttggcttctctgggcagagggaaggtgaacaaggcttgtcagtatcaagaggttatactgtacatctgaaaagcagtcatgttggagaatgggagttggaaaagtttgaggaacatctaaaaacatactaattagcctttccaatggaggggaagcataggcaattgggaagttcacggtgacactgctttagataggaaatggacccaaaggcccgaatcccaagactgactcttgagaactgggatttttgtctacagggatcagaagggccaagggcaatagtccactctgtgactggttcttgcaaggctgtgactaagccctttcaagtctcccaaggagaaaacaaaataaaattcataatgaaaaggaggtgtagtctatcgctgaggaatgccgtgtgagagtagacaccggaatgagttatcaaagcaagtctggtattcttcctctgatggccttaggagagagacctagccgagtgtgggtggttgaaataggattctggctgaagccaaggggacgacgctacaaactccagtcttcccttttttggttcctaaaacaaacccacaagaacttccagagagtcttgttcacggacacttgccagcactgagcctgttatgtgatctgaagacagaaggcgtttgataaatgaagagattaagggactcagtgagttcacctggctgttgggaagtgttgcgagcctgtgtccctcactcacaggctctggctcacctgtctgcttatcctcagccccttcccacggactcgagagagtgagtcaaatggactaaggcttaaatattgttgtgaagctttgtcctaagcccatatgtgcatgcgcacacacacacacacacacacacacactcaaacacatacacacacatacacatgtgtgcgtgcacatacacacatgctcaaacatacacacacacacacacactcacaccacatacattcacacacatgtgcaaacacacacacacacacacacacacacacacacactcaaactcatgcacgtacaccggcacacatgacacacatatggcatacatatacatgctgtctcttgagtgcacacgcatgtccgtgcgcgcgcgcacacacacacacatccacacacagagcttccagtggagaggtgaatttgtcattatctgcaaacacagggtgatggaacacctgtgtaatagggcacagtcctctgtcaaggccttactcatctctagtgtttctgagctaacagatgtggggccaaatcaaccacgtgcggcatgtcttcagcgttccttcatgagatgcaatcagagaaagagatctaaattgcaaaaaaaaaaaaaaatattttcttcctttcaaagctcccatggctgttgcctggggaaaaaaaaacctgtttataaaaagcaaactctgggctggacctcaccaggtccctggggtaaacactgcctgtgtgcttacaagaccattgactgaaactgttcggtgactcaggaataagcctggtggtgaacccgaagagcagaaattacacatttttgtcagttgctaggagtgtgactgtgtgtctagcctgtttgcatcatcaagagaagcaagagagattgggactgatcccaaaggccccaattctccagggaacccccccttccacgctatgaaaaggagtactcagatgtggaccaccccctaatgtgaggaggaggaagagagaccatttggaaggagctttgggatttgacaggaagcaatcaggtccaatccaaagatgcgctgcctctcttctagcctcaactgggtctccttccctgccctaatctacattcacctcttgcagcctagcaaccactcagagagacagcaactagagctctcccacaatgcccgagccatggtcagtagagtcagacacatcagtctccatcttaaagatgggaaaacagagcctctgagaagagaggtgccacatctcagtacacaggctaggtaggttagatcttggtaagcctggagttcgagtgcctgggttcatagctcaatgacttccactgaattaaaacagggcgtcgagctttggcgacttggtttctgcacctttaaagtaacaagattaacggtacctacttcataaaatgagcagaacaaaaggaatcaggcaccgccagccattttggtgctccatacatacaagccattattattgttgtgttgttattattattacattcttgttttggacaggtagccaacaggtgcagtttctaacctgtttcccctttatccagttttgcaccgagggccagggttttacactgcctttccacaccatgtctctgtgtccctgatattgttcccattcaaaacctcgaaggcttaaactctttcctaagccagtggccacatgggctgttattcagtgttatggcaggcttgagggaatgtcacgcctccttacctttgtggtacatgattaagaaccatcaatagatatgggagtgaagagcctgtctcccatggaagactagggtggtgcgatggcagaaagcacacatggcctctccctgaagcaaccatcaactctaaataataccattaccaaatgacagaaggaattgggaagatgtttccggattctttgccctctgtcctttgcgttcttcccggttccttgcctgtagcaggtgggaagaagaaccagaaagaaagaaacggcctagctagggcttcaggcagatttgtccttagctgttctctgctggtggacatggcattcagtggtctctacactgactgcagagggtggtacttcagagaaagagtagcctttgctgcatgcggggggtggaggggtatctacattctctttagatgaggctcctggaggtccttgctcggcagtgtggtatctctaagggaaactgtttgacatagcatgcaggaaggccagcagaactaatgaggagttatctctgaggttctctcactgcctggaagacactgtgttcccatccagaactctactggctggaacacggagagcaatcacacttctgaactcaggtgatgggcatagtttaagaaaatgctagtaacagaaaatgtggacagatcacacaagacaagttttgttcctagggcatactgaggcaaaaatgccctatggtgggcttaaatttgctctacatctcaggcatgaaactgggcatcttcctgcctcagctttctaaatgtggaccttacaggtgtgtaccatctgtctcctaaatttccaatcactttgatagtcccaaccttttccttgaaaaagcagtcattcggtattttgatccttctgggggtgggggacaggggagggtggaacttgtatcttaattaggttactttaaacgtgtaacttggctttctgagcttagaccttgtttttcaaaggataaaatctgttttaaagtgtattacaaaaacttctacctcgagggttcccgttcttccccccaaccttccttctcagtaatggtgaattcattattcttggaagcagaaactcagaacttggagagaaataccatgaatcctcccttcctccatatctgaagaaaagctgttctgcttttatttgatgtgagctgtgcatcgcatgagctcaaaacacacagctctgaggccaatgcaacaaagtccatattctgggtctgcatcttgctgcagagacttgggcatgtcatgtcccctccctaaggcttcgcccccacatatatgaaacagaagagattagccgtgttctttcaggttggttatgagggacacagtgatgaagctagaatgataaagttgtgtctggtgcatagcattaagcaatgaaagtcatttaataagtaacaattattgcatatttaatatgcagcaatagtgtgctggcagcttcccattactgtatttaatcatcacaataacttgatggtcattccattcactttccagatgaaggaaccagggcagagcagctatgaaatgtggtgaaggtacacacagccaggagtggcaacgttgggatttgaatggaaaaccagaacccaccgtcttaaccctaacaaatggtgaccaccttggtgagattattgagatgaaaccccaaatgtctgtacttagatgttatgagacaattgctttggcagagatgccctgcctgacccttttgtgaacatgaaaccaaaagtttcgcgaattcgacattagtcggaagagaaaaaagaattatttcccacaacctggcaatataaacaggctagtaaaatagacatgggtgggtttcccagttgtaatgaccttcatttctcatgtgatcatacataatacactcaatacagaagctcaaagcaaatttggaaaggaggcgttggttttaagctcttatcaccagacttaacatctgttgaattgggcctgggttgaagtaatcgtgcaaatagttaacagccatttgcctgctcatctggttttcaaaagccaggtttagtaaagtgatctgtacgtttgacaggatgtctctctgctgccctgacgcatgctttcattttatacgggacaaagctcacactctcgttttcttattgaccgccgaggaatgtacttcattccaggattgaagccttttaggatgctcacaagaccgttgcctgtatttgctctccttggccccaatgccaggcatggaagatgatctggaaatctctacccacactggactttctcttcacaaatgtaccttgctttctcctgccccaaggcccgtcctatacctacattctccccgaaaccttctttccagagatcatacccccccacccccaatccttgcatgtccttcagatctgtgacaggtgaggtcctcagctggatattttgttttgttgggagcaaacacagccaccgtgatggtgcctttgagtgatgtgctggacaaactcggtgggattcggagctggacctgggtctaggtaccatcatatccctcagagtgtagcacatgctggaatcacggttgatcatcaagaaatagttttaagactctgcccatccactgcttgaaccagtactgatacatctctgaaatatggtcctaagggtcttgtccatattatctatgccactgggatgtcattaactttggctccacagctctgtcaggcatagcatgagctcagctaaaacccataggtcctcaagtttgtcctgagatactaggtgtggggagctatttgtcagttagcatttgtctggtttttaaaggccacgtgctttgtgccatcagaattgcagatctggtccttgcttgcgtctatggttaagggggatgctaaccttggctgcatctcccattctccaccagcagtcgcaggtgggaggaaaatgacatcacatgtgaagatatccaaacacgtttcttggcacatcaaaatgcatgtggtaaatcatttgacgtgtctcttgagtaaccatcatcctgttaacacactttgtagaacagctacgagaccgaccgaaagaaagtccaaaaccaccctgacaaggcattccttaggaccttctagccatctcccaactgcccacagtgctactttaccctcatcccaggcagcctgcatcaaaggaatctcctgggttttttttgacctcctctggaaaaagcaaatgagtctggcagcaaattgttcctgacttgatatcttttggagtgtcttattcacatgtagtgacaactctctctctctctctctctctctctctctctctctctctctctctctctctcgtcatttgtttgttgcatttttatctaaacactaacagttcaaatgctccaaagtagggaatcctggtctcaccttggtattccactcccacatctcagggttcttcctctccgtagaacagaatcacaccccctgccttcctcttacccctccttgcctccaggaaggataccatggggttgggttctcttaagacagcagcattaatatgcttggtcattccttccctggaacaggtctgcagagtcgctacattggaattctccctctccctgaaggggtctgtctgtaacagccccctctctcttgccttgtagccaccctctactaccacctcagcttcactttcctctgaaatgccaaagcaagatgaaattgatgaagtcggcgtgttcttccctaatggggtgagccaggctttctgagcaccccgcatagtgaccagggcaagggacttggatcctgaagaccgggcagcagatttgaactggaccaccaatcaccagctgcgagactttaggcaagttcttttagctttcctgaacttatctgtctaagctcgctggggctggcttgaaatatgtgctcttgattttgttccattatctacgctgactacatttaaaggtttgtactttttttttaaaggggggaggaagaaagtggggtatgggggggtaagtaaggctatcaaagactggttctcctccgatgttctggaaaggctgagagagggactggccccgggcatccttcagagcctggcctgcctcggggcagctagcctctattagcacctgcctcccctcccccatgtttagccatagctgggtccagcgaagctcttaagggtaggtgagagagttcttggaaggctcagcttccacagggttcccccccacccctctccccctttctagactccttgatggtatggaaccacttctcttacccccactgtcctcctctgcgaaggttggtagcggcaatccgccagcttcccgcgctccagtcagttctaccatcatcgggcgtcttgccctgggctggcttccctgctccccattctctccgccgcccgggagctccccctcggggcggcgcgaggcggcagcctgcggggttggcgacagcgcgggggagaggggcggctgctgcaatcctcccgcccacgtgcaccgacggcagcgaagcgccagcagtcgccagggcccgcgcctcccgcgcgggtgggtgcttcacctctggggctggtgggggacccgtaacctgagtcccaccgccgggacctctatttgcataacccgaccccccatttcttccctacccaggctggagatgagagtcgggctccccaccgaggcgtcgtcttgcctgtggtcagcgcgggggccgcgggactggccggagcgcaggcggagcgggctggcgcacgtggtaagagcaccactatttcttccttttctcccccctctcccttcgaaacagggctttgcagggtttttaagagggtgggatacccacagaggtttcgctgagcgttctctcctgtcccctttgaatttgatccccaattggaaaggagatcgcgcgcagagcacgatcgagaaactttcccagataatgcttttgggcgtttgaagtaatggcgaggaccattcccgggagaacaactttcacggttggcacgaggagaacagcgctgctcagagagcggcgacaagccggctcctggtggcactggggctcccctgaccaccgtactccaatagggcaggagccggcgcgctgcggccgcgggcatcgcaggtgatgggcgggagagcgcctgcagcgccgcgctccctccacggcgtggcgccgtggctcctgcccgctggggatcctcgctgctccgggtagcgtgggtcaagaaagagaacagcctagcccggtctgaatcccttttctgcgggactttgaagctgagaagggcagggcagtttcccagcttgcgtctgctatcccaggctacgtagatcccggagcctcgggcttgggtaccctgcagtagccagagcgcatcggaagagggctgggcgcgtggggaaggtgggaaccgagtgtccggagggccagcagttttagctctcttaaaagtttttggtcatttagcaggaagctttctcctggaagggcttgtttatttattgacttatttatttgccggggaaaacacgtgtgggggccatggctaccagaaactgtgccatttgttgtcactcagcgcagaggaagctctaagcaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctcgcgccttcttcccgctgaactctgcagtccggagtccccgctgcaggcaggggccgagagccccagacccgggtggttgtccaccggctgcaaatcgttcctggcgagctcagcggagcccgcgcagccaagcccgtatgcaaattggccatgtgacggcaaaagctgccaggcccagccctgttcctcagtccatatatgggcagcgacgtcacgggtattgaagacctgcccataaatactccgagcctaacactttccgtctgagagagcagcgattgattaatagctgggcgaggggacacactgactgttataataacactacaccagcaactcctggctccccaacagccggatcacaggcaggagagagtcagtgacggatagacttttttttttctttaagaagccaacaacttggttgctagttttatttctgttaatttttttcttttttttggtgtgtgtggatgtgttgtggtggtcttttctaagtgtggagggcaaaaggagataccatcctaggctcagttcaacccctctccaaaaaaaacggcttctctggcgctccaggtagcgagggagttgggtctccaggttgtgcgaggagcaaatgatgaccgccaaggccgtagacaaaatcccagtaactctcagtggttttatgcaccagctgcctgacagcctctacccggtggaagacctcgccgcctcgtcggtgaccatcttccccaatggtgaactgggaggcccctttgaccagatgaacggagtggcgggaggtaagccgcgtgtcttcttcggagcttgtgggtggggagcggtgggtgtgggggggcttggaggggagaatggggacttgaggtggacggcgctgaccacactggctctgaagactggaagtaggcgcagggggagcggaaaaagatagactagggctgcctggccgtgcgcgccagcagatgcacctggtcaccaaaagccacccgcatgcctgtagctccgggcgcgcccagctttggctaggcgcagggttgaagcatcatctcctggtccttgaagcaggtccatcagccggactctgcgctactgggctagggtcaaagagatgggaaagttcatcagtcgggttagagctgcgcgtctggagagctcagtgtcaggggagcgcttagggagcgcgcgggcagcgctctctgggcagagcccactcccggaggatctcccgagcgcgttgtccttctggggtggctgggaggcaccacccaacttgcgcatcgccccaaagtgaacagggttaacaagccgaggcggcggagcagggcaagtaacagcgagaagcggcaaggagaatgcctagggaggcccgcgctggcaccggtgtgcgccggttccttggcgatgctgtgtaaagtcgtcttcctcagcccccgcgccttcctagaagcgcagcctcttagtcttaggctaagacagggatgcgcgggtgtccggcttggccgaggatgttgggagggaagggaaccctagactccttcctccgctgcccgggttcacactggcagtcttcagctgaagcgcagcgggagagggagggggaggtggcaccaggaattagcttcaagaacatcacccacccacttatccattctggggttcccctctctcgcggctggcaccttctctgtaccgcctgggattgattggtcggctctttttattggtgtctgtatggttgcctcggcggtaagaccacaaggcaaaggagtgggagagaagtcagaggcagatgggaaattgtttgatattgttgctgctattgggtgtttttattgggaactagagtcacagatggccgggagatggaagcaggaaggggcatgccctgcttcttggagatacagtttttgagttccagactctgcctaacttcttactgtctctccaggcctcagtttccccacctgttgctctgtagtgttggaatcatgaaatggggattgccgtgtgtgtgtgtgtgtgtgtgtgtgtgtgtgtgtgtgtgtgtgtgtgtccgcgcgtcagcatgcgtgtatgtgaattagttcttgcctgtattctcattgtcccacctcttccctgacttttccctccccagatggcatgatcaacattgacatgactggagagaagagacccctggatctcccgtatccgagtagcttcgctcccatctctgcacctagaaaccagaccttcacttacatgggcaaattctccattgacccacagtaccctggtgccagctgctatccagaaggtatcatcaatattgtgagtgcgggcatcttgcaaggggtcacccctccagcttcaaccacagcctcctccagcgtcacctccgcctcccccaacccactggccacgggacccctgggtgtgtgtaccatgtcccagactcagcctgaactggaccacctctactctccgccaccacctcctcctccttattcgggctgtacaggagatctctaccaggatccttcagcattcttatcgccgccatccaccacttccacctcctctctggcctaccagccacctccttcctacccatcccccaagccagctatggacccaggtctcattcctatgatcccagactatcctggattttttccatctccgtgccagagagatccacacggtgctgctggcccagatcgaaagccgtttccctgtcctctggactccctgcgagtgccccctccactcacgccactctctaccatccgtaattttactctggggggtcccggtgctggagtcacgggaccaggagcaagtggaggtggtgagggacctcggctgcctggcagtgggtctgcagcagtgactgccaccccttataatccgcaccacctgccattgcggcccatcctgcgacctcgaaagtaccctaacaggcccagcaaaacgccagtgcacgaaaggccctatccctgcccagcagaaggttgtgataggaggttctcacgctctgatgagctgaccaggcacatccgaatccacacgggccacaagcccttccagtgtcggatctgcatgcgaaacttcagccgaagtgaccaccttactactcacatccgaacccacaccggggagaagccctttgcctgtgactattgtggccgcaagtttgccaggagtgacgaaaggaagcgccacaccaagatccaccttcggcagaaggaacggaagagcagtgctccctctgcacctccatctgcccagtcttcagcctctggtcctgggggctcgcaggccgggggcagcctgtgcggtaacagcgccattggaggaccactggcctcctgcacctctcgaaccaggacaccgtgagatgaagctctggctgacacaccagtttctccaggccccagaggccctctgtccgagctgccaacactaccacccttccctgttcctccccatgatcccgtgatctgggcaaaggaccttgatggagcccagctctgtcccaccttctcacggacggccttccgaaaacttaggccatttgaagggagttgactgtcactccaagaaatgggggagcaaaaagagggctgggtgagggcccctggcctacagggctgcgctctgaccctgactgagagatgtctgactatggtctgctagccctttccgttgaccctggatgccagttgttctgagactttttctacaataggttgggagttgctgattcctttgatcgaggacagcggaaaagactaaattaaagcaaaactgatgtggcactttaatggcttgggactgacttgggggtgggggtggggagttgtacagtgagcagagcctcatcctggctgctgcactctggccctagagcagtgaatggaggtttctctggccatctcaacccttaagcaatatgtcctagaaactcaagagaatggaagtgcaatgtcgggcaggacaaagcaatattggctcctttttttgttgtagttgaggaacaaagattattttttcagtgtatatccatttagattttgtgtatttttgatgtgcactgctctccgagttctgaaccttcgggaaaaaaatgtaaagcatttatgatctcttgaaatgagtcaaaggttaactaacttatttaaagggggacgtacataggatgcatgcagtgagtggtgttgcaagtgtcctctgtgccttgtgtgatgtgggcagtgttaacagggtctgcatgtgtacaggatgccttactatgggaacagaaaaatcactccttgggtttaagtatggctgtatatttctgcctattaatatttggaatttttttagaaagtatatttttgtatgctctgttttgtgacttaaaagtgttacctttgtagccaaatttcaggtgagaatgtgcttcaatgtcactgccgctgatttgtttggttattagctcttaatagttgtggagagagaaacaatctattctaacataaaaaaaccactaactggagttcagataatggatggcttattgactatggtgtaaataaatacttttcaacaatattctggttgcagagatcatttctgaagtacttactgggtggagttaaaatagttattgacatctgagaactaggaacaaacaccgctttagtgaggggttagcacaagccctccatgttcccttgctggcctgtggataacaagccctacctagctaggcttcagggatttcccgctgagttagtgaggaagccttctgactcactgttctgtcccctgtaacagcctatagcttctctctgctcctgagtgggctccggaaaataaatacttacaagcaagtgcccactcagagatgacaccccccagggctgctttcagaactctgaccacggcctggaactctgagttgtggctttgtggaaagtgtggcagcatggtcaaattagaaatgactttctgagttccaggattaatcttacaaccacaggaaactttttcaaagagctatcattccttcagatcaaacctgctcggacaccgctgatgccagctgatgccaatgaaacggcttcagcaattaccccaggactcatttctctccagtcctggcgtctcagatggttgcccatgtttggagggatcatttgtcacaagcttggtggatctagaaatgattctcaaaatagcttaagataggtagacacgaggctgtaaaactccaagacaatctaaacttactaggtaagctgcctcccccaaaacattataaaactctaaggtttcttttttactgggaacattttatcattttcttttaaactcaaaaccatctgacctacccacttgtgttatgcgcgttggcatctttactctgaaaatctggacctcaatatttataatgtccactgctccttatgcaatgtaatctgcgggtgtagccacactgctcagcctcaacagaaaacccctcccttgcttctggtccctgtaaagtccctgaggctgatggctactaatcaagggcttgcattctacagtggtggtcacatctttggcccttaacagcacaaggataagagattcaatttatggaggccactagtgcccctccccagtctccttcctttaaccccctttcatgggtatagaaacttctttccagaactcctaaatagaaatttcaaaacctttagtgtgggatggtttccttataatttcccactggactcgggctgtcaactaccaaaactattattgttacttatccaatactggcaactataaagccacaccacatcgtggtaacttttaaatacctttctcctgcaaaactttcattatttaaagatagtacacacctaaattttgtagtttttagctatctttaaaattttaattttggaccacattcaatcaagatcacccaagccaggattttaaaagcaagactaaacatcacttaaagaacaagacaaaaagaagtctccatgctaaagcacaccggttatgtgatcagttccatcctggtgtggtagcaaacctccccaacaagccataagattcagtacacctgaatggtcagagctaccctttctgcttctgtccccagttacttacatacccgatatctttaaccaactttctcagtttaaaagcattcaggccaattctcctgacatttaaaatttttgcctaagaaatcaccacagaatggtaaatttggttcttttaatccctcccctgcgtcccccaaatgtttcaggttttgtgcagagagattccttaagagattcatgccagagatggtttcatttgtataacaaacagctgatgaaacctaaatgacttcctcaagccaggatatttaatatccgtatcctaattgtttacgagaccaaggcaaatcatttcataaaagttttcaactgttggaacaattcagcatgtgtgtggaggcatgtagatagactcctaaatgctgccagtccaaatggtaaccatggaattactaagacaaaaaaaagagatgaaaacactttaagccttaagattttctttccttttaggataaaaattgactttgtttttcttgctagtttctttagattaaatacaaaagcagccttttctgttacagcaaaatagtgtaattagacagtaaatactctcagatgtattttcagtcggcttgcttcaaagaccactcacaagaaaacaaactaagtttataccacttcttggtctttgggggatctgtaggtcactggcttttgatacaatacaaccttatggaataaactgtgagttttcaacaataattaaaatagtaatagttatgtttcccttctccactttgcaataagcaacattatttctacgtaattttaaacatgcttttatttcccataagtacacacatcttactcagaaacgtaaacacccctgcactgtaagactgggtattgttaagaaatgatctcctttgacagcagaaacctcagcacaatggaccaatctgggttctgtataaccctacactctgaattcaggcctgcggtagaggagcaaacgctgtcaggagagtggcagagtgacgaagtgggggtaactgtctctctgctgggcaggacaggagagctaaagcagttgactcatttgccatcagagcaggtaggttctccccagatgtcaagttcaaggaacctacaagacaatgcaaggatcgagtggggaaggaaaggtgtacattttgacagtcatgttaaaaactcaagagaactcactcctattaacatagaaaacacattacctaaaaggcagggttttttttttgttgttgttgttttttaatgtaatcagcagcatgtggtagtaaacccatcaattctcaaaggagtaggaaggtatgaaaatcttacatcgatataactggtcactgatagaactacaaggttgaaaaggttcagtgtatttagacagacagacagacagcgtctcactcaggatctagttattgcatttattattcatcagaacagttaagtgacttaacaccattgtgctcattggtcttttctaagaaaaggagaaggtaacttttatcctaatttctagaccacaatctatattgtagacctacagggaaacacaacggcagaagttatagctaatagtttatgcatagacgtgcaaggatttttctgcacattttatcttagtaacgagcatattctttctcaagtggctcattaaaacatattacactgttttcaccgtaagtttactcagtttattagtgaaatgacagtttcactgttcctattgaactaatgaggaacacagtattgctgttttagctcagaacaatttcgttactcttttgaaaagcaccttagggtttttttccttccaaactgcttataacaaacctttaatatttctcctccttcttttgcaatgaaggccttcataataattgttattactagcccaattccaggctagacttctacaggctccatgaaaggacctccagagtatgctgtaaagtacacatgactctcaacaatccttgtaaaggaatcaacctttgctgcaattcaaaatctgtatgtggctgaaaaaccatattcattattaatattctatgaaaatagtcaaatttaaaaccatcacttcctatctagatgttcatacgagtggctcaaagagctgcttcgagaggctccaaaggcattttaaagaccatgatcagaaagaacttgaactctagcagccatggtggaagtgtttgggtgttgctcatggtttgtcaggtttaaagcaggtttccactggcctgttgttctcatttttattaaaatgaaacaaacaaacaaacaaacaaaaagccacaagccaagccagcaataatttgctgtctcgtaccactttaatgactgcaccgggaaggacaccccttcagcctggatgtgtatcctggatacatggagccaaaagcagtttgtttccctgccaggtcaacaaacatttgtcactcatgacagtaagtctccatttattgccgatattagtatattctattgccacatgagccatcaagagagcttagaagacagctgggcacatctgatttctacagtttgtctttatgaaaaggcctgtgataaaaaggaaccctacacatagtaaacaggggaaactggtggtccatggtcagaatcgatagacacgtctgtaaacatggtaaaggggctgagcctccgccagccataatactgcagcagcgctagggtttgctgcagtgttggcatagggtttagtctccaatcttggtgccctaaatggctaaattctcaagcatctattccatgtatccatttcatatgtgtgtgtgtacatacatatgtatatgtgtatatatacatattcatatgttatgtatacacacacatttatatgatggtgtcttatgcatccacggttccgctcaaattcactatgtagccaagtctgaccttgacttctgatcctcctgcctatatttcctaaatgctgtgtgctacacttggtttatgtggtactgaggattgagcccagggcttcttgcctgcttagccagcagcctacttccagagcccctcccagggtactacatgctctctacctcttcctgcaagagaaggcagtagtaggcagcactggctcttgtttaagggagtgctgggaggctatctcccggcagcacagctggaaccacacagctcctctgcaggctccctccacagagaacgcaaaaaaacaaaaacaaaaaaccaaaacagaacaaaaccaacaacaacaacaacaacaacaacaacaaacagtcaagagtatctttctcttctttcctaggaagaagctggaagtaaatacgagtatggaattcaacaggtggccagggcctttacattcagttatttggaagcatagcagattccgctcctcggaatcgtctggttagaaaacacataattattgtatcatctttgaagcacgtcaaggaaaaagtcagctgaggataataatcgtctttgctttaaaggcaaatccccaatagcaacaaaaaaatttgtttaaacgacagatcttgagacccaagggaaagacgagctttaagggcctgacaagagaattcgcgtatgtgaccttcttactaaaggttacctgagtacaccagaagtggctaccaagccaggggaggaaagacatcgtcctcaacacgcacagttatgagggtgaaccccagtgctagaaagatgtcttttcagaactcctcactttagatgctgagtagtttgtgtgtgtgttttaaccaaacgaataactaaaaaaaaaaaaaaaaaaaaaaaaaagaaaacaagaacaattcaaggtcatgcacaatcagtaataaattaaactattaaggagcaatcgtgggcaggagagaaaacaaatctgagtcaccgaagggaagagggattcaaaactacttagtgtattttgtagagaatgagaaacaaaaatggtttcattatggctttaggatggaagcgctttagggtccctgcccggttcccttaaatcaaagccttggtggcactgaggataccaggaatcaacctagccttccgcccacccgcccccataaccgtgcccggtggtggctgtactccagtgggccgtgttccccaaggttcctcaagatgtggcgctggtcactccagtaaatccatcgtccaggcgagggggcggagagaagagcccttatggaagatagagggcagccaggcctttcttgagcagggcagggtacatctttggcccacagttccccgggcggcaggagcttcaaggtaggaccttggggcctggatagggctctccctcgcaccagaagtcgtcggcctgtggtgtctccaggagccacacttctcggggaaggtcgcaggcagagccggaagcctccttgggtctgatgggctccactacacggtaatagtggcagtcccggccgtcctccgggtcgtagggtggggccaggatgtccaggaaggcagctggcccgtccacggcatcaatctggtgcaggttgtacccggtgtggagtgagcacgcagggcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttgtcgcggggcatgcttggcgcttcctgcgcggctcgcggccggcccgttccgcctctgcgccgccccttgcggtctccggcggccgccacggctacccgcgcggacccccgcgccaggcgggagacctccccgcaacaaccggccagcggggcgcgcggggccgccttgcacggtcgcccgcttagcgcgccaatggtcgggcgcttgcccgcgcgcgaaggcgagtgcgcacgcgcacggccgctacccgcactcacgctccggggcccagacaggcgctggcgcgggccgtgccaggcgctgcctcacgcgcggagctccattcacgcggcccacaccaacgactacagccgggcgcggcgggagcgccgcaaggcacgctgggatgtgtagtccgagcctgcgcttgcgcggggcacgaacgcgtcctgcggagcaggggaaaccaggatttttttaagaacttggcagaaagcgagcagcgcgttcgttttgcagagcctcagggtgtttacttgtttgataaaactgaactattattgcaagagatatagccagttaactacaactcccgccatccccgcagtcggggtgacatacttccggcagctggtggaggcttctcgccgctgggaaaaaaacggcacaagagggtcgttaaccttcttgtgccgctagggcctgctgggtcactcggggtcacctttgacccttgctccctaggaatgaggtttcggggtcaaccttagctgctcgtaggccacactgtgtgcgccgtggagatctgtggatggcgcttgtctatttttctgtttcttaggaggtgaatggggtcgggcgggtaaccaaagcggtcacccagcacagctgtgcgcagctgttgtttgcctctgggcctgatgacgctgctccttgactcactgatagcgggaagctttgagaggccatttgctacagccaagggttctgtatactagtggttatccatccgtagggcgcccgagaaacaccagttgaggggcaaggggcgttttgtcagaatagattatcgctgtcatgagtctctagagcaatgcaactatcgggctggtttatgaagttaggtcaccgcagagtgattattctctggactttttgcagacgtaggtggtggctggcaaaggaagatagtagatattatgaatttaaatcttacccttgaatttaaggtcttcttggactttcagaattaaacatgggtttataactgcagtggcccaggaaatccttttcagttaagaaggcaggcttttagtgtgtatgtgtgtgtgggttttgcatcctagccagtaagtgtggtattccaggtaccttgttaaatacattaaataatgagttttatcttagtaataccctcacagaaacttttaagacgtaggcactgactgtattattccccgcctgtacacgagagattaatttgcaggtgcgcatttggaaaagacgtaagtgcaacttaacgaaacacagtttgaattggtgtaaaaggaaccaagggacacaaggacgtagcttctgcagcttattgtggtgctcacaagctgtggctttctgcacagcgtacctttccaagtcctcagttcattcctccaaagaatgctgggtttgatgcatccagacttctgagtcattgtttctcacccaaagtccctcggtagcttaaagggcgattctagacgttataccccagggcttctgattcagtattggggtgaaggatagaattctggttgagaggtgcccactgaagtggttcgaggttcagcacccatgttggggggggtgtcactgtgagatctgtaaatggtgagccaaccccatttacattccacagtaagagcaactatttggctacgtaaatggatccttaagattacttgtgtttgagccgggcagtggtggcgcacgtctttaatcccagcactcgggaggcagaggcgggcggatttctgagttcgaggcttacagagtgagttccagggatagctagggctacacagagaaaccctgtctcaaacaaacaaacaaacaaaaagattacttgtgttttagaagctggtggtgtgccatccttaaatgcactatggaagttcatcatgtaaggaaatcccatgcagtttatttgtaaagtaaggaatatttaagagaaagttcttttgttttcacatacagatttttttgcttactggctttacttgtataaagagtagttagcaggagaaacagacaccaaagagcacagacctaagcagcatacagcctgcttgatttccacgccccccaccccctctttaatagttgtctgcagttacatgaaggaagctgtatttcatctgtcaactggaaggttagatacttatgcaaatgcccaatgatgcctttgggaacagagtaactaccacaggacaataggtattattaagatttttcagtggctacaagttaccctttagagaccaataggtttaggcactcagtgagtgctaaagcaggaatgtggactttaccggtttcagagcagagcttttcaaggttattttatttgctttgacctagtaatggctcctctcaggccctcatttttcatctgctagctgataaaagtttccagacaacctgcataggaaacactgggggtgcttgtccaaagggctcgtcccaaattacattaaaatctgcaggagaatcttttgtgtgttgaagttttggagacccagtgggtgtccgcctgtggtactttataagtcacagggccttcacagttccctttgatgctgtccttcagagctgcaccaaggaaggaggataactgagcctagtgggtttgcccaccagaagggctttgctcggcttttctgtcccactgttagtagcacagctgggcaggagactgtattcatggcctttaaaaatagtctttatttttcatttctccgtcttgcggtatgcagagtgaaaaccaaaggaagggtagaaaaaaaagaaatggtaacaaaagtcaggaaaatgcatggcagggaacaagtttgggatatgtggaatatattgtcaataaatagtatctagtggttacaaaacttagtgtttggaggctcaacaaggaacaaggagagacaaggtgttgtttcccaaggaatttactagcaactgtgcccatctctaagagcatacaatgaacatgcaatacccaaatccatacatccatgatagctggaaagtcctttgggaggtacatagattgatgtgtagtcccatgatgtcatcggtggtgttataagaagatagcgactgagtttgcatgcttgtctttctcactatgtgacactacacttatctcgctaagacatagcatactaccctccgccatgttacgctatagcatgaagggcattgc

SEQ ID NO: 1332 - DNA, 2862 bp, Mus musculus
agcgattgattaatagctgggcgaggggacacactgactgttataataacactacaccagcaactcctggctccccaacagccggatcacaggcaggagagagtcagtgacggatagactttttttttctttaagaagccaacaacttggttgctagttttatttctgttaatttttttcttttttttggtgtgtgtggatgtgttgtggtggtcttttctaagtgtggagggcaaaaggagataccatcctaggctcagttcaacccctctccaaaaaaaacggcttctctggcgctccagctgcctgacagcctctacccggtggaagacctcgccgcctcgtcggtgaccatcttccccaatggtgaactgggaggcccctttgaccagatgaacggagtggcgggagatggcatgatcaacattgacatgactggagagaagagacccctggatctcccgtatccgagtagcttcgctcccatctctgcacctagaaaccagaccttcacctacatgggcaaattctccattgacccacagtaccctggtgccagctgctatccagaaggtatcatcaatattgtgagtgcgggcatcttgcaaggggtcacccctccagcttcaaccacagcctcctccagcgtcacctccgcctcccccaacccactggccacgggacccctgggtgtgtgtaccatgtcccagactcagcctgaactggaccacctctactctccgccaccacctcctcctccttattcgggctgtacaggagatctctaccaggatccttcagcattcttatcgccgccatccaccacttccacctcctctctggcctaccagccacctccttcctacccatcccccaagccagctatggacccaggtctcattcctatgatcccagactatcctggattttttccatctccgtgccagagagatccacacggtgctgctggcccagatcgaaagccgtttccctgtcctctggactccctgcgagtgccccctccactcacgccactctctaccatccgtaattttactctggggggtcccggtgctggagtcacgggaccaggagcaagtggaggtggtgagggacctcggctgcctggcagtgggtctgcagcagtgactgccaccccttataatccgcaccacctgccattgcggcccatcctgcgacctcgaaagtaccctaacaggcccagcaaaacgccagtgcacgaaaggccctatccctgcccagcagaaggttgtgataggaggttctcacgctctgatgagctgaccaggcacatccgaatccacacgggccacaagcccttccagtgtcggatctgcatgcgaaacttcagccgaagtgaccaccttactactcacatccgaacccacaccggggagaagccctttgcctgtgactattgtggccgcaagtttgccaggagtgacgaaaggaagcgccacaccaagatccaccttcggcagaaggaacggaagagcagtgctccctctgcacctccatctgcccagtcttcagcctctggtcctgggggctcgcaggccgggggcagcctgtgcggtaacagcgccattggaggaccactggcctcctgcacctctcgaaccaggacaccgtgagatgaagctctggctgacacaccagtttctccaggccccagaggccctctgtccgagctgccaacactaccacccttccctgttcctccccatgatcccgtgatctgggcaaaggaccttgatggagcccagctctgtcccaccttctcacggacggccttccgaaaacttaggccatttgaagggagttgactgtcactccaagaaatgggggagcaaaaagagggctgggtgagggcccctggcctacagggctgcgctctgaccctgactgagagatgtctgactatggtctgctagccctttccgttgaccctggatgccagttgttctgagactttttctacaataggttgggagttgctgattcctttgatcgaggacagcggaaaagactaaattaaagcaaaactgatgtggcactttaatggcttgggactgacttgggggtgggggtggggagttgtacagtgagcagagcctcatcctggctgctgcactctggccctagagcagtgaatggaggtttctctggccatctcaacccttaagcaatatgtcctagaaactcaagagaatggaagtgcaatgtcgggcaggacaaagcaatattggctcctttttttgttgtagttgaggaacaaagattattttttcagtgtatatccatttagattttgtgtatttttgatgtgcactgctctccgagttctgaaccttcgggaaaaaaatgtaaagcatttatgatctcttgaaatgagtcaaaggttaactaacttatttaaagggggacgtacataggatgcatgcagtgagtggtgttgcaagtgtcctctgtgccttgtgtgatgtgggcagtgttaacagggtctgcatgtgtacaggatgccttactatgggaacagaaaaatcactccttgggtttaagtatggctgtatatttctgcctattaatatttggaatttttttagaaagtatatttttgtatgctctgttttgtgacttaaaagtgttacctttgtagccaaatttcaggtgagaatgtgcttcaatgtcactgccgctgatttgtttggttattagctcttaatagttgtggagagagaaacaatctattctaacataaaaaaaccactaactggagttcagataatggatggcttattgactatggtgtaaataaatacttttcaacaataaaaaaaa

SEQ ID NO: 1333 - DNA, 1413 bp, Mus musculus
atgatgaccgccaaggccgtagacaaaatcccagtaactctcagtggttttatgcaccagctgcctgacagcctctacccggtggaagacctcgccgcctcgtcggtgaccatcttccccaatggtgaactgggaggcccctttgaccagatgaacggagtggcgggagatggcatgatcaacattgacatgactggagagaagagacccctggatctcccgtatccgagtagcttcgctcccatctctgcacctagaaaccagaccttcacctacatgggcaaattctccattgacccacagtaccctggtgccagctgctatccagaaggtatcatcaatattgtgagtgcgggcatcttgcaaggggtcacccctccagcttcaaccacagcctcctccagcgtcacctccgcctcccccaacccactggccacgggacccctgggtgtgtgtaccatgtcccagactcagcctgaactggaccacctctactctccgccaccacctcctcctccttattcgggctgtacaggagatctctaccaggatccttcagcattcttatcgccgccatccaccacttccacctcctctctggcctaccagccacctccttcctacccatcccccaagccagctatggacccaggtctcattcctatgatcccagactatcctggattttttccatctccgtgccagagagatccacacggtgctgctggcccagatcgaaagccgtttccctgtcctctggactccctgcgagtgccccctccactcacgccactctctaccatccgtaattttactctggggggtcccggtgctggagtcacgggaccaggagcaagtggaggtggtgagggacctcggctgcctggcagtgggtctgcagcagtgactgccaccccttataatccgcaccacctgccattgcggcccatcctgcgacctcgaaagtaccctaacaggcccagcaaaacgccagtgcacgaaaggccctatccctgcccagcagaaggttgtgataggaggttctcacgctctgatgagctgaccaggcacatccgaatccacacgggccacaagcccttccagtgtcggatctgcatgcgaaacttcagccgaagtgaccaccttactactcacatccgaacccacaccggggagaagccctttgcctgtgactattgtggccgcaagtttgccaggagtgacgaaaggaagcgccacaccaagatccaccttcggcagaaggaacggaagagcagtgctccctctgcacctccatctgcccagtcttcagcctctggtcctgggggctcgcaggccgggggcagcctgtgcggtaacagcgccattggaggaccactggcctcctgcacctctcgaaccaggacaccgtga

SEQ ID NO: 1334 - DNA, 24370 bp, Homo sapiens
attccaagcatctagcataatacctagcatatagtaggtgcttaataaatatttgctgaatggataaaggaacactatgagctagtctgggcatttggaagtgagagaagttaccctctggttcacctacctgcttatccacagcccctggctcagcataatgtgggctgagcctctaagttagagcagtggccttcaaatcccagggaatttggacaagctgtctgttattagtcagggttctctagaggacagaactaatggaatagataaatatataaaggggagtttattaagtattatctcacacaatcacaaggtcccacaataggctgtctgcaggctgaggagcaaggatagccagtctgagttccaaagctgagtctgatgttctagggcaggaagcatccagcatgggagaaagatgtatgttgggagactaggccagtctctcttttcacatttttctgcctgcttatattttagctgcgctggcagctgattagactgtgcccacccagattaagggtgggtctgcctttcccagcccactgactcaaatgttaatctcctttggcaacaccctcacagacacgcccaggatcaatactttgtattcttccatccaatcaagttgacactcagtattaaccatcacagtgtctcagtcctcttcatcaggaatttgcacagtggggaaggagtcaagtccactcaggttccactacagccacccacccatcttttacctaatatttatacatattgggcttccagatactagtttctatttgtctggtaacagtccactctacttgctattctgtgagagcaatctgtgattttaaaaagcctgaaacacaggaaaagtgaggaataagctcccttgttaaagcaccttccatctctaggatttctgagtaacaggtgagaggacgaaaatggtcactttggacatgtttttggtgccgcttgtttcatgaaattcaaataaagggaagaaaggctgtaataaattgttccagttttcctctttttgaagtgttcatgggttgttgtctgaataatcgtattttaaaaaagcaatctgtctaattccaaaaggctgggggttgccaggtctctggggagactctcttttgagcatacaaggccattgattgaaattgttctgttagtagtgagcacactggcaccacaacagcccttagagggaagcacacaatctagttaattatgaggatgcgagaaggagtatgaccatgtgtctgggcctgctattagtatcaggagaagcagacccaccaaggcctagttccaaaggccccaagactccaagggacatttccccactcccctatctccacatgagaaggaaaacacagatatggaccactctgcactgtgaggagaggaaaagaggccactttaaagggccttaggattggtcagcaagcaaacaagtcacaagtgagttcaatggttgatgccttgtcctggaatcataaacttggcctcccaacctaccccaatctatattcagccctgcctctgaaggcccagcaacccaaacaattgccctgggagacaacaattatatttgcagtattgtcctgcttttcagaatgtggtcttccttggatgtctcgcaatgctctggccaatggcacttagggcaggaatacccagtctcattttcaagatgaagaaacagaggctcagagatgctaagtcacttgtctagttacaccggttagagtaggtactgggaacaccagtaatggagtcagactacttgggttcacgtcttggcacttccacttaatcagctctgcaacttgggctttggtgactcagtttcctgagtataatgatatctgcttcatagtgtgattggtagattaaaacagataaagcatcccagtcatgaaagtgtttagcatcctgaaatgctcaataaatatcaaccattattatgatggagaggcaactattaaggccaattcctaatctcatggtatttccagtacacagtgttgtacccagcaccagcttcttgcattttctttctgcccaatcctctcccctgctccctccacctttctcactcaaaatagtgaagatgtaaaactctttttctaaacattatggcccccttggctgctacttaaaattctggcaggcacaaggggatgtgatgtctctacctctttgtggcatgaggttaagaagcatcactggatacagggaaagaaaagcctatctcccaaggctgtcactaaaggtttgagtgatgtgactgcagcaagcacaggtggtgccttctagcatcaaccacctaccccaaatagcaccatcagccattgtcagaggcagaactgaaactctgtgccttgagtcctttccattccccaggctacctggattgccctgcatctgggactagtagtaggtgggagaggagtcaggaaggagagggggtggctcactgctggctgctaccatgtcagtagcactcactatcctgaagacagagagtggcccctcagaccttaatgatttaaacctctgcaaaaggggatatctgaggacaaacccttcagaggatgctttctagggtccttgcccttgttctgaatacaacatctccctaagaaactgttagacatagcatgcagtgggatgggtagaattaattgggaattatctgacaagatagtataaaaatctcagatgcctctcgtcactggaaaggcatatattggattcctatccagaactttgcttgattggaatataaacagagaacacatttctgatgtccctgccttaaggagatttataataaagttgaaaaagtaatggcatggagaatatgtgagaagatcccacggggacatgctcctacatgggttgtacaaggctaagaatgccccttatggagcactgtctctagatttcgcaggaaatttgctaacacattcttcctaaattttatattttggttctatattcccaaacctccttggaagaacaacagtgctattattatgcattatggtctcactggaaaaaaagatgatatattaattagattattattaatgtggaacttggctttccaagtttagatgacattttccacaaaggtatagcttgttttaaattacatgccaataacctctgccttctgggttcctttttcgcctgctcagtaatgatattatcaatgttcttggaagctgaagctcagaattttggaaaaaagcgacaaatacttcatatatcaatgtttgaagtatggccactgtcttgcttttatctgctgtgggttgttctacattatataatgtacttgaaacatgtgggctttggtgattgagagaacagagttcatattctggttctgtgtgaacttgggtgagctgtgtatcttccctgagctttagttccctcatcagtaaaatgagaataaacagacctgtttctcaaggtggttgtgaggaatgaagcaatgaacctagaacatagtaaagtgtctggtgcagagtgaacagtcaataatagtaatgatttaatagctaacaattactgaatagttattatatactgacaatatgctatgggttttacatatattattatatttaatccttaaaataactctataatcattctgtccactttatatatgaggaaatagaggcacacagaagttatggaagtttttttttgttattttttttcctttttttttttgagatggggtctcactctgttgccaggctggagtgcagtggcgtgatcttggctcactgcaacctccacctcccaggttcaagcaattctcctgcctcagcctcccgagtagctgagactacaggtgcgtgccaccacacccagctaatttttgtgtttttagtagagacagggtttcaccatgttggccaggatggtctcgatctcttgacctcatgatctgcctgcctcagcctctcaaagggctaggattacagtcatgagccatcgcgtctggccagaacttttgactacctagatgtttaagtacatatagccaggtagtgtcaggatttgggtttgaacccaggacctcaggatttaaatccaggccatataggcctccagagcctataatcttaaccgtaatcatgagaaatagtgaccattcttattaagattatctgattgaaatatacaatttgctttcttttttggtttaatgctgcaaagcaactgctctgacaactggatgcactgactggcctggtccttttgtcagtataaaagcaaagcttctacaacaagtatgacatcatttggaagaagaaaaattgctccccgtaacctggtaatataagcaggctagtaatatgtgtctaaaaatccgtaagctcctcagttatagcaaactttattttttatacaattagagataataaattaaaggtataagctgaaagaatagaaaatataaaaaggcatgattttggatgaagattatgctttgagcctttatgatcagactgacagcctatcacttattaaagtggacatcaggtttgtatgtaccttgtcttaaacagtcatgatataccatgcattgatttaccttttgtcttttgccagcaatggtaaagtgatctgtagatttgtcaggatgtgtttctactagataaaactgcacttacaaactctattcatttaaaatgggacaaaattcacacagtctgtcatttccttattaagaaatagacaactaagaaatgtttttcattacgactgtcaccaagacacaatgctaatatcaataagcatttttgtgtatgttctccttgctgaaaccttgtcagcatgttctcatttgtctgcagaagctgagtggtaaaaaatttcaaatgtaaaaattctaatgtcactgtcattagccagaaaaagaaatggcagagcaaagaaagactcttggagaatgaaatctctccggagacactccaaggaggatgcctgtattggctaccttcagccccagtgcactagacatggagatggcctcagaagtttccaccaaccatggactttctccattcttcaaatgaactttgcttccctccaccttggcacctttcaacacctgttctttctccctggaatgctgtctccactgaccttcccccaatccttgcacatccttcagatctctgcttagagaagtcttcctcaacctcctagattcaactgggtcctttgtcattttctttcattgggatcaaacactgtcattgttcatagtcatgtatttgtgtgatgcacaatgctaattccatggggtgggaaccaggcctaattttaggcaccattatatccctggggtttggtgtagtgatggacacctggtagagaggcacacgaaatatctaaagggaacctgagcacccactgcttgggccagtgctgctgcttgtgctgctgcttctacaaaattagatcatagagctcttatctcctcctgtccagattatttgtgccaatgacacgtgacttaagttgtacattggactggtgcaaagcaatgctttcctcaagcttcacaacagttctgattggcgtagcctgggcttggtttatagcctctgggattaccagattagtagtgagatgctgaaacgtagagaaccatttatcactttttttcagcatgcaggggcactttaggtggatggcagagttggcaattgatctgattttcaccgaagtgcacatgttctatgccattcaagtttgaggtccccaccctcatgagtgtccacagttaaggcaaattctgaccttcttttgtcttccactccagtaacagtattagtatggaagggaacaaaaatgacattacaataggtagagcctataatgatgtgcaagaatgttaataaatcaaaacacaaatatgaacaaattatttgtgacatccctcttggctgatggtgatcctgtcaccacactgtaaatgagaatttcaaatctgggttaaaaaaaaaaacctgaaaatcactcgggagactctggggtccagctaggaccctcaggttgccacccctgcttgtcaccctaaacactctcccgcaaccccaggagcaagcctactaaagggtttctctgcatcgttgttattttactttctggctctggaatctggacaaagcaaattggaatctggcatgagtttgctactcttttaatagccctgatacatcttggagtgccccatttagtcgggcatttttacaggtctattttaaagaaagttgtttctttgttggatttttaatcaaaacaaaaaagttcaaatgcttaatagtagggaccatggtacatgtttgtattcaactctcacattctccatccccacacccctccacctccagcacagtatcttgctcagtaaaccctttggagtttttacttgtccgcacttctttcttttctcacctcttcttgtctccaggaaggatactgtggggctagcttctcttatgacagcgcctattagtatgctggctttgtgccagcctggctattccatccacaatctaggtctggagagcccaagaactcaaattctccctttacagtgggcagggggcgtgtccatgacagtcccttcctccttgcctgtagaaagccctgacctcagctttgctctcctcagaaatggcaaagaaaggagatgaaattggcggaggcggcctgattcttccctagtgggctgagtcaggctcccaatcctcaaagaagtgttcacttttcagacctgggttttcctgagggcacgatgtagcgaccactgtgcgctgtacttggattcagaagacccagctgcaagtttggacacgaccacttaccagctacgtgactttaggcaagccactttagctttctgagcttatccacagggtggctggcttgaaagggtgcgccttgattctgttccattatctgcactacccatatttaagggttggtacttcaagagacactcaaaaaaacaaaggttacgagagttatctactgacttgtttcagcggaggttcaataaaggcctcccaggactggccccaggcattccctggcttacccgcagctgccgcccgtccccgcccccactccattccctgcgcaccccaggctgatgcagcgtagctcttagggggaggtgtgagtccttggaaagctcacaagaatttcagagggtcagtcactctcatttactctaatgtgctttcaagactccttgatggggccccctcctccacccgccttctactggcatcctcctccgggaaaggtggcagccgaagacctcgcggttttccctcgctcaggcaccccgccccgcccccagccccggtcctgccctccgcgccctgctggccgggcactcgggcgtccaggagctccccctcggggtggcgcgcggcgaccgccggcgggtttggcagcagcgccagtcgcggggcggcccgggcaactcgcccgcctgccggtccgcccacgtgcgcagagaggagcgaagcgcgagcagtcgcctcgcccgcgcttgctgccggtgggtgcctcacctaaggggccggcgggggccgtaacccgagccccatcgcagggatccgcatttgcataattcggctttcccccgttctttcggactcagggcccgagatgcgagtcggactcccttccgaggcgtcgtcttgcccatggtcagcgcgggggccgcgggacccgccagagcgcaggcggagtgggctggcgcacgtggtaagaacgcagctatcttttcttgcttttcttttctttctttctttcttgagaaataggactttgcacatttttgctggggtggggtatctactagggtgctaaccttgctgcgatttctttccatgtccttttcatccccaattggaaaaaagcgcacagcgcgagcgagaaactttcccaaatgtgctctgggtgacttaagtcagagagatggccggccgctggataccggctgttttggagggagggggagaagcagcgcttcagtggaagagcagagggagagaccgctcccggcagcctcagggccctgaccgcggtgcgctgggcccggcgagagctggcgcacggctgcagcggtcgaggcaggtgagcggctgaagacccgcctgcagcgccgcgcttcctccacggcgtggcgccgtggctcccgcccgccccggcccacactaagctagggccgctccgggcccggggtgaaaaagggacaggacaggcctgcgaggctgaccctgcgcgttatccctggcctccgcggctttggagcgggaaagggctctggggcagttcgcaacctgcacaaacgaccatgaatgagtcatgcaggcggcggtgcgctggacttgggcacccgggaccagcctcctgtggggccccggacaggcccggctatccattgcgggctggggcgcactgggaggtagaagctttgcgcccagcaagccagaacctgctgctatttggactttggaaaagtttttaaaaattgctttgggaacgaaacagaagggtttctaccggggtctcgcaaagtaaaacgagtgggttgggggatggggatggcgtcttgaaagtgattagagatgctttcggccgtcactgaggaccgcgctgggctcaccgaggtgttttttggggagggagagaaaatatttattctagtacgtgtatcttggctcgggtgcgggcagggcgcggtcctggatcctgggctatgggggtcagggggattctgtggctgcagggaccggtagtgaaggttaggccagtgtcttcatagaacctcctgtccagcgagcccggagcccgctctgccgccgggacactgctggcaacgacggcgcgcggacgcagtcaacagggaggtgtgtagtgtaaggtgtgtgagcgggtgtgtgaagagggcagcgggggcgggagtgtgtagcggaagtggagcgagtgtgagtgtgtgtgtatgtgtgtctggaggggcagggtgagtgtccaagcttccatctggacgcccccacgcagccgaccgcccagacgcgccgggaagggcgcccgctccgcgcagcagctgaaggggggcggggagcgcgcgggcagaggaaggagggtgtctccggctgaggatttctctcgaagctccccacagtaattctgctcctcctagggtttaccctcccagtcccaaggtgcccaaaatacttaaacaaacaaacaacccaaacctgttccgttttcgctcctgtataaatagaacagactttccaaaaaagcaatacgcattcactcttatcaccagccacttctttccaccaagtaattcagaaaaaagcagtcagcttccgtgaatgcatgtagctttttttttcttcgctgcctccttttgcttgcggttttgagctgccaagaaagtgagtaggggtttgactgtagtgtctcggctccgctcggtttctttccgaagtttaattttccggaatggctcccaaacaagggctagggaggcggagccgccggcaccggatcttcgccttttttggaaagtcccagagaaccggaattcctccccgccccgggaggctgagccgcagcctggagcagctcgctctcctgctgtggctgtgactgggtccatggcgcgccctctcccccgcgatccctgcgccccggacccaggctgcagctagggccgcgcgcccgggaccccagggatccccgccgcctgcgagctggaagtcgcgagcccggcggagtccgcgcggccgagcccgtgtatgcaaatcagccatgtgacggcaaaagccgcctggcccagccctgttcctcagtccatatatgggcagcgacgtcacgggtattgaagacctgcccataaatacttagagcaacactttccgtctaactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggaggtaagccgcgtgtcttcgcaggcccggacctgcgcggcccggaggtggtggatggggtgcagtgggtgtgcgggaatcgcaggagaggattggggctccaggtggacggtgctgactgcactggctttgaagactggaagtgggtgcaggaggaacctgcgacagctgagaccagggcgcgcgggcagatgcgccaggtcgccagcaaacaggcgtgcgtgcgccccggcgcgcccagccccgggcgagcgcagggatgggggtggaagaggcgtccccccgggtttcgaggcttgcgtaggccctctggccggcagcacttcgacctcccctctcccggggcaggggcaaagtgacggtaaagttcggggctctcggggagagctgcgcgcctggagagccgagcggcggagaagcgccaggggaaagcgtcggtagctccctcctgggcagagccgaccccgggaaaatctcggagcgctcccttcttgcggcctggaggcgcgcccccacctgcccgccgcccgcgaagttgagggggttagtaaggcgggggctccggccggcggaggcagcgagtgggtggtggaggagggcgcgcaacggcgggaagcagcccccggactgccgagggaggcccgcgggggcaccggcgacgccggtttccttggcgatgctgtggaaagtcgtctctcgcggcccccgcgccttcctcgaagccgggccactggccttgggctgaggcggggacgcgcggctgtcgggaaaggcggagaagattgggagggcacggaaacctacggactccttcctctacatcccccattcgctccagcagccctcggctgaagcgcagcgggagagggagggagaaaaaggcacaaggcgccggggatggggagcagccgggaaatcacccacccccttctcgggctctcctctcggtttggcaccatcacggcactgactgggataggtcgattcttgggtggtgtttgtcttggtgcctcagccgtggaacccccaggcaaaaaagagggagaaaagctccgggcggatgaggctttttaaaatattgttgttgctattattgggtgttttttattggggactagagccacagatggctgggggtggaggggagttgggaaaagctcattctgcttttttggaggtagttcttgagttccatactgtcaatgggttgccacagttgggctggcctcttcttacagtctgtgggcctcaatttccccaccttttggactttgccacagctctacagtgctgagactctcggccttggaaatggacctatgtgagcgggggtgagaagggagtcctggctgtattttcattgttccacctccattctgcctttcccctccccagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaatatttttgttgcagaaatcatttctgaaatacttactgggtgggaattaaacagtcattcagtctctgtgggaatattttttaaaaacagcactaagcaccagtgaaaatgctttgaccaaaccatggtctccagatcttctttgctagcctgtggacaccaaccccaaagcaggctccattcataatcaaacactagtgttctggggatttcccccatgcattagtgtaaaagtggggaggcgttgttttgactcattgttccgttgtctctaacagcctatagcttctctctgctcctgagtgggctccggaaaataaatacttacaaacaagtgcccactcggagacaacacatttacagtcgctttcagaaccctgaccagggtctagaactcagacgagatgtggctttgtggaaagtgtggtggcgtggtcaagctggaaatgactttcagcttccaggattagtctcatgaccacagaaaactttttgaaaagcactatcatctcttcagatcgaaaatgcccccagacgctgctgatgacagcatgaatgggttgtcaaaggaattaccccaggactcatttctctccaaccttcacttcccaattgattacccctatttgatagaatcattgatctgccaaaggtttggtgggtctagaagtgacgatcaaagtactcagctcattagataagataggtgcctcaagaaaatctcaaagataacctaaactaaataggccaatatagtcctccatggtactggataaaggtttgcaaagaatatactgtagggttcatttcactgcaagtcttttgtagtggttttaaaatataaattcaccaaaaattagttaatttagccacaaagtaaacagacgatgcctttgtgaagttatcatctttactgtaaaatctgggcctaaaaatcatttaagttcacccacttctggatccttacacaaatgtaacatgttgctgcagcgtccactgtttagctgacatctgaaaatccctttgactatttgcccttcagcactgttaagactccctcagactcaacctgtatttcagaataacagatgattacagctactctggaaaccaccttttgcccttaccagcactagaatttgagatccaatttgtggagggaatgaatgcctttcttctgtatctcttctccatccctatttcaaggatgtcgaatctctctattctattactacgaaacaagagttttcagaacttgtttcatatttttttagtgactggtgttttcccattagttcctatttcccagcttgttggcgtaatatcatccttgcttgtccaactttggtaagtataagacaatgccacattttgataattacgtgattttaaagaatacttccctcctaccaagatttcattatattaaaatatacccaaattttgtaagatatatttgtcttgccaaattctaattttagaggattttcaatcaagataatcttaacaattacttacgaagcagtagactaaaagtcatctcaaaaataaaatagaagatattttgatgacagcaaaattggttacataatcactttcaccctgacgtgggcttggtgaggtagcattaacacacataccataaggaacaccacatctcagcattttctcagagccaactttgtggcttttactagtagatttcaacatgtgaggtcagtatctttaatccgattttgctctctgcttaaaatgttcagggtgcttcttgcacgtctcattttttacattgctcaagaaataaagcatagaaaaatgtcttcttctaatcttgtacatacacttttggagaagaattccttaaagattcgtagtgcttttgagatatttcaattcatattaaaaatgggttgataatacctacacaaggcttacaagttttcataaacctggctatttaatttcattatcccagctgctaataagattaaggcaaattgtttcatatatattaaaaatggctgcagtgacattttaaccacttaataaccacttttgtgtgtgtgtgtcggtggggggggggcagggggaagagcggtcagcattaacacaagtcccaaaaatgctgccagcagaagctaaaactaaacaaatactacaggaaaacaaaacaaaaaataaggaaagaaaataagtcctaaaactctttccttccagaatgaaagtatttttgttttcttgtatagtactatcttattttccttaggttaaatacaaagtaagcttttttctgttacagcaaaatagtccaattagacattagcttcagatgtgttttccttcaggctgtttcaaagctcactctcaaggaaataaactatttttaagtgtatattacttgggctttagaaatctgcagaaggccactagattttagtacaacataatcttacagtatatactgtgaacctttcatggtaatcaaactgtagacatcagagcaggtaaggttttccctatctgtcttgcaataatcaagtaagaattatctctaaacaatttgaaacatgtcttcattttccataagtacactgatttttttttcctttcttttttgagatgcagtcttgctcttgtcacccaggctggagtgcagtggcatgatcttggctaactgcaacctccacctcccggattcaagcgattctcctgcctcagccttctaggtagctgggattacaggcgcccactaccatgcccgactaatttttgtacttttagtagagatggggtttcgccatgttggccaggccggtctcgaactcctgacctcaggtgatctgcctgcctcagcctcccaaagtgctgggattacaggtacactgattttaatccagaaatgtaaacatccccagatttgggtttgaagattcaatatctataagggacttgacaaatggtttccttctttgacaacagatgcctcattgcaatggaagtgatcagtgattggcttctgtatatacgcttaagttatttagacctgcaattacaaaagtagcactgctctcaggttagagttggaaagcaagaggcaagccctgaattaaagatatattgcttcttcactgggctgtagagctagagcacaagattcagaatcagtaacagatgagtaatggcagagtcctcccgagatgccaggactgaggcacctagaaggagacaaggaaaagggggaataaaaggtgtggattttggaagaagttcagggttactggtgttaaaagctcagaaaaccctctcctgttgccaaaacacatattacttaaaaagcaggctaccactttcattaataaatagcagttggtgtaaatgcaacccattcaaatcaggcttagtaaaaatcaattctcataaaatagtaagtaggtacacaatactctgcattgatataactggccagtgacagaaccagatactttaaaagcttcagaagcatttagacagacaatttctcacccatgaggcaattattgcatttattattcaccataaaagtgattaatatcattgtgctcattagtctttccaaggggaagataacttttatcccacagttgttattaaaacattatctatattggacggagtatatagaaacacaatagcaacacaccaagtcagtcacgactaacagtttatgcacacaggtgcaagatagtttctgcaccacattttgtctttgtaataagcatattctttcctcagtggctcactaaaacaagttatattttgtcttcaccactaatttactcagaatttattagtgaaccaaaagtttcactgttcttattgaactaaatctgagatatcatattgctgttttggcctgcaacaatttcagttactcttttgaaaagcaccttaggttttttcttccaaattgctcgtaattgaaaactttaaaacttctttttttcataatgaagtcataattcttcctttattactatcctacagccaggatgagttttcgtagctttaatgtactaagttgtattataacacatacattgctattaataatcttggtaagctaatcaactttttgctacaatataatccaaaaaagtatgtgattgataaccacattcattactgtgctatggaaaaaaaaacaagatcttttattttgtgaagttttctaagaaaatcatttgcatatctagaattttattttcaaactaagtggcatgaagaactgcttcaaactgcccccaaaggcattttaaactacaccagaatgtggagctacaataaaacaattttagcaacaatgcaggaaatacttggtactatgcctgtgtcaggttttataataaagtggcatgtcctgtggaatatctttttgtgttttgttttggttttatttttaaatcactcaccaagtatttgcttttttatactatcttaaaaactgggaacaaatactccctcaccctgggtctctgtgtgcataaagaggcaaaggcacgtactgtttctctacatacggggtcaacattccactaataatagcaaatctccctttattatagatattagaactctattgccacttgggcaagtcaatcaagagggcttagacgacagctgggcaaattttaatgtgtttatttctacaatttctttttattaaaagtcttgtgaaaaaacggaatcctataaatagtaaaaagggagaaacagtgctccatggcctgaagcaaatggtgtcaatacatgtgtaaacaaggtaagactgctcggactattaaaagcacaaaaataaaactagtcacagatagcaagacttcatttcaggagttgggagtgggaagtaggaagtgtttaatcccaagttttggtgccctaaaatggctagtagtatagttaattctcaattctctagctgtgatcttctgtgccttctatctcttcctaaggaaaaccacattagatgaacccagggctcagtcattttagggagagggttgagacaacactgccagcaacacagctggaatcacccgagtcgggaacattaaagttcctgagagaatatgaaacaactatcaacataatatttctccctacttttacagtaaaatattggaagtaaataaatatagggaatgcaacaactggctaggagtgttttacattcagttgtttggaagcataacacattcagctcctttgaatcttcccgttagaaaatacagaattactctatcaccttttaaggtacagtaagacaagaaaaaaagtcatgtgaggataatacagtctttgcattaaaggtgaatctgcaacatgaaatctgctcgactcacagatctggagattcatagggaagataagctctaagtgaccatgtcacagagatatgcaggtgctgaatttcttagtagatgctgcctgagtaaaccagatgtggctactgggcaaagggagaaaagaaaataaatcttgtcctctacatgcatagttatgttgtgagaatgatccccaaactgaaaaaatcatttagttttcacaaggaattaattaggcaggccagctcactttaaacagtagctcatctccttaaacctagtttttaccaatgacttgaactaaaaacaattcaaaccactgggtcatgcacagtcaataagttaaaaaactataagaaaaaaaggcataagggcatgagtggaaaataaaccctatttaactaaggggtagggagtgggagcaagaaaaccacttagtattttgtatagaatggggaagagaggaagatattttcattatggctttaggatggaagcgcttcagatagtcccctgccccattcctccaaatcaaagccccagtggcagtgacagtaccaggaaacaatctagcctccccgcccaccccgcccccataaccgtgcccggcggctgctgtccagtcgcccgtgcttcccaaggctgccgaggaagcggctgctgctcattccagtagatccaacgcccaggctagggggtagagacacagcccttgtggtagggtagggcacgtcttcggcccaccgctcctgggcgccagtggcttcaagggaagaccttgggacctggatagggttctccctcgcaccagaagtcatcggcctgtggggtctccaggagccacacctctcgaggcaggtcacaggccgagctggaggcctccttgggcctgaccggctccagcacccggtaatagtggcagtcccggccatcgtccgggtcgtagggcggggccaggatgtccaggaaggcggcaggcccttccacggcgtcgatctggtgcaggttgtcccggtgcggtgtgaggatgcaggggccgctggcctcggtgtactcggcccgcgaacgcagcacgcccggccgcacggcttctcgctcccggggctgcagcggcggctcgaactgctgctcgggcggcaaggcccgcggccgttgcccgccgcccgcgtctagcttgtccatgcagctgatgcgcacggtgccgtacagcaccttgagcatgccgtgcatgcccgggtggtcgtgcagcgggatggacgtgccgctcttgagcaggaacacgcccaggctgaagccgtccgtctcgtagatgtgcatgtaggtgactggcggcaggttgggcggcagcggctgcagtgtggccttgcgcggggcgatgttcaagtcctcggcgcggagctgggtcaggaggctcttcagcttgctcaggttctcggggaagcccggctgcatcggcgcctccgggccagaagccgcgtcgcgatcggaagcgccgcggccgcccccgctgccccggaaggtgaggcaagcctggcgggcgatccgttggatcaaggaggccatgttgtctcggggcatggtcggctgctcctctgcgtgccgggaccggccccctcctttcctccgccccttgcggtccccggcggccgccacggctgcccccagcccgggtcgaggcgggaggccccgcaaccaccggcccgtcgggcgcgcggcaccgccgccaacctcagcagccacgcgcccgcaactgcccggcgcgctcgccttgagccccctctgagcgcgcacgcgcacgccccacaccccgcactcacgctccgggagcagatagcggccgcgcagacggtgccaggctttgccttacgcccggcgctccattcatgcggcccgcacctacgacggtggccgggcgcccggggaccctgcggagcatgccgggacttgtagtccggccttccgcttgagctctgagatagttcagtttgttgattggaaaatagaggaactattacacatgttgggcataaagcgatctttttcaggatgcagaggtgtttttcttgttttagaaaagatgaatcggggtggaagattagtagccacttgactacaactcccggcactccccgcagggtggagtgacgcacttccgtcagctggcccccggagtagtggaggctcttggccttcataaggaaaggggcagggagggtcgttaaccttctggcgccgcgctggggcctggttagccatgcagggtcgccttcctttggccttgcccctgggaaggaggctgttgagtcagccttagctcctcgtagcggcctaggcagcactgtctcccacgggaattgcaggagggcgcttttataattttgtgtttcctaggaggggagggggtccaggccgtcctctgtgatcatcaaggttactcggcccagctgggcccagctgggcccagctgttgtttgcatcaggacctgatgacgctgctcttctggttacagagcagtatagctttttgctggagagacttgagaggccatttacagtggtcgtggattctgaacatactagtggttatcaaatcttggtttgcctgagaagggggagcgggcttttataaatgcagattccctgtcgtcacccagagatggagttactagatggttctgaggcatcctaggagaaatagtggtgtgcaacagtcagttcagtcagtaattgtgaaattgtttcactacacagaggcatccttctccttggcgtgaactaacttttggcataagtaaatgactagaaaagcaagacattagatactatgactttaaacttaaccctgagtttaaagtctttttggattccaaagctgaacatgggtttcttgtacattttgtaattggagtggttcagtgaatcctctccagttaaaataggcatactttttaaagtggattacataacctggctaatgagtactcacaatatgccaggcactgtgttaagtgcattatataatgaatgttatactatttaatccttgcagcaactcttaagaggcaggcactattattattcccagattgcagatgagggaataagttgtaggatagtgaatactaagtacccagcaaagcatgagcagcagagcagaaataagtacagtcttaccaaaaacagcagcttgaattggtgtaaaagcaccaaacgagagtcaggatattgttgttccagcctactgtgtgtacttacaagctgtgtgtcgttaggcaaatcctacccttttagggcctcaatttattcatttgtagaatgccggtgttaagggaacaaaagttctgaaccctactcatcagaaccccctggagagcttaaaaaataaagatcttggggtcacacctcagagattttgattcagaagaactggagtgaagcctatttttttgtgtgtggtttttttttgtttgtttgtttgtttgttttgaggggtaacaaggtttatcgtgaagagcgaaataacaaagcttccacagcttggaaggggaccacagcgggttgcccctatgatttatatttaagatgcttcctcaagcaattattattattatttttttttttgagacggagtctgggtctgttgcccaggcgggagtgcactggtgcgatctcggctcactgcaagctccgcctcccgggttcacgccattctcctgcctcagcctccggagtagctgggactacagatgcccgccatcacacccgcctaatttttttttctgtatatttagtagagacggggtttcaccatgttagccagaatggtctcgatctcctgagctcgtgatccgcccccctcggcctcccaaagtgctgggattacaggcgtgagccacggcgctcgtccaagcgattcttgatcattagctcagtttgagaaccactggtagagctgtaaatagtgaaccagctttcattagttaagagggtggttatttgctttaggaaaggattgttaagactgattcatttttagaggttgccatgccattgttacgttatttaaatgtactttcaaagctgataaataaatttcatacagtctttttctaaagtgagaagtatttgagagtaaaattcttccccttcctttatttacaaatatggacttttatttattggttttacttctattagggtataattagtggtaagtatagactccatggaacacagactatattaacatgcagatctcttgcacttaatggttgtccacacttacttaactgaagctcaaaattttcatctataaaatgggataatatacctgtgtaaatcactgatgacactatgtagaacatagtagctgccccatgacagtagctattataggtttaaaatggctataagttgtacttaaagaccaatgaatttaaataatactaagcaagtattgaaatggaatttgacttgttttgagaatcagcttcagggtagagataaaaaagattattgcttaaaccatttacctggtaatttgctagtcatcctttggcctgagttcaaagtttccgaagactgcctgtatcagaatcacttgggagtgtctgtcaaaagtgcagattcccagatcacgtc

SEQ ID NO: 1335 - DNA, 2984 bp, Homo sapiens
taactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggatcccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattatatactcagagaacagaagtgcaatgtgatgggaggaacgtagcaatatctgctccttttcgagttgtttgagaaatgtaggctattttttcagtgtatatccactcagattttgtgtatttttgatgtacccacactgttctctaaattctgaatctttgggaaaaaatgtaaagcatttatgatctcagaggttaacttatttaagggggatgtacatattctctgaaactaggatgcatgcaattgtgttggaagtgtccttggtcgccttgtgtgatgtagacaaatgttacaaggctgcatgtaaatgggttgccttattatggagaaaaaaatcactccctgagtttagtatggctgtatatttatgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagatataatggatggtttgtgactatagtgtaaataaatacttttcaacaat

SEQ ID NO: 1336 - DNA, 1431 bp, Homo sapiens
atgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttga

SEQ ID NO: 1337 - DNA, 96600 bp, Mus musculus
  misc_feature (7789)..(7808): "n" at positions 7789 thru 7808  can be any base
  misc_feature (9978)..(9997): "n" at positions 9978 thru 9997  can be any base
  misc_feature (14125)..(14144): "n" at positions 14125 thru 14144  can be any base
  misc_feature (20780)..(20799): "n" at positions 20780 thru 20799  can be any base
  misc_feature (27797)..(27816): "n" at positions 27797 thru 27816  can be any base
  misc_feature (31149)..(31168): "n" at positions 31149 thru 31168  can be any base
  misc_feature (33786)..(33805): "n" at positions 33786 thru 33805  can be any base
  misc_feature (34873)..(34892): "n" at positons 34873 thru 34892  can be any base
  misc_feature (45961)..(45980): "n" at positions 45961 thru 45980  can be any base
  misc_feature (50121)..(50140): "n" at positions 50121 thru 50140  can be any base
  misc_feature (53877)..(53896): "n" at positions 53877 thru 53896  can be any base
  misc_feature (55271)..(55290): "n" at positions 55271 thru 55290  can be any base
  misc_feature (57012)..(57031): "n" at positions 57012 thru 57031  can be any base
  misc_feature (60915)..(60934): "n" at positions 60915 thru 60934  can be any base
  misc_feature (63387)..(63406): "n" at positions 63387 thru 63406  can be any base
atgcaaaggaaaggaatgtcagaatttgaaggaattccttgaaaaggaaccccatgtctgtgattacagctctcagcagatggaggcaggaggctcgggacttcaagactagcctctgctacagatagaactagagttcagctgtggctacatgacatcctgtccaaaaccccaaaataaaaacaacaagttagccgggcgtggtggcgcacgcctttaatcccagcactcgggaggcagaggcaggcagatttctgagttcgaggccagcctggtgtacaaagtgagttccaggacagccagggctatacagagaaaccctgtctcgaaaaaacaaaaacaaaaacaaaacaaaaaaccaacaaaaaaaccaacaagttatatgttataacttggatgaagtttgatttaagagtattatgcgaagtgcaatatgctagtcgcatataacagcagcacataataccatagaacccagtgaatgcagccatcttagcacataagtggatactacgatgcttgtacaagaacaaaattgcctaatgtggtggtttgaataggtttggctcctagagactcttgagtgtgagtgcttgactatagagagtggcactgttaggagttgtggccttgtggagatgggttttgagacctcatagaagctcaagtctgaccagtgtgacacaatccctttctgctgcctgtggatcaagacgtaaaactccgagttcctgctgcagcaccatgtctgcctagaggctgtcatgcttcctgccatgatgataattgactgaacctctgaaactgtaagccagcactgttgcgggaaatatctagagctagcccctgcaccagacgatctaatttgctgggtctctcagcgcagcaattcaccagccctgccacatgtctcccaccaggccatctctccaatggggccccgaagctcctctcaatttcacgaaatgccccacacatccctggttagccatttcaacacctagttaccagatagaatcaagactcttaatgtttaattagccaatcagatatatgtatcagtaataacacaatttataagatgccaatacaataatttcagagccaaatgataatgataaagctttaacacaattgttctagccttttgataacaccttgtcagcctccattctgttctcctcagatctctctttgtctctgtctctgtctgcctctctctctctctctctctctctctctctctccttaactccttcatccacctcccttctcctgtccaatcacaagcctcccactgccctaatgtgattggacagggaagaatcctgcaacacagccccaattaaatgtttttctttataaaaagttttcttggtcatggtgtttctttacagtaatgaaacccactagctaagacacctaacgatacatttcacaaaacatctcagggctcagccatgggtaagcacacttggtagccacacaaacatggtaacctgagttcaattcctggagctccactcgcttccaccaaaagaaagtggaagttgtcctctgactctccgacttttatccgtgttccgtgtcatgtgcatgctcacatacatcatgtacagaggctagtaattataaagggggaactctttgagacatggtctcacagtatagtcctgactggcctggaacttgctatatagaccagtctgaccttgaattcacagaaatctgcctctccttgcctccctaaaggattataggtgtgcaccccccccatacctgatccataaatgttaggtgatatatgtctctactgtatgatgtcaaagaaatgatatctataataaaaaaattcataggagtgggaagaatggtaactgccaggatgaaggaacagagaatgggagtttctaacagtatggagttttagttctgcaatatggagttttgcactttcattgggcccagtggcccatgcttgtacacctagcaaccaggaagttgatgcaggaggattgtgagttctaggtcagtctgagctacaaagtgaaaccctaaaaacacagttctatatattgattatataataatgtgaatatactcattgaaagtggctaagacagggctaggatgtagctcagttagtgtctgcctcacaggcatgacacccttggtttgatcctcagcacttcataaactggaaatggtgatgcccgtctgtaatggcagcattctgagacagagacaggagaatccgtaaattctttttttttttttttcttttttcttttttttgagacagggtttctctgtgtagccctggctgtcctggaactcactttgtagaccaggctggcctcaaactcagaaatccgcctgcctctgcctcccgagtgctgggattaaaggcatgcgccactgtgcccggatgaatctgtaagttctaagtcatgcttagctctatatcaggttgacgagcacactggacagcatgagttcgtaccgagaaacaagaaaccaacatccccaaataaaatagaaaaccacaggatatccagttagctgtcagtaacatttgaatgataaggctgtgtagctgaatcacgtaagtgatgcaatcatatgtaatgactgtacatctgcacttttgaaagtcagactttctaacaatatctgtgcatgtgcattgtggtagcagaactcaacacttatcacttacatctcctactctcaaatttttcatgcttaaatttgaaaataaccacccccctaatacatttaaaatgacttgagataaaataaggtgaaatgtcacttcagggctagaaagatagtccagtgggtgaaaggcttgctgccccagcttgacggccttagaaattcaaaggaataaagtactcgtgagtgtgttggatgacaactgtccctaccctggcacgctatggagcctgcaaatcattactgacagaaatcaaagttgaagttatggcttagtgcagagtatttgctgaaggaggttaagaagaagcacgttggaagtagtaatgttcaattcccagcaccatgataaggaataaatagcttctggaaatggaaagatagtctgtgttaagagggcaatctgtagtaacacaagcctataggcaaacaatcgaaacaaaagaatctcttgaaagaacgactttgggacactttggtgaaatcggaacaaagtggtcatctagttgatactctatcaatatcagctttgcaaatttaagatttttactctttacttaaataaacccaactctggtgtgacagctgtaatcccagcacttggcaggggctggcaggaagatcaaaaagtcactgtcatctttaactacatcatgattttgagatcagcctggacttcatgagacacccttctcccaccacataaagaaaataataatggccgggcatgctggaacacgcctttaatcccagcacttgggaggcagaggcaggcagatttctgagttagaggccagcctggtctacaaagtgagttccaggacagccagggctatacagagaaaccctgtctcgaaaaaccaaaccaaccaaccaaccaaccaaccaaacaaacaaacaaaaaaaaaccaaccaaccaaccaaccaaccaaccaaaaaacaaaaaacaaaaaacaaaaaacaaaaaacaaaaaaaaaaaaaaaagaaagaaagaaagaaagagaaaagaaaataataatgatgacaaaaatcccttataggctggtatagcctctctctctctctctctctctctctcacacacacacacacacacacacacacacaaatgaacacacacacacacacacacacacacacacacacacactttgttatttaaaagaaaaattggtctatgttctttcactcgtcatggcttagaattagtttgttgtattcaatcaaaaacagtattgggaatttggttaaaattgctttgatctgtgcgatcagtttgaggatctattatgatgtgaatcaaatggagagaagatttttgcaaaaagttgaaccccgtggggattctaacaaatagaaagtgggaagaaaaatcttgaccgtttgatcatttcttataattgtatctaccctgcttcctaccacgtttgcaaagtgggaggagagaggacaacagagaggatgaacactaactggtaggcatccagtgctcttctcaatccgggttttctctggtatgtttcctgaggacacactatttgaaacaggggaattgaaggtgagggttgaggggaaaaaaaaagattcaaagaatgcagttgaatatgcgtcaggaggctataaatgttaattgttgaagttgctgttcctaatgcctgtgagaccctgaagttcaaggacaggaattctgcatggggactggggactgtagagacgcgatatttaagctttagggtggggttgggggaaactcggtgagagttcctaaatgccaggggttttgaggtgtgacagtgctgcacggattggagaagaagttacaggtattccaaacacttggaacaaacaacacgtgcatgggtgtgatggaggccagatgtatttggaccgataagtagaggtgtgattgtgcaaaaccatgagtaccaggttaaggaccttggagtttgtcctgcgaagccagtggatctggaacagaaaagcagaacccacaccggctttaagattactgtggctgcgatggaggaaagcaggtggtcctgtcctggccagccgagccaccctttcacctgcagtgagcgcggtcccggcctggcgtcctccccgccccttcccttgacgctccaggtcggatgagctcggaactccgctacaatgcctgggcgctcttgctttgggatgcgacgagggagtacagacgcgcccccgtgcgtcacctccgttctggcagtgaggctgcctagcaccgtggagtggcgccaaggcgagcgtctgcgcttgcgccgccagtcggaggccctctgcgcgagaaggacgcgtttgtgcctggcgttgctatctgctgttctgggtgtttgcttttgtcctaagagatgtaggcagacagtttgcaaaggctcgatggctccacgacttcccctcttgctactccgctaggaagcaatttcccttgagccacttgctttcagtctgcagccagaatttcacactggtgaaaacctaacctggccgacaatccatgttcccagggcttgctccctttgtacttcaatcagagtcctagtgcaaggggatcttggagttcagttaccttaatgctctctggtatcttgaagtgagcttatgtagattttgctcgcacagtcccaaagatcaccaattttccagcgatagctttatggaatatttgtttgtttattttgagaaagggtttcactatgtagctcttgactgtccaggaactcactatgtagaccaggctggcctcgaactcctctgtcccaaatgctgggactaaagacttgtactactacacctggcaactctatgtattcttactgcacgtttcctctatgcaactttgatgccattaaaagcagtgcttcctgctgtgcatacgtaataaatcctgggatatgtaatgagctacatacataaaatgttgattttttttttttttttttttgcatttacattctagtgaggggagttcacaaatagatgtttgagtgcttggaaagagttatacaggatggtagttaattagactgatcagaagaggcttcttggagattttgatgtttagaactagccatgtgaacacctaggcactccagactgggaggagcggtgctttctgggaatacacaggctagagttgactagagtgtgatgaaccatgattgacagttgtgagaaaaccttatgttttaagtaagtgccagattggtaactttgtgtagaactttgaagtgtgtgttcttttagattttgagatagcatttcatgcagccctggctggattggaacctaccacacagctgagattggccttgctcctctgcatctacctctctcctgagggctgggattagcggctgcatcacttctcgcagcttgaaatgtgttttaataacgagaagccaaggaatagttttctataatagttgatttggttcagtcacttaagaccacacaaaccagttgttgaaaataactgatatatcagttgttctctgaaattccttttctaagtccttcctaagctataattcctctgcctttctctttaaaaaattatatttatcttgtgtgtggtgcacctgccattggccatgtgtagagatcagacgaacttctgggagtcagtttttctgctcccagcgtttgggtatctaagacagaacttgggttcccagtcttggctgcacctgctctttcctggctgagccctcccaccagcaggtctgctgttgtcttactactctgatggttaatggatggacttcaaactattactgaacacgttcaaaatgagggggacttctttttttttaagatgcaaatctgtacatgtattataaaaggaaaggcttgtagatttcattcagatcctaagaggtagtctaaaagatggtggtttcaaacatttttcatctgtgagatcttgtttattgtactacaaaacagcatggttcttccaactgtcttctcatctatgaaatgaaaactgaaaactaagacgttttactaagaaagcgttcaatgatagagcacatgtgccacagcgttgcacagtgccactacaggaagcaagtccatccttaggatggacggacaattcatagatactgcttttatagcattctgtgattttcatatctctatcctgggtcctgtaccaaggcgaggtgagggctggggggaaatccctcccttccagaagctaattatccagttgaagctatgaaagatcccaagcaggatggactaaatccataaataaaagcttgtgggtttgaatagacacatgatcaataaatactacacgtatgcgttacgtcctcatggcatggaaaggcagatggaaacaggcaatctctcctcccactagacaaacactgagcagtcgggccttttgttttttttttttttttgttttgttttgttttgtttttgtgagagggatctatcttttgtgcaatctgtttagtatacagtgcatgctcggggcactccttatcttcgtgctgggaacaaagtacacacaccccttttctgaaacacagggcctaggatctcctagagctggatgggctcccgggctgtgggaccacacaaaaggggcgcttcgcctgctcgcaggcccccacacccaggttctcgggtcgcgggttcgccttcagggtccttcagccccgcctctgcgagtgccctccccagcctctggcgcgcacccctcctcatccgcgggcagccggaaaacccggagcgaaccggcccgggccagcggcgcatgctcagttgcgagcaggttcagtttgctagtaggaagctccggcgctacaccggcggcggcagcggcagcggtagcagcagcggcggcgacggccaagcggccggattccccggcagcgacctcgggccctccccgttccccaccgacccctgctcccgcttcgtcccgttctgggcctctcgcttgagttccccgctggcgagcgggcgccaccggccggagcgtccatccacgcgccgtctctcggcgggccaggccgtgccggggagcgnnnnnnnnnnnnnnnnnnnncagaggcaggcagcatctttgtgagtttgaagctagtagtggtctgcataatgagctacaaaacagccaaagctacaaagtgagaccctatcttgaaaacaaacaatcatgcaaacaacatcaacaaggaatctcacagtctcagttttacatccaactttgtttgtatatttttacgtttggcttttctactggggactacaatctgttttagttaattcttgtacacgaagtgagctggtggtcccacttcagaccttttcatgaggagatagagttgtcccagcaagtgatggaaagcgtctcttcctcatgtgttgtcttgtcatcctttctgaaattcagctgagcgtaaatgcaaaggcttccttctgggctcccagttctgttgctttgttccatccatctagctttctgtcaacactgtgtgcctcccttcctgagagcctctggggcgagagaaggaattgccatgcttcattgtcctgcttcttcattggctggagccatcctgggttcaggactgaggtagcttgagaaagagctctgagccaaagcacacaaggtatacaatgtgaggatcaaacttggatttgaacttttaatgtctgaagatattttgagtactgaccttgcctgtcaagcacaacattgaaattgacaaatttgtagagggtagagaatgaaatcaaaacaaacaaacaacaacaaaatcagaaaaggggagatgagaaggatgctgggcaagcaagcccataattataattttgaacccttgtggtttcaagctagtctctattctgtttcatagttcctgaagcagcctgagaaacttcccattgcaatgtcaatcaatacaactgactagtccatccttgatagtgaggtattagtgattaattgtatgtgaagtgtttttaccttcagaatctacatctcgtttaagaaaactgggtgtattcaaggaaaacaaagcatagtgtatactccactgtgttataaatggtgctagatatgtttaaagggggaaagaaaggagcataagttaggatatttaagttatatttcaaggataaataagggtttagataatcaaagatggaaagagggtattgggttgtgtggacagacaggtaggcaaggagaactgaggccaagggggaatccagcttagctccagggtgagtgccaggactgcagagagaccttctgtggtagacttaggcatggctctgtttgaagaacgcctccctcctccctcaatgatccttgatgaaggagaaagtccttgtttgtccaaactgttgattcatgatggaagaaggatgcatacaacttactcagggtgaaccagagattaaatacctcttggaggaagggatgcccaggaagggaaactcattagcttgcgactctaggcctatctagacacctcattagcattagatacctctaggctctaagctatgtgaccatgactggatgtcatggtcctcttagtggggtgtcatcgtcatgtactccaggacagaaacctggtttggagtagattcaaatgcctgctattcttaattatgagaattgctggagttccttaatctgctccaccttgcctgttcttggtctggtggcatggtttcacttgccccacagagtgcaattgtacttggggtctcccaagcacatgagtaggttttataagaagacctgttaaggagtgatctcaagattttgggggctaaaccaagtaagtttgtagatgagcagcctgttttgttttctttaggcagaagcagactactgagaactttccatttggggaaagtattcccatgttagtctaggcattcagagtagcaaaggtgactgattctactttctcaccaaaatgaataccaaggctacctttgaatgcgttttgtttgccttagctgcctgacaaagttcatagacactggaaagaagcaccaatggaagtttccatagctatgtacttagctaacctcagatcaggagtatttaaaaaaataaaataaataaaaatccacagtctgagcttgcctcttagcaggtccttgctccaggaaagctgctctatttcttcattgtctctcaagcacatgatttctttacctatctccctgttcacatttacatgtagaccatgtannnnnnnnnnnnnnnnnnnncaggcgcagcagctgccttacgagtttttcagcgaggagaacgcgcccaagtggcgggggctgctggtgcctgcgctgaaaaaggtaggggcgcggaacccgcttcccggccgcagtccgcgcggggctgggcgagggtggggaggcggggcgccactgtcgtctttcttcccggtctcggatctcggggaggtctgctcgggctgcgaggttccccgcgtccgctgctccagctgttgacactcgcccggggtgcgtgggaaggccgcacacagtcggggagggttggtctggatcatccaagcgcggaggcgggggttggaggagcctcggttttccgtggaggtcaacgaaggccattgcctaccttctcgatcttccgaactgcggtcaacctctcgttttaggagtccggtactctcactggctcgaaagtgccttggccacagtgcttgcctaagtaattgcgaggttgcctgccagcaagaacatggcctgctcggctgtgctcgtcctcagtcataactccccgttttcttgaccccctcccccattacagcggtgatgcacatgccactgtattcagattggttcttttgaagtgtctgagaatctttgaacgtcatttggtttggtgttttgcatctttttatttggaaatgttgctacactttaaaagcttctaaagcaactgtctgtcctttggttaggcattttggatttttgtttgccagtggttaaagttattcgtgaatgttgctacattttaacagcttctacagcaacacttagtgacatagtaaatactgtactaagacatctgaaacaggtgtgcttgaatggattttaaaacaaccagattggtttttgttttcatttgccttacctgtagaaattgttttacaatttaatctcccatttcttgttgctcagatgattttcgtgctatctttgctaaaatgcagttttgttactactgagtacctggcgtttactgtgccattatgcagagcctttctattttaccagaaagtcttgaaaggtatttcatactcccagaggccagtacctttcagtttctcgtctgccctgttctccccttcccctcttggtatgttatgtggaaactgttggctttgttggaagactttgcttttatctttcagacttaggttcctgcgctttatcctcaagtgtctccctacttacaaacctctgtatgttttctaagaaaatcaaagagaccaccttgttgtgcatccttaatgactccatgagacttcagtccatttctacattggctttacctgcacaattgcctgcttagcttggagaattggagaagaatgcctcatgatgctagaagtttggtattttgacaggacaggatgaagacaaaaaattgatttatatgtacaaaagctctcatagaaccagtttgaggtatatggcttaaaagcaatagctcctattctaaggaaacctccaaaataacactcgaggctcctttagaatggtagacagagcattgtagaagttggcagactactctaacttgccacttgggtggtccttgctgaaatctattttgtgtggctggcattgtggattttgttttgtttttcaatgtatgtaattagtcaccagtttctttttttcgagacagggtttctctgcatagccctggctgtcctggaactcactctgtaggccaggctggcctcgaactctgaaatacgcctgcctctgcctcccaagtgctgggattaaaggcgtgcgccaccaacctcccggcagtcaccagtttcttaaaatgagaactatcacataaactctgaggtttgtttgttttgaattatagatggactggccatacattttcaccatcagtaaactgctagagttttgagtgactgctttctttggaaagggttttgtctccagttcatcagtgttgcttgtgttctatcgcttcatggttggttggttttccatttgaagcagagacctccctgtagaagtgatatgaagagggagtttacagagtctccctaatgtgtgaggttctttccctcatttacatttccacctgcaatgctcttaagacacccaagacaaggttggatatatttctcatattctgaatatgctcttttgtttttttttttttttcccgagacagggtttctctgtatagctctggctgtcctggaactcactttgtacaccaggctggcctccaactcagaaatccacctgcctctgcctcccgagtgctgggattaaaggcgtgcgccaccacacccggcctgaatatgctcttgtagctgaaaacttgaattatggtatgtgtgtagatgtgtccttggacattctgtgtgggtgtctccttatcttgagctcttcagactttaaactacttgcgtagtgcccgactgtgtgttttcatacctgaggctttttggatagcctgtgcattttctctggtctaatactattcaaccccagagatttttctcaacctagtggcccatcctaactcaacagtgaattttaagtcctaatttacttgtccatattcacattagctaccctattggacttgttgtacacaggtgctaggccttacacctgttagcactcattttggttgttttgtttgtttgtttgtttttgtttttttggttttggtttttcgagacagggtttctctttatagccttggctgtcctggagttcactttgtagaccaggctggcctcgaactcataaatctgcctgcctctgcctcccaagtgctgggattaaaggcgatgaacaagtgtctttgtaggttaccttgagtttgtcagactttaaagtaaattatttagaaatcttgctacatttttttaaagcttctaaagcaacattgtaacttagtaaatcttcacatctccctccttttggtttggcgttttgaatttctaccctttgtatgcttcatttagtttgccagtagttaaagttatttggaaatgttgccaattctgtaaggggatactcaaaactgacccccaccaccagtttttaacttcttgattaacggctttaaacttttatttaattggctcaaaactgaagcctaggactcctttccgtactgctgcctgccttcaggccaaaccttctgcttatcaacctctaacatgctcttggactctgctctgctaactgcttggagtttccgaggttactgtggtaacctctcagttgagttccttacccccaacccacctgcctttacatatttcagaagttataaagtactttcgaacatgttatacatttgttcaaaattgttgatgtcctttaagttaaagttagggtttgtttgtttgtttttttaagatttttatttattttatgtatatgacaagtacactgtagctgatctaggaaacaccagaagagggcatcggatcccattacagatggttgtgagccaccatgtggttgctgggaattgaactcaggacctttggaagagcagttagtgctcttacccgctgagccatctcagcagccctaaagttaagttttttaagcatggaatttataagacggctttaccttggccttcctgtttgatttcctacctagatctttctggagagcactgctccttttcctgaatgtatttattaggccccacagtgtctttcctactgcatctatcacatcccacaaatacttgattcttgtttcagaacaggtatggcctttggcactaaggataaatgacatatattaagaagactaagtcgagggaaggtggtagtggatatgtctggagagaggacttgtttttaagccagggattttgtttttgttttttttgttttttttttttttattagatattttctttatattcatttcaaatgctatcccgaaagttccctataccctccctctgccctgctcccctacccacccactcccgcttcttggccctggctttcccctgtactggggcatataaagtttgcaataccaaggggcctctcttcccagtgatggctgaataggccatcttctgctacatatgcagctagagacacgagctccaggggtactggttagttnnnnnnnnnnnnnnnnnnnnagtgacccattggagcagtagtccttaacctgtgggtcaaaactccccacaggggattgcatatcagatatttacattataactcttaacggtatcaaaatttcagttatggagaagcaataaactatctatcagttctgctgacaagcagctgtattaaaggtcacagcatgggaaggttggaaaccactgcattagtgagtgcagaaatgctgggccttcctcatgctttctccacctctcagaacactgtatttctccttcctgagaacaggatggtatgcgagcctccttctctgtttgaatattgcatttgagggaagatgttatgccattggtcaatgagtccagagaattagtgtctctgaatgtttgttttagatatttgaatttcagtctaaaccatttaaaggcaaagaaagtgaaacccaacaagttcaatgtttagctagcgagatgtttacccatgaaacaaaaatagacacaatattatgatcactacaaattctaaccagctaaaaattctctgtcaggacataaaaagtgaattttttttccttttacctagccattgcaaaacaaaatttctaactattgactgttttaagatgggaccaaagtacccccccccccaagggtactgtgctaagagcaaattgacctggagaatcccatacacttagtggtaaaacctggactatcagaataggttctaatcatggcctaagagaaacacttttcaaacctgtttgattttatatctccccctttgaaaatgggtttataataaacctttccgtgatctcaaggtattggcacaataaaaacaaagtataaaaaagccgagagtgctttgtcaagaacagactactgaaggtagagtgcccttggcaatgtagtcatggctgtttagctagcagaactctgagcctttccacaggaaatgagtgcaaatagtcatcacagaaaaatcttactcactaaaagccatttctcagtggaaaaaaccctgctatcatgcatacgtatgcatgcacatatacatatgcacacatgcacacaggtgtgtgcacatcagtatcactcaagagctaaacacttaatgggatgtggtaaccatagttacaaaatctagcacttgggaagcagaggcaagaagatcaggagttcaaagttttcattaactacatagagagattgaggccagcctggttaaatgacactctgtcccaagaaaaacaaaatgaagaggggaaaaaaggaggagaagaagaaaggagagggaggagagaggagtgaaaaagagaaaaagaaaactaaagaaaaaaacaaaaaataaaaaatgaaacacaaagaaaataaaatgctatgaaaagctagtatttgcgctgaacaattccttgtaggtgagacagaagcatttcagggtgacacaaggtcagagttttttggcagggcttcatccttttaccagtttccagactgtcatcttgctgagtcttcacttggtagactgatagcttaccctctgagctatatccagcaataccagcttcactcacaaagccctcttcaccttcatgacataattcagggagactttaccttgactacaatccttctgggattggagtttccacatatggatttggtggcatgggactcacgaattcaccctattatagcacgcacacacaccctttttgagacagaattggtgtcctggaacttgctctgttgaccaggctgggccgaaacttacctgcctctgctaccctcatactgggaaaaaaggcctgtgataccatggccaatttacggcaactatatctaagatggaacaagagacaattatttatgtaaaaagagaccgcaaaggagtactatgtaatagtcttttgaaataatcgaaagaaataaaaactccgaggtggcagaacttgatttaaataggagagagagagagagagagagagagaaagagagagagagagagagagggagagagagagagagagaggccctgatttcaatttccgacaagtggtgagtggagcacacaatggaaaatagatactgtaggaatatatagagtcacaagggagagaggagatagacagtccctgtctgaagagctagtggaatttgatggctgttgtgagagaggcagtcagttttcttcagggatgcagccattgggtggttacccatgctctgataggttgttccataactgtgcatgtataggtagcactgagtgactccagtttgaaagagtacatggcgttgggaaggattagtagtggtgggatatagagagaaattggagtggaagggtgagtttgatcaaaatgttttattgtcttaattactttctactgctgtgaaaaagacaccaaaagtaacttggggaggaaagattggatttgtcttacatttgctgggtcgcgccgtctactgagggaagccaaggcaggaacccaaggctggaagctggaggcaggaaccaaagcagaagatttgaaagaacgcagatggctagcttgctccccatggcttgctcagcctgttttcttatagtactcaggaccacctgtctagtgggcactgtccccagtgaacatggtcctctcctgtcaattatcaatcaagaaaacaccctacagacttgcctaaagaaaatctgagagagacaccttctcaactgagatttttttttcttcccagataactctagcttatgtcaaggcgatgaaaagacttaacccaaacatgtatgtatgaaaaatctcaaacaataaaaaatatttaaaatgatatgagggaaaagccttatagaacacttttaaaaaaacagttcaaaaaacaaaacaaaaacaaaaacaaggaataagatgcctttggacctttgttgaagaaagtattgaagagttatcttcaataacccggaacaccaaaaaaaaaaataaataaataaaaacaaaaaaaaaacaatagcaaaacaaaaacaaagacacccccaaccaaacaacaaaaccccaaactacaggaaagtttaaatatttttaacaaacagaacaaagactacaacaacaacaaaagagaccagggtggcagaaaggaactttgcatgttctctcaatttaatttagggaatgattgtctaataaattagaaggatgtgggatagaaatggtgattgtttcatctataatatcagaaatacaattttacaagacattatttcaggttgataggcaaatagtaggagtaaaagaatatttaaccaacactaagaaatacaattttattgattcaaagagcaggcaaggaactgacaaaaacatagagaaaatataccattattatcattggtttttatatagaattaatggtataaagataaataggaaattaaaaatgtagactttcttaaatataaaaatccacacatgcatgaagcagattactgtggaaagacttgaaaaaaatacctgtccttagatagaacaatacgacagaccaaaggccagacacatctttcatgtcaataaatgtaaatgaatatgacccacctaatataaagaaaaacttttcacattgcagaccaaaggaaccttcatactttgttctgcattcaggagacacatctaaaactttcagaagagttaaaattaaagtcgttcttgagatgtcaatatcagatacagtggaattcaggatgaaaagcactttacaataaaggtcttttataatgccaaaggggacaattgatagtgaagatataaaagtcacaaaaaatctatgctccaatcaaaagcagtaacacccatgaagctgaaatgataaaaattacagggagaaattaacaaaaacacacaaatataagagattaaggtcttaaaaaaattggcaaactttattttacttttaaaagtggcagctgttctttatgtttccttattgtgtacaacatgttctaaagaactccttaaatttagctaaatagcaaatttgtttcattaattagtatttttgagatgagagcatataatattcactatttcatatttcaagaatataatatgtcttaagttgctttctactgcgataaaacgctgaccaaaactaacctgggagagaagctttggtggcttacaagtcacaatctatgatgaaagaaagtcacgcaggaactcaagacaagaacttggaagtaagaactgaagtagaaagagcacaagaatgctgttattggctgcactttcgactcacgcgcagctatctctcttatacttcttgggactaaagcccaggaatagaactccccacagtgggctgggccctcccacatcaatcactaatcaagaaaatgctcaaacacacttgcctacagtcaatctgatggatacaatcttcagctgaaattctctcctcctggatgactctttatctttgtcaagttgacagacaaatttaaaaaattcgatcattggtatccatcattgaatttgggcttctggagatagctcagtcaataaaggttactctgtaaaagctcagacatacaaatatgcattcctcacataaacatgtacatgcatatgcagatgtatacatataagtacagagtgaaataaactttgatgaatcttaaatattggtcctccattatcaaaacatgtctacttcgaatgtctatggactcatgaaaattgaaatatttcagatcaccgagtaatcatcagtggatgtattttatcacaaccaacttaatgatcatgatcaagcaaaatcagaaataagccagaaaaaccaaaggccacttcatgtgataatacaaaagttttaatcatatataattaatgtatgcaaataaaaattttgtgaggttctgacttgtgacacgtacccacaaaagggctataatgcaacattaagcaatttctaaaagcaaaacaaaaccaatggaaaaaacaaaggtatgtattaataaataaaagtaagtttaaagaacaggaaaaaagataattttaaaccttgagtcttggcagaaaaagaaaagaggaatctggtttactggggaaaaacaaggggaatataattatataaattagaaagtgacaatgtgagactaaccccagaaggaagccattcaaagaattctaagatgactcaattctatgcaaataaatggaaaaatctggattaaatgaataaattaccataaaaattagtcagtgcaagcctaccaatttttaagaaatacccattgtcaacaatgtccaaaaaaaattaaccagccacagacaactttacaggaatatctgtgaaacatttcagaaaaatgacttgtgtgcagctggactgttccaaggatgggagcagtttaagttgtaagtctctgtttctcacatgggcaatatctacacagagaattcaacgcagaggaagaactcatacagaaggcttaacatagggaaagtcatttgtggcgatcagcatttcagacagctctttttgtccattaatttcctaatttaatgtggtcttaattaaaatactagggattcatttcacccagaaaactggctcctaaatttcacatagaaaagtacaaacagtgataacaacaaacgcctaaataattaaacatggtgattcttttctatctaatttaattttattcaaacaatgtatttccatcatctcgtcccttctccaacttcttccggattcttctcacgcctgtgcccactcaactccatgttctttctctccatccaaaacaaaaataaacatttaaaaaaaagggggaggcggaggcggaggggctagagagattgctcagcagttagcagcactgactgatcttcctgaattcaactcctagcaacccagtcaccactggctcacaaccatctgtaatgagatcggatgccttcttctggagtgtctgaggacagcaacagtgttctcacatacataaaacaaaatttttttaagggtcgctaataagacacacgtcataatgaaacaaactaccctgcctttacaaatgggggtctatgaggaaaaggaggaagagcgattgcaagagacacaggtggtcgatttctccaaggaaagcagtgtcgtccagatgcaacagcctggtgcacagatgaactcacacattctgaggcagcacacatacaacatgcacacgttccagatggagtcccagcacgagggggaagtggacagacgttactgtcccaaaccaagaagctattgcaattcatatctgcaattcaattttctcccatgcccaggaacagctgaccaacccaaaacatgaagattctttttttttttttgaaggcatagattaagaatttattatgttttttttttttttggatgtgatcataacaaaatatcttcaccatggtgtctttgatgctaagtaagaacctcaatattataaaaatttctttgttatttcatttaaaatatattgacagacagggtttctttgtgtaatccaggctggcctggaactagctctctagaccaggttggccttgatctcaacaaagatccattgcatctgcttcctgagttctcagataataacatgttactaatacatannnnnnnnnnnnnnnnnnnnttagtgctcttacccgttgagccatctcagcagccctaaagttaagttttttaagcatggaatttataagacggctttaccttggccttcctgtttgatttcctacctagatctttctggagagcactgctccttttcctgaatgtatttattaggccccacagtgtctttcctactgcatctatcacatcccacaaatacttgattcttgtttcagaacaggtatggcctttggcactaaggataaatgacatatattaagaagactaagtcgagggaaggtggtagtggatatgtctggagagaggacttgtttttaagccagggattttgtttttgttttttttggttttttttttttttattagatattttctttatattcatttcaaatgctatcccgaaagttccctataccctccctctgccctgctcccctacccacccactcccgcttcttggccctggctttcccttgtactggggcatataaagtttgcaataccaaggggcctctcttcccagtgatggctgaataggccatcttctgctacatatgcagctagagacacgagctccaggggtactggttagttcatattgttgttcctcctatagggttgcagaccccttcagctccttgggtgctttctctagcttctccattggggagggctctttgtttttagacagtctcattctacagctcagactaatcttgaacttgtagcttagctgtcctggctcatctaccctagtgctagggttataagtatgggctagctagcacacctggccagtgaggtgttttaagtagggagtaacacctggcttgaggtttagaagcctcactttggccaacgaagaggaagaataaggcctaaggtaagggagagaagcaagaaggctgtctaagaggaaatacacatttggattaagatggatgctgtgtgagtggtgttgaaaaggcagacccgttgggacctagcatttcactatgtgactgtaggaatgttaaggaagtcaagtttgcttgcagctagtcactgaactttgggatggagagacaggtaacataatgaaatgatttggaacatgttgatctttttttttttttttttggtttttcgatacagggtttctctgtgtagccctggctgtcctggaactcactttgtagaccaggctggcctcgaactcagaagtccacctgcctctgcctcccaagtgctaggattaaaggtgtgcgccatcatgcccggcggaacatgttgatcttaaaggccttttggatcgtctaggccttgttctccagttggcagcccagctttgatacccaatgcagcagattttgaagtatgaagtagagtagatgaagtgtatctatagaaaaacttatgtatgagtcaggtttgatggtacaggcagtagtagattagagcacacacctagtgtgtataagatcctgggtttagttcccattattgacaaaagaaccatatgtatgaataccgtggcaggtctattcagctccacacagcaatcgaaatgtatactatccgtaatcgacaaggaaatgagtgaatgaactgtggtgcagccgtatagtggaatacatgggaatgtaggttactgatgcccatgcagtgtggccaacccgctaaataaccaacaaaccaaactaaaaccagcatgttctataggcttcactctcataaacctgtaggaaatgcaaactgatacagatgattggttattataaaaacagacgtctagatggttatgctgacacaggcctgcaatcacacagatgagaaggaagcgcaagaagaccaggagcgaaggtctttcttagctacacagcgaaagaacagcaaaccaaaaggagacgtctatgtctacttatcttgagtatgctatagtgctaggtggtgtcaaatcatacaacttagatatatgcggcttagtgttgactagttgttctcagtgaagaccaatgtagccatcagcttagaatctgctactgtctcactgtgtttgctttatcacacctatccactttccctcccgttaatctgttgttgtgttttgagacagtctctcccagtgtagcctgaaaacactgtgaagcccaggctggtctcagacttgtggcaatggtcctgtctctgcccctccccctccagtgatgagctaacaggtatgagctgctctgtccagcttatctaatttttttttttaaagacagggtatctatccattcattcacccatccacccacctgtaactctaagccagctctggctgtcctttgcccacctctgccttccaagtgctgggacttaggggtccactaccacacctggcacttatgtgatatcctgatgaattttgtagttgcaggtataagcacactttattcctaaatccttcaccccacatcagtaactagaaatcaatagctttttaaaaacagttccttttgttttagtaggaagttcctatgcagtggaacatacagacgttacttggagtgcttaatgaatgtttactgtcaaagcctctattaaaggatggaccactcccatggctcttgaggttcccttcgtgcccctcttcccagaggtagccgccactgctgcaacatttcagcacctcacatcggttactcttgtctgttctggaatatcatgtaaatgaatcaagtagtgtatatatatttttttattgttttcttttttttcaattttttattagatattttcttcatttacatttcaaatgctatcccgaaagtcccctataccctccccccactctgctccccacccacccactcccacttcttggccctggtgttcccctgtattggggcatataaagtttgcaagaccaaggggcctctctttcccagtgatggccaactaggccatcttctgctgtagtgtatatttttagtgaggcatttgagagtatgctttaagaattccgtcctttttttcccaccatgtgaactatgtcacagtttatctagtggatggatagctgatgctttcaattcggagctattattaaagctgccataaatgttctttaaaaattgcatctatgtgtttgtgcatgtatgcacatgcatgcacagacgtggaggtcagaagacaacttacaggaatctgttctttccttctgccatgtggatctctcaaatcaaactggcgtggtggcaggtgagccacaggctcaaatggtcttgttgagatggtgtctcatgtaaccaggcttgccttgacctcctggtgctcctgtgtttgtctcctggatgttgggttacaggtgtgcacacttagcccccatggttcttacaggagtctgcttagagacagcttttattgcttgtacactagtaccgagacattgcttgcaggatagagatctgtttatgagaaactgctagacctttccccaagatggccaaaccatttaaaagtctctcacagtgatagatggtggctccttgccagtgtgtgatgttactagtctttaactttagtggtttgaagtgctatcttattttaactgtgtcttgtatcccatggtagataattacattgatcacttttttatattcttttttgcactgtgtgtgtgtgtgtgtgtgtgtgtgtgtgagtgagagagagagagagagagagagagagaatgaatgagagggggcagacagacagacagacagagaacagcttacaggcattgatactctcctttcactgtatgggtcttcaggatccatttgaggtgatgaggtttggcagcggcagcagatacattctgcccccctagtcaccttgttggtaccttctgcttttatgttcttattagtcattcttgtttattcctttggacagtgtctgctcaactcttctttcccataaaacattgaattatttttttctttttagtattgaattgtaagatgccttacatattctggataactgtccttttgataaggtatttttatgatatttatctatctatctatctatttatttatttatttatttatttaaggcctcatgtaactcagggtcataatggttcaacttccttgagtgtctgcatcttaagtgtgtactaccgtgctgggtacacatcatttcttctagtctttgatttgcagatttactttctagtagtagtgttttatgacaagtaaagttttaaatatccacacatctatccatggtgtcaagcagcccacattgggctcggccttactgtgtggctgaggctgactttgaactcctgatcctcctaccttcatgtccccagttctgggattatgggcctatgtcaccgtgtctgctttgtttttgtgaggtctaattctgtagcccaacttagcttgaaattcactggctgaccttgagctcataatccttgtgctctaccttccaagggagccacctagtccagccagatagaaattctgaaggatcactggcatccacatggcagctcacaactgtttgtaacttcagtgccatgggctctggtgcccttacagaacaacaggcaaagcaaaaacaaaaaaatttatctttgattttacagtgctaaggaaaatttgccagggtgtagggagtctttgagtgaaagttgactgtcacaggaatgctgcatctctgagaaacggagtctgccttcgtctgcttgccatgctcagtgatcgactaggaggggctggttacaggcatggcccctgcacaaacacagcggtggatttcagagtgcagcagctggggcccttagtcagttatcctgcctccagccagatctgagagggccattgttgtggccaaccaggctcttctctggctatgaattgcctgattgggataaatcatatacagttttccccgtgtaaagtaggtgatttggccccttcaacactttaaatgttacaaaaaaaaaggtatcttagagtaaataaaaataaaaacttaattttcattagaatttaatagtatgtaatttgcttccgctgatcaaataaactgtttcctagtgtgaggctggtttgtgcagttaaatatgtagttagcaaaaccacagataggacggtaactctgaagaaaacagctcagggatgcctagataatcactgccttaactaaccaagtgcagccttggaccctgcttactgaggtagacagaaacaatggccggtgaagttcctcatgaaattaatcttgttaaatttccagtgggattggaggtacccaggggagaaagtaataaaagtgggaaaatgttttcttcccagtttttgaggcattgtcctgatgcatagctaagactagccatgaactcattcttctagcttcactgaaaagtgatttaaaattttagaattatggacacttaattactatgatgttattattttgaaacattattttatataatacttatttatgctttatgatagtatgtgtgctttgatgtcagttttggagagtgtcaccaaatagttttcagggacttgaacacaggttgtctgtcttggcattggaccttttcttgttcagtcatctccctgggccctcatatgttattctaagatagggatttttaaactgtaaaatgattttgagactctctttaaaaagtacactgtgtgtgtgcattacacgggcttgtgtttgtgggtatgcagttacgcgtgagcatacatgcatgcattcatgatatgtgcttgagtgcacgggtgcatgcaggcgtttgccacactttgtagagctcagagaagcaagcttggtgatctgagttcaagttcaactcctgcacgttgtcctctgaccttcatgtgcattcctgggtatgtatgcacatacatacacacaacacataccagataataaagggaaggaaggaatgtgggtaaaaatctattctgaaatttgttgaatcttatgtcttaaaacacagtcagtttaaaatttctttctttttccttttaaagtgtagttaagggctagagatggctctgtggttaagagcatttgttgctcttgtagaggacgcagatttggttctcagtatccaaatgatagctcacaatcactcaactccagttgcagggatctgatgcccctgtctgacctccacagacaccaagcatgcacgtgatgcacagacatatgcaagcagagcactcatagacatgatataaaataaataagtctatgaaaataaataaacctatgaaattaattttttaaagctatcaaaaatgtcagaagtttcaatatctggaaaaacttttttgtcttttgctttttctggtcagagtatcactcagatacagtttatatgtgtccacagaatttaaaatgacattatcagagaagtcagagatctttcagtagaaattcacacatgggtttataggaataattacacaaaataagtgatccctcactacatttcttttaaagcatttttatttttttccagacaaggtctctctgtattcttggttctcagtgtagttgatgtgtagcttacagttatcacttaaatagcaagtttgcattcattatgaaatttataacttgtttgtttcttgggcaagctctcatatagcccacattgacctcaaattgaataagtagtggaggatggccttgaactcttgatccttctccacctttgtagtcctgggctacaggcatctgccaccctgccctgtgttaccattttaatgtaggtattgtccctattttatagagtagggagtaagtatgtctgtcatctttcaaattaaagaagtggacttagaatcatatcttaaattactcacatgtgtaaaagtgccctgcatagagtcctcatttatttgtacaataggggaaagtcagggccgtcttgtatgcgtgtttaaaaatatgcctccggtcttctaagatttaacaaagtctttatttagttaaatnnnnnnnnnnnnnnnnnnnnttcaccatggtgtctttgatgctaagtaagaacctcaatattataaaaatttctttgttatttcatttaaaatatattgacagacagggtttctttgtgtaatccaggctggcctggaactagctctctagaccaggttggccttgatctcaacaaagatccattgcatctgcttcctgagttctcagataataacatgttactaatacatacatacatacatacatacatacacacacactcatatatatacacatatatatacacatatacatatatatacacacatatatacatatatacatatttatatgtatatatttatatgtttatatagttaaataggttgaatcaaaatatcataaacactccctggtaatgggcaaagggacaccttgttgttggtggtgttcttatatcagtcaggggcagagcagatgacagtcctttttcatcctatcttgatttctggcttggcagccaaagctgtttaatgcctaggacccataaaagtcaaatccaatcctatccaattgtgtcagcgaagaaggaggaagacagagacctgcgaactaccatgccacccacaaacctgccctccatcacacggaacaggcgaacaggcaggcaggccatagacatccgcctgttgccacactctgaagtacggatggaggatcttgcccaggggctcgctagttgcttggccagcttgcagcaggagccaccataatgtgtgaatacgtgatggtcagttgggagagaaagagaagtacagtaccgtgatcattatgaagagagatgggactggaggcgtgacggtggaaaggagtagcctgttatgtcaccagctctgccacctgagttagcttgtagcccaaactgccactgagggacatgtctgagtctatggctacaaagcagcagcggtccatgttgatgtgtatgactagacaacacagggatgtcctgtgcagggccagcctctagagaccacgtgaatattcaggggctgtgcttaaatggccccgcccctcactgaatgcagtgctctgtagagcttgcctcacccttcactggtggcagctctgggagccctgtgccttgcacaggcaccactgtagagctggttctggcagtggggttatgtgggtgagccaaccttgagggcatgactgtgggagagctgaccctgccgctggtctgccatggagtggcattggtgcaaaggtgatgcccacctcccactctgccccttgccacctctggcagtcaagaaagctgcccccagtgtcttgagcttgagagagcttgccctgtcccttaccagctgcagcactggcactagggagagtgggcactgcaccgcgtctggacagcacagtagaactggccctggcgtggggggggggggggcgcatgcgagccgactccgaggtcaagagcatgagagagctggccctgccactcatctggaggtgaaatggctggatctggaaatgatgtcttcccccttcctccctcaccacacgcagtagtggggagagctggggatcatgagagcaagagtcccgactcccacccccttactggctgtagcactaggaagagagggtcctgcaccttatctgggcaacacagtggatgtggccctgttggggaagacacaggtcatccattctgaggatttgagagcaggagggctgttctaacccctcataggctgcagcatttgggaaagtggtccccgaacattgtcagggagctggccctggaggaatgggtgcaggtgagccggctccaagggcatgagagcaggggacctgaccctgcctcctgccaatgatagtaggtggcctagctggagtagtaaaggagggcttatcttggaagagctgatgggctgagcagctcagttgctatccaggcccagagccagggtcctgagttggcccaccccaaaatctgtatcatctgcgaatggttgggaattcgtgaaagggccaaccaatcctgttgttccaaagctgcagtatctccatgacacagggcaaaaacaggataacaggaaggaatttcaatgaggatccaataatgatgttgtcacagaagccaaagatatcaaaccagaccaatgactcatgtaatgaacattcgcaaatgaagatgtctatgcagtataccgaggggtatattgtgggacacacggagccacactgcagcttccacgatagattttttttttatgcttttgctttttattgttgtttggttgtgtgtatgtatattgtgggacacacggagccacactgctgcttccacgatgagatggttttttttatgcttttgctttttattgttgtttggttgtgtgtatgttttattttgcaggggatatgagagctcagggagatgagtgggaatggggtgcatcacgtgaaactcacaaaaaaaaatcaacaaaagggtttttttgaaaaagtagaacaaaactagccaactgtgatttatgactgtttcaaaatgtttgtattttatctacttaaagaaattttgcctagtactgttagaataactaacatcataggctcttgatagaatttcaggtgtcttttatgttgatatgtaactttactttcagaacctttaaatgtgtttcaggacactgtgcattttaatgttttccatgtttgctgaaataagcaaattctaaaatgacgattaaagaatatatcataaacagagccaaatacctaagcacttgatttctttccccttgaagcagcacctccaatgctctcccatcaggctccacttctcaagggtaccactgcctcttagcatcttcaagctgaagaccaagcttctatctcaggaatgcttgggaggcaaactgttttgaaagcagagcacctcgtagaaagcaggattgcacagcatcaagatctctgctttgcagtataagccctcggctggcctagaacttactatgtagaccaagatattttggaactcacagaaatctgcctcctacctccgagaatttaaggcatgtggccctatggccagcttgattaagctttcttaataagctgacttgtcaaagagaaagtgtcttggtgacaaagtctaattaagttgagccttttggtgtggttttagaagctgtcactttagcttttgatcttggccattctgaagggtgataaatggaatctcagaatcattttgatttgcattttcctgctgagcaaggatgttcaacatttctttaagggtttctcagctcttaagagagtcctctgttgagaattctttatttagctctggatnnnnnnnnnnnnnnnnnnnntatagcccacattgacctcaaattgaataagtagtggaggatggccttgaactcttgatccttctccacctttgtagtcctgggctacaggcatctgccaccctgccctgtgttaccattttaatgtaggtattgtccctattttatagagtagggagtaagtatgtctgtcatctttcaaattaaagaagtggacttagaatcatatcttaaattactcacatgtgtaaaagtgccctgcatagagtcctcatttatttgtacaataggggaaagtcagggccgtcttgtatgcgtgtttaaaaatatgcctcctggtcttctaagatttaacaaagtctttatttagttaaattatggttttgggttttgtttgtttgtttgtttgtttggtcttttgagacagagtttctctgtatagccctggctgtcctggaactcactttgtagaccaggctggccttgaactcagaaatccgcctgcctctgcctcccaagtgctgggatcaaaggcgtgagccaccaccgcccggcataatgtacttttacaaatgtattacttcacaattaagatttaatttgtatttacttattattgtgtgtgcattaccggggggggggggcgggggaggaccacagctttatgtctaggatgacttagtaaagtcacttttgttgtttcaccgttacgtgggttctgggtccttacacgtctgtccagtacctcccactgaactgtttgcctgtggatatgcatgtgcctctcaacgtgtgcacacaaaataagtcaaatgcaaatgcttttcttgaactcatgtgtgactctaaaaagtaataatgtagctgggtgtggtaatacacacccacatgcaaaaacaatactcagagccagttgcagtaggatttggagctgaaggccagtcccagctagggcgagacccgtctttaaagagaagctgatgtgagaggtgtggtctgagagccgatgtgagaggtgtggtctgagagctgatgtgagaggtgtggtctgaggctggagaggtgtggtctgaggctggagaggtgtggtctgagagctgatgtgagaggtgtggtctgaggctggagaggtgtggtctgaggctggagaggtgtggtctgagagctgatgtgagaggtgtggtctgaggcttgagaggtgtggtctgaggctggagaggtgtggtctgaggctggagaggtgtggtctgaggctggagtgaagccttcctggtgctttgatcatcacttttcagattaactttctagacctagggaaagcttgcagccagcagtgtgtgaatgagaatcatcctagctctaggtgggtgtaggtggatctctgagatcaaggccagcctggtctacaaatagtgagcccctgtctcaaacagaagagtcaggggtaagatgttgttttctgttctgttcaccccctttcatgaaagcctcaggagcagatttacaataaaataatatatatagtgctgaatatttgcttacatttcaaaaatttagaattccctgttaccatcagagagattttataaagttatagaacctttatttagtgtacatgtgtgtgtgtgtattattgaacatacacagtgtctatatctaaagagagtatgatttcccactgtgtttaacagatcttggccatttcaggagttaagtgtgattatatggtaaagcccaatcaaagtgaaaggatggattttctttcagaatttgaactgattgcttccataaaagttaaagacagacaattggctaattaaattctaactaaaaagcatagtttgatttcacttaaatgaaactaaaagagagaaactgtattaaaccactatccatgcctttgtgtgaattaactttacctttctttctttctttctttctttctttctttctttctctctttctttcttttcttccttccttccttccttccttcctttcttaaatttgtttattttatgtatatgagtacactgtagttgtacagatggttgtgagccatcatgtggttgctgggaattgaactcaggacctctgcttgctctggccccactccctctggcccaaagatttatttatttattatatgtaagtacaccgtagctgtcttcagtcacaccagaagagggcatcagatcccattacagatggttgtgagccaccatgtggttgctgggatttgaactcaggaccttcggaagagcagtcggtgctctgaacagctgagccatctctctagccccatgagccttttattttttttctccttattctgaagtttgtcttggtttctcatcgcttaagattgaaattaaaaacagaatttgcgttttaaaaacttatgaccaaactcattggaatgacttcattagtgttaaaggttgaggattaagcacattccgtgaattctaattggattaatattctttctcagaagcactgtcttgctgggcggtggtggcgcacgcctttaatcccagcactcgggaggcagaggcaggcagatttctgagttcgaggccagcctggtctacaaagtgagttccaggacagccagggctacacagagaaaccctgtnnnnnnnnnnnnnnnnnnnncttaaggactcagtgttgtggatttgattgcacggattcccaaattacactggagttagaacatctgcttgtaagtcgcttgagggtcccagcccctaattggttttgatttggaaataaaattgctagcagccaatggctgggcagggagacagaggcagaacttttagaattcctggacaaaggacaaaggaataggagaaggagaagccaccataagaagtgcgtaggacagaccaagcagagaaagtgcaagagggtaagatggcagaaatgtaggtgcaagaggaaggtggccctaaaggggctgtccaacagggcccagggcagcaaggacccaagagagatttaccaagtgttaactcaggaaggaatatcagagaggagagtatgctagccgcaaggaggtttagaaacgaccagccattgcgatgcttagtgcatattaaaaataagctggggctggtgagatggctcagtgggtaagagcacccgactgctcttacgaaggtccagagttcaaattccagcaaccacatggtggctcacaaccatctgtaacaagatctgactccctcttctggtgtgtctgaagacagctacagtgtacttacatataataataaataaatctttaaaaaaaataaaaaataaaataaaaataagctggcataagtatgtctttcattcaccacttgtagaggaggtgcgcacaccctagggaagcatagagcgggtttaattatttaccgcaacagctgagccatatctcctgactttaaatgaataatatacacaatcaccaagttagagggaaaaaaaaaccaaaagcataaatacaaagagagaaaacaaacaaacaacaacaacaaaacaaccaataactccataattgaagaaaaacttaataaaaataaatatggacaaaagcataatttaaatttaatctaaagttgttaaacagaagaccagagagtcaaatatcagtcaattctaaccaataataaaaagagaatttattaggaaacattggctgcacgttttgataaacatctttaaattaagagnnnnnnnnnnnnnnnnnnnnctggccccactccctctggcccaaagatttatttatttattatatgtaagtacaccgtagctgtcttcagacacaccagaagagggcatcagatcccattacagatggttgtgagccaccatgtggttgctgggatttgaactcaggaccttcggaagagcagtcggtgctctgaacagctgagccatctctctagccccatgagccttttattttttttctccttattctgaagtttgtcttggtttctcatcgcttaagattgaaattaaaaacagaatttgcgttttaaaaacttatgaccaaactcattggaatgacttcattagtgttaaaggttgaggattaagcacattccgtgaattctaattggattaatattctttctcagaagcactgtcttgctgggcggtggtggcgcacgcctttaatcccagcactcgggaggcagaggcaggcagatttctgagttcgaggccagcctggtctacaaagtgagttccaggacagccagggctacacagagaaaccctgtcttgaaaaaccaaaaaaaaaaaaaaaaaaaaaaaagaagcagcagcactgtcttatataatagctgcatagaatttagtttatatttcagttagtctatcatagtttttctaagcatttatttattttattatgtttggtgtatgggacagagaataaaactgagggccatgtgtgtgtgctagctaaacattactgtacctctagtccaccttgtaggtttttaaatagttaattaactttactgccaattaagtactcctattcatagacagtacattctaatttgcttatttctaggctgtcagtgcaaaatgtttaccttttccttatgtataagtacaaaggccaggtttgtagctgtatcctttaaattatacaactttccttcagtgtcatgtgagttccccagctccacctgccgggtacccttgcttgctgaggcatcctacaggcctctgattttggaagtttgtttattaagacagaatgtagccggggtttaccctgaacatctgatccttcagcctctacctcccaaatttttggattatacacatgtgctaccacatcaggctggtattctgaatttttaaaaaaggttttttgttttggttttcttttttatgtattttgcctgcatagtcaagaagatggcaccaggtctcctggaagcagagttccagttctgggaactgaacttggatccttttgaagggaaataagagctcctaactgaggagccatctcttcagccctcccttaatttcttaaaggtttgaagtctatcacaaacagtgactacaacttaggagtttgtttaaagaataatgaaatacaaagtcatttatttttttgtttttgaaacaaggtctcattatataactcaggctggccttgaactttctatgtagtccagagtggcctggaactcttgaaaatcctcctgccttagcttcctgagtgttgggattacacgcatgagctatcattttcaactgaaataacatttagaaattattatcatcatcattactgctttacacgtgtgggtgtcttgcctgcacgtatgttcatacaccttctacatgtctgttgttcactgatgtcagaagaggatgccagatcaccttgactgagagtcatcgtcatcgtgtgggtgctaggaattgagcttggatcctctgcaagagcagtatgtgcttttaattgctgagccatttctccagactctttaagctgtccctaactacattatatagcacatgcctcttgccttcatccactgagtgggggaattacaggaacgaataaccagtctcatgtttaacaatttttagtttttgaatttgtttgtttatatgttagcttcccagttttgtctcttttaaagtagattatacttcagttgcttcactgaccattttcttgttgtatgtacacagtgtgttctgtggttggttcccagtactgttcattgacttgacagtcatttgattttgtatgttcaaatttgctcagctgttattgctgttcttattttcagaatgatttcatataaaactttattttaaatttcttcttgaattctttgatttatatgttaacaatatcattctttattgttttttatataaatcttttcatgaatttgatttctttttttttttctttttttttttttaagacagtgttttctctatgtagccctgctatcttagaactgtgtatagaccaggctggccttgaactcatagagatccacctctgcttcccaagtgctagtaggattaaaggtatgaatcactgcctgacaaacatttcaagaagttatttttagatactgtattagttacgtttccattgctgatgccatgaccaaagcttatggttccagaggtttaggtcagtgatgatggagtgaaggcatggtggcaggcagctggaacagcacctgagagatcacggtattgatccacaagcaagaggcagagagcacactaggagtggcacaagtcttttggaacctcaaagcccacctctagtgacaacacctgttctaacaaggatacacctcttaatccttgacacacttcctctaacaaggctacatttcccagtccttcccagatagttgtaataattgggaattaagtattcaagcatgggagtctgtggggccgttctcatttaaactaacacatacaggtttttgtttgtttgtctgtttgtcatttgtagttcaaagctgcttgtatagggtatataggttcccaggtttctaacttgtaacttgcttatagccagatatgtaataagtaccttgtggggaggtataatggtccgtttttattactgctatgtgtaccagaagattggtagaaccaggaagataggaaatgttcttttttcattacatccacgtgtaagccaggcatggtggcctatgcctgtaatcctagcactctggacattatcagggaggattatgagttcaagtacaacctgggtaagatactgtctcaaactgaagatgggatacaagaagagaaaggtcagtataggctcagtgtgtctggggagggacttgttcttgggctacctgctttaccttaacagttgcaaggggcctcttgtattttccataacagaacgggcacaggataaaacatggatgaccccagtaacacataacaccacttctgtgtaatgttactaccttggcctctgctattgaaacctagatgaagggaagggccagtggatggctgtgtcaaagctttactgggctcttggttcaacctgctatgaaccctaaatggaggaaagggtggcagtagatcttatcctgcccccccccccccccaaggtacaggctgaacagagagggagttaatgattggcactggagaaatagcctagaatggagatgagagtctcatctgaggtctgtggttgggagttcatggtgagatgctagaattggctagtcagggttcaaggatggggacctgggagtgagggtacagggagctatgaggactagctaggaggacctcagacgggagtgttggttaaggatctaggaccctacaaacacagattgtcagggtacagacatcccttagccccccccctccccccccacacacgctggctgctgacacctccccccaacaccctagcaatgtcagcatctctgctagcagctacaaaagagcccagagctttagtcaggcctttgtcatacatgatggtggtaaaggactcagtctagagctttgaagggagccagcctgaaaatagatgtctcccccaaaagtgtatgtgaccaccaaaagcgaaggcatgggagtggtcagcagtgaaaaggagcagcgtgtcctgctcataggtaagctgtcctgccttcttaatggcagtaaagcatgatggtttagtcagccgctcggtaagctatgccttcatcgtgattttggttgatgcaacgtagacgtttcaggttctcctgcacagcaggtccatggtcacctctgtcatttccattaggggtgagtgttcagccttttagaggcctataaggtggtctgtcacaggtctaggcatgcctgaatgaactttgtactgttgtgttagttgggtattcagcatctgtatatctttgggaaacattaatttatgggacagagtatcatgtcactgtctttgtgggaagcgagctatatggagtgaccttgcagtcagctgtgctccaggaccgaggcaggcctttctgaatctaagcacagttgcagtgtaaggtgcaagttaggaaggcttgtgcaccgaggtggtgggtgattgctttcacagacttctcctggtttctcagtgtgatacattacagacgaatctcattgccgcactgatgtatgtgtgcaaatcagtgaccttgacattggctcttaactcctcagaggcaggctatggatgtgcctgtctttggggatctgcctgtctatgttgtaattgctctgcgtccattaggacttgggttcagatccctaggacccacattagaataacaaaacccaggcacgactgagtacctgtaacgtgcattggtgagagacaggcagatccctagagctcacagccagcctgcctgcctatccaaaaaggcaagcttccaggtcaagaagagacattgtctgaaggcaataaagtaagacacctgtgtcctgctctgccttctccattatatgcaattgaacactcatgtgcatacaggccggtgcgctctctcgcacacacacacaaacacacacaaataaaggaaatagaagatctaggctttctaaagcctttttagctttttatagagagacattagctagaaagggctattaaagattcatcagaattcatcactgttttctggcagtttacccaagggttcctgagtatctctggacagctcatatatcagatagacagaaattcatacaaaatcttgtaataatagcaaataaaatgttgtataatgtgctagagtttactgcagataaagtgaaccattgccagtttaaaatttgtaaggtgctatcttttattgaacatggtgattgtgtcttacaaatggaattgctgtcactttcagtaaaattcctgttcatgtctgttattgaactcaaggcatatgccttgataactggctctgccttgtttttaaagacagggtctctcgctaaagttggagtccactaattggctagataggtgaccgaccccctgtcttatctcaccaggacaggtgttattggtacataccacacttggcaggtgaaggattgtttttttgttttgttttgtttttttgcagtttttgatttttaagtgggctctagtcattcaaacatggtcttacgtttgcatgacaaacatgagactgaacctccctcactaataactaataattagaaaggaacttggttgatagctacttagaagcattgctccaagtgactttaggattcactgctagtaaattagccatgaggatatagaaagtcagtttgaaccataaaggcacataattcagtgtgcagaagtaaagtgtgttcccagagtgtttaaaagggtaatcgcatcatgctaagtgtatgcgggagtgaatttatcacaatgcctatatacactagtcagagtatgttggtgaatgaaagactggatttaaaaccctgaaccctcagttctccattattttaactgtgcatagccattgtcttttgtcagggttcattgctgtaaagagacaccatgactaagacaactcatactaaggaaaacatttcactggagctggcctccaggttcagaggtttagtctattatcatggcggggagcatggcagcatgcaggcagacatggtgctggagaaggcgctgagagttctacatcttgatccaaggcagccaggaggggactgtgtgtttcacattgtgtatgtgtgtgtagcttgagcatataagatctcaagctgctgcccccacagtgacacacttgttctctaacaagaccacacccactccaacaaggccacacctcctaatagtgccactcctatggccaagcattcaaacacacgagtctatgggagccgttcctattcacaccaccctagtcatctagtaaagtagaagaactggtaaaccagttatcattaggctggcaggcaggtcatatattgactatggttaaaaacgtgtgggtaaatggttgcagcttccagggctgctgcttcactggtaaaatcactcaagttttaaatattctcttacgcagttctgagttgttagaattattttccttcaaatatttacctttaaaattatataaagtggatatgaatgtacttggcatatacattttttaaagaagaatcaccattagtatactaataatgttttcccccagccctaggctgtcaccctccccatcctgagtgctttctgtcagtaggtgcatgtcttaaaacgcatcactctcatcaggagaggtttttcttgccattcctagcttgttgttgagtaatagttctgacccacagtaagcgataaagggatacaaaactgttttgctggttattaaaatgcaagcttttagtagccaacagccttaagtgattatgaaaaaaagtcagggaaaaataaagatcattaaatgattgttcattttttcacagtatagcagactaagtcacaaattgtaaaagcactcattgcccacccggtgagagtgtgtgtgtgagaaagtgtgtgtgtgtgtgtgtgtgtgtgtacatagaaaagttagaggacaacatgttttgggtgtgagcttttcctttccactttgttgaggccggcactcagggtctctctatttttccttttgtgctgactcttccctgctgtctggcctgccaggctcttggcagttctaatgtcttaggctcccatctggctgtagagtgctgtgcttacaaatgtgtaatttgtatgtggatcaaactctgtggtcaccaggcttgtgcgtctatcgtctgagccacctccttggccccactttggtgtaaggtgactttgtgttcactgtctgtactgggagtgctttgcacagtaggtactagatgctggagactcattagtgaacctcatagacggacccccgcggtctcaacattgtgtaaggaaggtggagttaaaaggggtcagagacccatcagaggtcagtttcatccaagaagaatgctgactgactgtcctgactggttctgggcaggggtcctacataaacaatgttttatcaccatcttagcctctccctcatgtttcccatttctacaaggcactgcaaaccatagtatatgcaaagaatactgaaattacagttaggtaactagatttaaaaaaaagaatagcatgcatggtgtatgaggctgggaacaaagattgtgaagccctgattttttggataacattcaatctgtatttgtaggctagttcatattttaattacttgcctttttgtttacaggttcaggggcaagttcaccctactcttgagtctaatgatgatgctcttcagtatgttgaagaattaattttgcaattactaaatatgctatgccaagctcagccccggagtgcttcagatgtggaggtatggcaaatgaccgcttttgttttcttttaactgcatgtatctcgccgtacgttggctgtaatggcagtgaaggagaaaagggctctccagttcattcttccatctctgtaaactttgaactgggtatgtggtagcttctatgtgtcttagctgtgaaacgttcagattgtacttttcagcttaaataaacagcttcatgttactactagaatggtctgaggcaaaccctctctatgtaaaccaggatggccttgaactcagagatccctgttcatacatacatacaaacatacaaacatacatacatacaaacatacatacatacagacagagtgcacgcaaaggttttagtcccaaaacatttcctttaaatttcagagagtcaaaaggctgataataaaatatctcaaagtatctgagggagaattatagaaacattggggtcacaggatgaacatacaagttccctggtaaaagttacaaagcaaatgtggacatgtggtgacacactagagctgaaggttcccaaggtatggacggcatttaaagagttaagatgccaatcaccagtattgtggtacaaacctttaataatagcacttaggaggcaggggcaagaggattaggtttccagatcaatttaaactacacaggggagttcaaggctagcctgggctatgtgagaccctatctgaaaaagcaaaacaaaagagttcaaagagtactttatttttacctttagctccttcaagtcccaggacttcagttgggtgggaaggcgtgggacctgacatgtgagtgtggagcattgatgtaaggggtctgtatagcttattgactacatttcacgaagccttaccccatcctcagggttacagagggggtgatggacggaaggaggggaagaagaagaggaagaggaggagggaggagggaaagagagaaaacaaacaccaagtaacacgtttagtcaggtttagaaaatactgtatcctgggtaattctcatctctcaactcatttacagtagattctttgtggtggtttggttttgttgttgtttttgagacaggatgacatatagcccaatctggccttgaattcaacttgctgctgtatagtcaagagtgacacttgctctgcctgcctccatctcccaattgctgggatttcacgagtttcctaccaggcctgattggtttcttctgtaaagtcagacttttaattcataatttcttttaaatatgtgtttatgttgttgtttcacagagatcttgaatagtatggcttgcatgactctatcacattagcaatttcacttgggttttctttgatcctagctataatcttccatggtttggcagaatccagacttacaagaaaggctcacaaatctcaccttgtttattatattgatgttggtacattttagaaatttgctaatctactgacattgcaaacataaatcagatattcctatatatatatttacataactatgcttgtttaatttcatctttaataaaaacaaggaacagaaaaccatatgaaattctcatgtggaggttttggtgctggggatagttttggtgagaacatgtaagaatatgactaatagaagtaccagtcacgtatgtaatcagctttattatttctttttaacatatctattggcattgcatacagttttatcatctgtacacatctgtgtgtaagtatttacatgagcgcaggcacccacagaggccaaaggagttggatgcctgtcttggttaggatttctactgctgcagtgaaacaccatgaccaaaaagcaagttggggagaaaagggtttatttggcttaccctacataatagcattgacgtgcatcatggaaggaagtgaggacaggaacccagataggggaggaatctggaggcaggggctgatgcaacaaaggctgtggacgggtgctgctttttggcttgttccccatggcggcttctacctgcttgcttatagaacccagaaccaccagcccaggggtggcaccacccaaaatgacctgggccctcccccatcaattaattactaattaagaaaatgccttgcaggcttgcctacagcccagtcttatggaggcattttctcaatcgaagtttcctcatatctgatgagtctagtttgtcaaattgacaaaaacctagccatgaaaatctgaagttataggcagttgtgagccacctgacatcagttctgggaatctaacttaggtcttttggaagaacattacttggttttaaccactgaaatttaataatttcaaagtgctgttttataaaattctgtatcttacaacagttctatgggggtatgggaatatctttctctttgcttgcatatttgaaaattgaccctcagaacagtattgacataaatgaagatccaagaaaaaaaatcaattttccagggctggagagatggctctctgggccataaaatcactttagtgcattgatcatacaaaaagaagtagactagaaaatactagtgtgcttcataaaataagggcgaggtttatttaggaagccctcttacagctcagtttctttataagtgtataatataaactattgaaaagttattatctaactactgtatgtatttgtatgtgaatgcacaaagggatcggcgtgtgggttctgggcatcaagcttggtcgtcaggcagggctgccagggccctaacttgctgggctgtctgcaccagaatggaaatgtagtattttttactgcattctctccctctctccctctctccctctctccctctctccctctctccctctctccctctctccctctccctctcccctcccctcccctcccctcccctcccctcctctccttactttatttttttacgttcacatacaaagtagtgtgtgttttttttaatattttgtgtgtgtgtgtgtgtgtgtgtgtgtgagacagacagacagatagacagacagacagagagacagagagacaggtggggagggagggatgtgagtgtaagcgtgcgtgcagtgtgcgtagaagtcggaggacatcttctggagtctgttcttcccggcgtgtggatttctgagataagtgacggacacaagtcctcagggttgtgcagcaagcgcatgctccgagctgagctatgtcacggccaggcaggatgggcagctcccagacacaggtgaatgtcatttatacctagttcttacgcattctatccctcatttctcctttttgctggcttttcttccctcagataatcctcccgtctactatcatgtactgtgtctactttcgtgtactgtgagttgaggnnnnnnnnnnnnnnnnnnnncatagagcgggtttaattatttaccgcaacagctgagccatatttcctgactttaaatggataatatacacaatcaccaagttagagggaaaaaaaaaaccaaaagcataaatacaaagagagaaaacaaacaaacaacaacaacaaaacaaccaataactccataattgaagaaaaacttaataaaaataaatatggacaaaagcataatttaaatttaatctaaagttgttaaacagaagaccagagagtcaaatatcagtcaattctaaccaataataaaaagagaatttattaggaaacattggctgcacgttttgataaacatctttaaattaagagaatttcaggttaaaccgatagtttagaggaaagacccccatccaatgggggctgaaaatatgactcagtcagtaaaatgtttgcatactaagagtgaaaaatagaaaggtaagatgttcaatgtggccttttagaaagatttgaaaattaagagatgttacaattctggatggaaaaatcacataagtatggtgaccctatatgtaatctagtggttcagtacaatttcagccaaaagtcagcttggtttggaatctagattaagggaattgccttctcagacaaaaataggggtcatagaaatgttaaacaagaacacaaagaccaccatgtaacaggcagtattccaaaattaccttttaatcctgacacaacactcagaggtgggtaatatcatcactttttacagatgaaggagttgagtctcagaggcattagacaataaataaatgagtcagtcagactggctttaacacatgtcattggaaatcaaggtcagctttctactacaaatataattcaagttcacattgcacactcaataactggtgttaagacaattaaggtatcatttgtaggagaatataactggatccttaattcctacctgacagtgaagcaagttccagagtaacaaagtgtatataatatgcatatatcagagaacaacagaccaacagtcacataatcaaatgagaaggaatgcacttctaaacataacattaaaaagcataatataataaattaactaaagttatttaacgtgtaagtttacttctacccagtaattaaacaaatgccaaataagtacacaccaaagcctactaagtttcaaataacaattacaagacaggaaaaaattctaacactatcttataaagtcattaaataaatatatggccatcactttgtagacttcagagctttttaagaaccagttccatgagataagattaaggacaatggtgatgtccttggaagacggtgtgaagagctcctctgaaattcatgagggtccatggattgacaggttattaaaactattcagggaaaccccagggaatatgatttctttttcaattagtcatccaacaatgtttatctaatccctttctggactagtttctagggtctcagtggaaatggagcatacactaactgtagcgagcttgaattaaggcaactgagacactgagacagagcagctctgttaaatctcatacaaaaagccaatcgatactgtgacgggaagtgaattgtacagacattggaaggtagatgattcctagggaagggattgtgatagtcagggaactgatgatgaaatcaagggctaagttggcagtggtagagagagaggaaggagaatggattatattttggaggcaggtttacaatttgttaatttggatgctacaggatgagaagaatcagtggccctgttagtattttttgctactgttacttagagggcagaagttatgaggcgagtagacaatttagaatagaaggtacatgcatagaatctgagattcatgagttacctgccacgataggtttgagattccaaagatatctaaagagggatgtcaaataaccagatatgaagaagtgatttgtttgtttgttgttgtttggtttgtttaggtttgactaacctttaatgtaatcaggttactctccagatgagcatatcagtctacctgagaatacgaagatcagtttgtccaggttgtaagatacctggtcactcatgccatatatgttcgcatctttgcttatatattcttctaaagaggctacaagtgaaaacaagtaccaaagaaattatccttatgaccaaccaacgtttaacaggaatctattacaaagaagtcctaatcaaggtacgagaatgtctaggtcttcagtttgattccattgataaacatgttggtttttatgacaataccatgcactttttattactataggtagtacaacttgaaatcaggaatggtgatcccttcagatcttcttcttcttcttcttcttcttcttcttcttcttcttcttcttcttcttcttcttcttcttcttcttcttcttcttcttcttcttcttcttgttcagaattgttttagctatctcagggtttttgtttgttgttttttcatatgatgttgtccttttcaggtctgtaaataattgtttcaatgttaatggtgattgcattgtatctgtagattgctttttggtaggatggtcatttttactaacaatccatgagcattggaggtttttttaatcttctgatatcttcttctgcttctatttcattaggggatataagtctgtttaaattatttatctcaccttgatttaacttttggaatttgtaattatctatttcttttggattcttctaacttgttgaagtacaggtttttaaagtatgtctttatgagtctctgtgtttctttggtttctgttgttaagccttcccttttacttctgattttgttattttggatattgtctctctctgccttttagttcatttggataatggtttgtctatattgttgatttaagaacttagtctttatttcattgactctttgtaatttttttctttgtttctattttattgatgtcagccctcagtttgattatttcttgccatccactcctcttagatatgcttactcctttttcttccagagctttaagtgttctgttaagtttctggtctctccagttgtttttgtttttttgtcttttgtttttaatgaaggcaattaatgccatgaacttgcctcttaaaaccactttcactgtgttgcaaaagtttggatattctgtatattaatcttcattgaattataagaagtcttaaatttttttctttatttctgccttgaccaattttccattctgtagagagttgttcagtttccatgaatttataagctttctgttgtttctgttgttgatatccagttttaatctgtgatagtctgactgagtgcaggaaattttttaaatgttcttgtatttgttgaatcttgctttctgtctagttggtcaattttggagaaaggcccaagaagtgctgacaagaagatatatttttttgtgtttaggtgacatgttctgtaagtatttgttaggtctatttggtttataatgtcttttagctctggtatttctgtgtttagtttttgtctggatgacctgtccattggtgagagttggagagctatgtctcccattaacagtgtgtaggtttaagctgtagtaacatttcttttataaaagtgggtgcccataagtttaggtcataaattttaagaacttaaatatcatgtggattttggctttgatgaatatgttgtatcctcccctatctctttcaactagctttagtttaaagtatattttgttagatgttttttctttttatcattttgtatggcttcattttgttagatattaaaatggctataccagcttgcttcttaggtccatttccttggaaaatctattcccaaccctttaccctgatgtgatttctgctcttgatgtgagagggtgaatttgtacagagagattttggcatcactatcacatagttaacttttaattttaggatctagatacaagttttcaaggcccaaatgtaaacagaaagagaagaatattgagaaaataacactaaacttgtggtggtttaaatttgaatgcctctaataggctctattatatttggatatttggtcattagggagtgatgctacctgacaggaattagggaggnnnnnnnnnnnnnnnnnnnnttgtactagagttaggtaaatttgtgttaaaagttaaagtgaaatggttctattagcctatatgaaacttttactttaaagtagtaactctgttttaccaatggccattctgttgaaaaacagctcctttccccaatttcagtatcgaagaaaaaatatacttaggtagctagctacttgtaaattgctccaagctgaacaaagtgcttagaacttgtaacttgttcacaaaattcatgctaaagaagattaaaattaagattattgaatagagtctcacaagtatttcataattcctctactgggctcaaggacctaatgacagctggtgagaggagaaaaggaagaccaaaacagttatataaatgtgcaatattattttagcttatgaaaccttgtgatggaaaagatgttctgattccacatagagatattgtactgatgggtgtattgacattattgaagtaaagtgagggttgatcatttttgcagtgtggtcctgaataggaaagcttcacctgtcttttgttgatgataggattgctgctaaaggatgaaacaaacaattagatgaatcactactaccattattattgcttgagaaaggccgaataactaactacccttcatgatgggtgcaggtggacatgcaggcagaagtgcaagtatgatgtaggaagaggtatagaggcaagtgcagatgtaaagacaggcggaaatgcagtgccagaaaacagacagagtaactgcagcttccttcttcctcttggactctctcctcctgcaagcaactgcatcttcactcctgtccaggctatttctgcacgagaactcttgtccttgataaccttgtagaagacccagtcctctggttcttacaatctttctttccttcctttaaaacaatctacctcctatttatttttcaatattctttgagccatagatgtaagggttgcaaaatgacgaatttcccagacttagggatcagaatgatgtcgctgagctaagatgaatgtatgtcctacaggagacccaagggaggatttgcttttctattcttctgggtcccacaggctgcccatgtttcctggcttatggaagattgctcttccctttgctgtagacttataaatctctgtctctgccttccttttataagaacttctctgaattggtacatttacacaatggaatactactcagctattaaaaacaatgacttcataaaattcacaggcaaatgcatggaatttggaaatattatcctaagtgaggtaactcagtcacaaaggaacacacacgggatgtattcactgataagtggatattagcccaaaagttcagaatatccaaggttcaattcacagaccatatgaagcccaagaagaaggaagaccaaaatgtggatgcttcaatgccttttagaagggggaacaaaataactcacaggaggaaatatggagacaaagtgtggagcagagactgaaggaaaggccatccagagactgccccacctggggatccatcccatatacagtcaccaaacccggacgttatggtggatgctgtgaaatgcttgcagaggaaagcctgatatggctgtctcctgagaggctctgccagagcctgacaaatacagagggagatgctcccagccaaccattggactgaacgtggggtccccgatggaggaattggagaagggactgaaaggagctgagggtgtttgcagcctcatggggggagcaacagtgtcaactggccagacgcccaggagctcccggggactggaccaccacatggacacatgagacccttggttctggccacatatgtggcagagggtgaccttgttggtcaagggaggagaggcccttgggcctgaggctgtttaaaaccccagtgttggggaatgccagggagggaagacaagagtgagtgggtgggtgtggaagcagcctcatagaggcagggggaggagaaatgggatagggggttttggaaggggagacctagaaaggggtaaacatttgaaatataaataaagaaaatgtccaataaaaaattactgaactataaaaggaaagaaagaaagagaaagagagagagagagagagagagagaaagaaagaaagaaagaaagaaagaaagaaagaaagaaagaaagaaagaaagaaagaaagaaccaactactgtgttgacattgggtctgtgtggataatccaggagatattttcacctaaaatccttagttcagtcacatctgcatagtcctttggtcatggaagatgatataggctctggggattaggacagaacattttagaaagcccctcatttagcccatgaccacattcactgttattgcatcagatagtcaaggaaaaaatgcgaagccgaagcaagctttttcttcctctttttatttaatatattttcatacagtactttttagtcatattctcccttcccacgactcctctcaaatcctccccacctccctacccatttattttctatctctcaacaaaaatcacacccacaaaacaaaatcaaaccaagcaagaaaaaaaaccaacaaaatgaaaagctcacaaaacaaacaaaggaacaacaaccacaacacatggggttcattttgtactggacaatcactccggagcccagggcctgtcctggagtatagctggtgttctcagtgacagtcaactggagattttgctttgccaacatgcaaatagtttcttggttaagggtgagattgcatgcccacttccccttctcagtgctgagattctgtttggcttcttgaatctgtgcatgtcttgtgcttgttgtcacagtctctgtgagttcacatgtacatttttccctttgtatctggaagacactgtttccttgaagtcatcaaacatctctgtctcttacaatctttcttcctcttcctccacatagatccccaggccttgtgggggaaggggtttttgatgaagacatcccatgtaagaccgagtacactaaagtctctcactctctgcacattgtccagtgtgggtctgaaggcatcttttaaaattaataacaagagctggagttgcccacaaagtaaaagttgttaagtagttggtaatgagattatatttgagtgagttaataatttaagaataccattttggtttaaagccagggtctatataatccaataactacccaagtataacttgtttgaaaccctatccagcgacagcaaactggacaatctaattatttcttttcaaaggcacatacccagttagaaaaagcgtactagaaagatcagaaggatatgtggtgatgagtatgtctccaacggcctttgtttttgagccactcagtagctccttccagaggtaaccagacaccaattttctccacctgagtcatcatttccttaccctgaaattatgttgattatttagaagtcttgctctagaatcatttctgcaagagttaatccattcccacttttaaaacagtatctatactggttggtcagccatgaggaacatttcaattgagccaggttgattgtgtgtctgcaatttcagaaggctgaattaggaagcttgttgcaagtttgaggacatcctgggcattggtagagttcaagatcagcctaggcagtagaatgagactctatctatctatcatctatctatctatctatctatctatctatctatctatctatctannnnnnnnnnnnnnnnnnnncccatcatgtatttgaatgcttggtaccagtcaataaactgttacaaggcatgtccttgttggaataggtatgtccttgttggaggaagtgtgtcactgggactggactttgaggtttcaaaagcctacaccaggcccagcgtctctggctttctgcttgctgccttggatcagtatataaagctctcagctctgcctgcaatttcctgtttgcatggccccatgctctctgccctgttgataacagactcgtctctgaaactgtaagcaagcccccagttaaatgctttcttttataaacattgccttggacattgtatttctttacagcaacagaacaatgactaacacacagtcccaggagataagacgcccttgtttggccttcataggcagaaggcatgtgaatgcatagacaaacgtgcgggcaaatcacccatacacatttaaaaaaaagaaaagcaagaaagaaatttctattaatttcttccaaaatagtcttgtttatcgatataaaacatgtttgtttaagctatataatccctatattgacacacatatataggtatttggtcatgctttaattttattttcacttgtttccttttttttgtttttgtttttgtttttcaagacagggtctctctgtgtagccctggctgtcctggaattcactttgtagaccaggctggccttgaactcagaaattcgcctgcctatgcctcccaagtgctgggattgcctccggagtgctgggattaaaggcatgcgtgaccacgcccagccatttcctaaaaagacaaataaaagagcaattgtcagcaaagcaggggcctttaagaaacatctcctttagaatccgagactttcctcaattaaatggtttgcctttgagaagtcagttgactttttgttggcttcccttgtttataaaatgagcataattatatagggcctacttcctagaattatgtgagttaagttaagtactccataaaaagatggtttggggttgaccagatggcttagcagaaaaaggagcttgctgctaagcttgatgacatgagtttagtctctgtcactcacctggtggaaggaaagaaatggcttctagagactcggggcaacttgtcctctgacctctcccttgctcttcttcccatcccctccatatgctctaaatgtgatttttaaaatgtgatatttaccaggtatttaacaattatgtttatgaagaactcttattgttgtataagaataatcctcctgtaatttgctttatcaaagtgtgttactggtggctagtggccctgtgtgtgtgtgtgtgtgtgtgtgtgtatgtgtttccctggggtcatgctctccctgtgtgtgnnnnnnnnnnnnnnnnnnnntacaggataaagatttgctactttattctatgtttgtttgtttctttgttgttgttttgttctttaagacagggtttctctgtagccccagctgtcctggaactcactctgtagacgaagctggccttgaactcaagagaactgcctgcttctgcctccccagtgctgggattaaaggcgccccactgccgtgcaccaccactgcccagctgctgctgtaatttttaactacaagaattcttttgacttctaattaattaaaacatgacattttaaatattggtatctggacagccttgaacataaaatgaagagaggattagataagtgcctatagatctgctcctaggatgtgctaaatgcacctatgcctccctcacacccagctctagagtacccaaggcagtgtatttactgattgaactttcattcaggtttgcattcaaggggcaatgttcacttcattttatcctacatacaagttgaatactgaaaatttgttcaaggttttgtaatagcgacctctactggctctagctgaggtatgtgcaagtggattttaaacacctgaagggagctaatagtgaattacattaaagtagggaatttagctattataatggctcgttctttaactgaataacttctagatgttagaattgaaatagtctgctaaagatgggcctgttcgttcatggtaggtccaccatgttaaagcacgggttagcagtgcaggccactgaggctcgtgacctggatgatacggactctcacatgaatgctacttgtatttataactggggttaaagtaaggacgaaataaataagaatttattggagttgatatttgcaagtctccttccatgaaactgtgaatgatgtttaaggtgacttaccagtcttgccattagtgttaatgaaggtgggtgcaggatatgatttacctgttaataaaaactgtccttagtcccttagtgacctaactaagaaactaacacagtgacaatcacagacttttgtttgcagtgtaaattacgtgaaaagctcgcgcatactctttatttcacagtaagctttaagtgctgagctgtatttgcttgttgcttagttattattccctcttttctaaggaacgtgttcaaaagagttttcctcatccaattgataagtgggcaatagctgatgcccaatcagccattgaaaagaggaagagacgaaatcctttatcgctgccagcagaaagaattcatcatttattaagggtaagctgaaataagccacatgacctatgaaaagcaaaataactgaatggtaaaatccttttacattttccagggattcatgttgaggtaagggggtgctgtggtagtgagtaaaggttggacaacgtggtttcatgtcacttcaaaccagtagtagtaaatcaaagacacctggaaaagttatattatagattttatttactccagggttgctagaaaatataattgtagatatttctctctttctggtcagagctaaatatcccataaagctttaaagtctgttagcattttgtgtagggctatctgtgagactgcagtgagggtctgtgtttttgtgggacaaacaagctggtcctgcttaaataagttaaccactttagtgtacccagaactagaaaaatgccaagaatcctaagagtgctagtttgggtttatttaccatgacaaacaaaataannnnnnnnnnnnnnnnnnnngtcttacattattgcccaggctggccttggcctgagtgctggcattaaaggctggcattgctacgcccgacggactgacctgtgctttctcctctcctgtaagacttcatcttccttgggaacttgtggctccacagacgcacatactctctgtgaagtctaataataggatcatttaaatgcttagtagcacatagcatggagggtgtttgttttgtttttaattttgtttttcatggaaagccaagagtgtgtcatcaggtaatataccatatgctccccacaccaagctcagactttgtggttaaaccacttacttacacactactgtgtactgctccagtactgtacacaaccagagacgattctgcttccctctgtgtgtacgcacgtgtgtcctacacataatagggtgtgtgtgtgtgtgtgtgtttctcatgaatgaactagtgaaaattaaattattaaatattggtagtgatgggcttcagtgaaagttaagctgggttgatactgtttaattttgtagttgattgattagattttactgtgtatgacgtttaaatgtgctttccttttaatttttcaggaggtcctcggttataaaattgaccaccaggtttctgtttacatagtagcagtattagaatacatttctgcagatattttaaagctcgtggggaattatgtaagaaatatacggcattatgaaattacaaaacaagacattaaagtggcaatgtgtgctgataaggtaggagaatcagcttctttgtgttgtattcataaattattacttatgatttattggatgctaatatactcttcagaaagaatagaattgtgcactgcattatgttttggggagagatttccagtaacctcatagcatacatccaggttgttactgtatggaaataagatagaggtggctggtacttaagtggctttttaggaaagaagatattttctgatgggattctattccactttcttcacactctggccattctggttatagattctacttatgtatgtattagtgtttattctaacagaataaagtgaaagagattatctggcctgaagaattaaaagtgttgtgatatttttaaatggagataaagtacttgatatttatgattacaactgaaaatgaatacaaagtgtttgctactttgttttaaatgtgtgtgtgtgtgtgtgtgtgtgtgtgtacagcgcagggattcagagaagtcggaacaagtattcgatctcctagaaatgggcgcacagagggtttatggtgctggaaactgagcccaggtgctctgggcaagctgtgagtgcttttaacagccaagtcacctctctagcccatctgctaaaagatttatttttattactgtggcacatgggaggggcattctgtgcacatgagcacagttgtttgtgaagaccagaagaggtaccagacccctgaagttataagcagttgtgaattgcctgacatggcttctgggaactgatacacttgtgtgttcttaaccactcgcctgtctgtctaaccctcttgcttgctactttttaaatgaatcatataagtaaaatattttttagtatctattatgtgctcatacagaaatgaggtacagaaaaatgtgtttaaaagggggctgggatctttctaactggtagagtgtggcctaggatgcataaagccttggatttggtttctggtcctgggtaaacagaatgagatgcgcgtgtgcaagcagaaggatcagaaattcaaggccagtcttggctacatagtgaccctatggctagcttcagttatatgagaccatatccctatagtttaaaaaatttttaaaaaacaatgcttcaaagttgttgaaaggtgacttacgttgtagcataaggtaaactatactgcagtgacactgtacagggccacaagagtgggaagggtgagtttcagcaagagtaaccgtggaaaactttttgaagaaactttttgtatgtataggtgtttaacctgcatacatgcctgtcgccatgttgatgcctggttgccatggttaactgattctctagaactggagttaagattgtgagccaccttgtaggtgctaggaatgaagctcaggttctctgaagaacattaattgttcctaacctctgagccatctcttctctaaagccatctcttcctccccccccctcccccacagggcatgtttgtcctcttgtgggggtgggggggatgcctagggcattaaccttcaagggagactacactattattactgacactttcattttacctctgactacataggtattgatggatatgtttcatcaagatgtagaagatataaatatcttatctttaactgatgaagagccttccacctcaggagaacaaacttattatgatttggtaaaagcattcatggcagaaattcgacagtatataagagaattaaatctaattataaaagtttttcgagagccctttgtctctaattccaaattgttttcatctaatgtaagtatattttgttatttttgcatgtgttgttaactttcagttcaaatttgaagttatataattcatgatttctaatttgtcctgatcacaaataaagtgctgccacagtttcaagagattaaacatcagaaattgaaagacagaaatctaaaatagactaattatgtaagtgaaaatgaaatcacataataatcaatttatctcaggggatagagcgtcttgtgtaggtgggagatatttttgattcagtgacttatttgagtcatttaagtgatacttatcaacagcagccgtattgtgggacaccacattcagaggagtcagcaacagtcctgtctcgtcagggcggagctggaaatgtaggacgaagagtcgtaatgcaagagtaacagcggaattattgggaacacaagagatgagccgcagggcagtgcccgtgctaaccgtgctagacctaaagaacgttcagtgatgagaacagtgccagctctggagctccaggcatcgcagttcctgggcattaaataaaacggagagcagctgagagcacagcccagtggcagagcacttgtctaatctgcctgtgaaaccctgggttcaatttccaccacttagtttgtaaatatgccaaacactacttattgagttagtttagatgtatgaaatgcatggtatttaaattgcttcattaaatttgctttaaaaaatagcaaaggagggataaagatatctgacacaaaaatcagcaatcaaatttgctaaatggtattcagtatcagagaattacaaatcgaaaccctagcgagatgcttgcgtacacgtcttagagaaagttaaaaaaagacagtgtcagacatggagaagaatgcagtgattgactgctcatgggtttgcaaaatttcaacattacttgtaagttataaattaaattagtaaaattggctggttttgtaacacatttctacattttctgacaattctgttctgttagttttttgcttagaagaaacaacaaggccacacaaaatagcagttttattttatagctcagtgcctaccagttgtgaagggagactgtgctttgctcacacaatggtcagcttttcaccaggagtaaagaatgcagggctgacgcatacatctgcatagctgaacctccaggactcgagcagagattcgtagatttgtctctctacttcctggacaataactgtctagtcacagggagtgagcactcattttctggctgggaggatggtgggagctgatacagaggagacataagggaacttaaaaattttttttcaattttttttttttttttttttagttttatgtgtgattnnnnnnnnnnnnnnnnnnnncacacacacagtagagagagagagagagagagagagagagagagagagagagagttttccttctctttgataaaataccttgacaaaaacaacttaagggagtcgtggtttgtttttggcttacagttcccgttcagcccaggagagacctggcggagaaggcatggcggtcaggagtgtgaggcctgcttgtcattttatagcctcagtccagaaggaaagagtgaacaggaagtggggccagactataaaaccgcaaagctggttggtccccagtgactacttcctccagcaaggctccgcctcctaaaacttccataaccttactcaaagtagcaacagctaggaaccaaaggctcaaacctgtgagtctatggtggggtgagatggaggagtatgggggtggcactttatattcaaaccacaatacatacatttactttgcatccatatcaaattgtgttgatacttaatttcaagcatgtgaagatccgggttttgtgtcactgaagtttatatagtctaagaatctcagtgtgtgtgtttgtgtttgtttgtttgtgtgtgtgtgtgtgtgtgtgtgtgtgtgtgtgttctttgaatagggactacaaaattttgcggctcatatgggtggagtcatccaaactacaggcccagccttgccagtgtggtgagtgaacccagatccagtgcttggagtaggtccaacctaatatctactccatctgcgagctgctggtgtgtgtgtggaggaggtggtcctgcagaaccagatccagagcccatcatcaccatcaaagatgaaaacctgaagcacagttgtgactcaagagggtggcactcctcaggaccttggaactgctccgaggagcccgagagatctatggagctctgaggggagacaagaaggtagctacaggggagtctgcagagcctacagtatccctggaacaactagagaagggtaaatcctatgggaagatgctttttagaaagtagacacctgaaattggaagggaagttcagggacagagccactggtacaggggagaatggcaaaactatagacacgagggtatgggagctatatgggaatccttgccacaacaaataaagaatagggcatgactcaataatagggtctgaccttggcctgctgacatgaagctgctactggggctcgtgatactgagagaagaaaattgctggacctctacactgctttcaggctgcaaacattatggtcctgcccgatgagcctagggatcgttggcatcaaaagcctggaggtgtgtagtagtttggagctcacaagatcaccctgagtctgggccacaccaggatatccaagatgaatctcagccacagttcagtgtttattatcataataaacagaaagaatagaaaccttgaaccaaaccaatgactccttgtaatgagtatttgcatataaagctgtttgggcaaatatgtatataccatgttgacactctgcagtttgcaatgccactccaatgaacaaatatacagagaggtgggaaagatgtaggaacagaggagtatgtgcctggcagagagaggcagaactagagatgccacggtggtgacaggtgaggaagaaggatgcaatgaagaggagagcatcgatgcggaacagggcgggcagggtggtgtgcagaagcctggaggtagcacaggctttggtcccaaacacactgccaagctgcatggttgccctggatgttcaagatagagaaaggtccatttttggattgggccttttctggaaagccctccaaggtctgtgctagccctggaggtcatgttgttatctgtgatccaagctactgccagggcccatgctggtgtccatggtccctgctgctttctaggccccattgatgcccaaggtatatgatctgtgttgccataggaagccagattgatgagtgtggcctgtgctaccacctgaggtcatgttgttgtctgtggtccaattggccacccaatagtcctgtcagtgtctgtggtgcatggtgtggctgggcccaagttgatatcgatgttatcatgtaaccaccaaaggtcatggggatatctatgatctgtgctaccacctgaagccaggctaatgtctgtggcccatgttggacccagaaacttgtgttgacactgactataaagatcaaggaaatatgttttgcagccttatcaatgactggaaactcagttgagaatgagagatatagacggcttctgtgagaacctatctccatcccccaacctcactacccatcaacgaaagtctagacaggaagtcattgaagggaactcttaaaattatttgatagagatgctaaagtatagctcttcacagctgatagcttctgatggggctggtgaacagcttgggattgggatggggaaggactcagttttcattaaagggnnnnnnnnnnnnnnnnnnnntagatttgtctctctacttcctggacaataactgtctagtcacaggggagtgagcactcattttctggctgggaggatggtgggagctgatacagaggagacataagggaacttaaaaattttttttcaatttttttttttttttttttttttttttttagttttatgtgtgattgttttcctgtgaaggtcagaagagggcactagctctccttggactggagttaatagatgattggagctgccatgtgggttctaggaccttaacttaggtcctctgggagagcatctattaactgctgagccatctctccagttctcataaggaagttttttaagacaagaaaacattgtgaatagtgactgttaggaggttacagagaggaataactgtatacagtctcaccaaaaagtacatttaaagtaggtatatctcattgcatacaaaccatacttcaaaattaacagaataaaaatagtaatcaacagattttaatagaacagtataaaatttatatggtctccaagaaatgtaggaaatgaccaacttattagcagcagtataatgacatttgacctgtttgcatagaatgttcccagtagtagatacgcacagcagggctctggactataaatagaacaatgggaagtcacttttgctaatgagtttaagttgtcttttgcagagatgaccttagtttaagtgtactgaaagccagtcagtggtaaatacattttacagtttattcacgtgatccacacacaggaagataaaattgctttaaatgagctttttggtgagatcgtatggactcatttatccttattatttaaccatgccattgtagagatacacaatactttcttgccttagacaatttctttatatcccatccacattaaccttcgccatccttattcccagaaagccagttattttatgatatgttaattaaaggttgatagaaaaattacatgaatgttagacagaaaacaagaatatcacagttgaatagacaattaaaatattccttcattttcccattacatgtctggtaaacttatgtatctagataaagctgtactttatcctgttctccagccacaacagactgaatgcagagacaaatagaaaagtcctgttctctgttaaactgtattgaagattagtaaagagagtatgaagatgttctaaaacaaaatgattggtagagagacatatttcttaattgtatatctatcactaaagaataaattttgaagtattttcttattgtaagtcattaaaattcctcaatatctacattataccttgattataaaataatttttttactgaaaagatatcttgttatacaatacaatatgattgaattaatttttctttctcctccgcaggatgtagaaaacatattcagtcgtatagtagatatacatgaacttagtgtaaagttactgggccatatagaagatactgtagaaatgacagatgaaggcagtccccacccattagtaggaagctgttttgaagacttagcagaagtaagtatatcaattatattgtcaattatatagcaagagaagtctgtctgtaagtacattggcattaaaatggggttcataattcctatttccagctcaagtcacataccgttgcttcttttccatcataggtcaacatttattactgttaccaggtacagaaatagttatcaagcactacgcccagtctcggtgtcactctgaaactttgatagaaagatcaaggcaaggccacccgtgagtgagaaaagcttgggtgtagggtcctagtcctcacagctcactgctcagatcactgctgtgtattacatgtgtggctccaggcgagttaccgatattttgcttctctatacacatttgtaaagcaagaagaataacaataagaagtctcaaattttttttttgtaagttaagataatctcccttaaatatttggctaattccctttacatagtaaaataaccagtacgtgatagccacatttgtttttagaattgaacaatgaggtgctaggaaactcagcccatggcatagacagttcagatcccatgggagtctggtaaccctgagtatctccaatgctaactgtgagttaattgtagtgagtcatcactggtagtcactctggggtttcttgctcttgtcctgctctaaagcccatttagtcttttagtataatggtgctgagcccatgggaaagaagagaggaaccagggatctacctctttaggtaaactctccccagcaaacatgaggcccttggtttagttcccagggccatatgaactgggtgtggtggtgcacgcctcgtaaccctcagtaatgggaaagtagatgcgggggtttgagaagatgggtgccattctcagctacagagcacgctgggcgtcaggctagatccatgtgaagctcttagagctctgtggaaagcaccaagaccaagggctgcttggggtttacaggttacaacctgtcatggcaaaccagagtgggaaccttgaggcgggaactgcagaagactggaggatagcagctctggcttgctcagcttgctttcatatctaactcagaacttacacccggggatggcatcacccacaacccacagagggcttagaacttcatgtcagtcaccaatccaggcaatcagttgggggtgtttttctcaatatcggttctctcaatcttttgtcaagttgacaaatgactacccagcacagaggttctatctcagaaagcatgggacaaagccagtgccctgggtaggaacctccaggagagttaaggagagaacactgctcaaggggctgcacagcacagggtcagggatgggacagagcaagaggagttgtcttgtttatagtctatagttggcaaatacaagaaaacactaaaatattaggtgagttcacagtatcggcttagagaaaggacgagcattcctatgctgtcacacatgccagaacatagaactttacaggcagaaggcaccctgtctcagaggcacagtaagcatgtggggcaagcgcgatggccccgcccataaagcactgtgcaggcctaacacttggtacctagggtgtcccagccttaagagtttaatccctagaacgtgtggtagaaagagaactgacccccaaatgttgtcctctgacctgtgcacactagtacacacatacacatacgtgattctactattactactactattactattactactaatgataataaaactcaaaaacctaactaaaagtatataagacctattaagaaaaattgtaaaatatttaggttgatatggaatgtacaagtacatggtaatacattctatgttgtgtttatggatggaaaaactcagcattgcattcatgttagtcattcacaagtagccagagcacagcaagctgatctttaataggtacaaatgaggtgtggtccatgctcataatcccagcactgaagccaggctttcgttgcaagttctagctatccaatgagatcctatttaggttgtctcagccactgcctaccacccactcagaagaatgagggaagcacatggaggagatttgcttcatcacagatttcagtttattaaataggaatatcagagttgctaccagtataggcagacaacgaatgaaacagaatggaattacagttttgacatatggcacagattgcattgatcagtagggacagaacaagttgataattaaattacgagttgacccaaaatgtaaggaagcaggaaggcctggagcgtcacctgctacgtgacactgtatggtgtccagagccctagtccagagtgttcagatatggtattctggctagtaactctttcttaagtactttaaaaacagtactagaggtaattaatacataatttgtattttatcttgaatcgcttgtcttatttcttacctactacattcatccactgatcttctagaaccagccactgcagaggtgaggcgctctggacctgaagctgggtgtgtgtgtgtgtgtgccatatagtagaggtcggaggacagtttgttaagtcacttctatccttccactctgtgggtcagggattgaactaaggtcatcaggcttgtcaccagatgtgtcaccagatgtgtcaacaggtgtctttgctcaccgacctttgtctgtccctcctgacagttttataactggaataggccacaggatcaaagatgggaagggccctactctctgtgctaaaatcaatagacctactctgtgtttcatcagcaatcatcgtactcttttagaccttgctatgagtgatatctcaatggtgattggtatattaatgatgatggattttttttttcactttggattaagttagttttatgaaaacagaattttaggtgatagaaacagttacttcttatttacaaaatagggaagtaaatgtctaacaccaaaaatattttttagatttattctatgtattttgcttctatgtatttgtaccatatatgtctctggtacccccagaagcccgaagaggacatcggatatcctggaactggagttgtgatggttgtaagccactgtgtgagtgctgggaaccaagcctgggttctctgcaggagcaatagtaactgctgagccatttctccagccctccccccacacccggaagactcagtccctaccatcagcactctaaggctcgagtcttacataccgtctgttgtccaggttcagctgtgctcgtctctagggccgggtcaggccactctcagaacaactcctggttcacagaagcggaagctgtggccgagaagcagcacagcacacagtgactctgctgctcagaagaaagaactcgtggattctttcacttgaggatattagatttattctgttaaaattataatggccattcggtttttatttggagcctttaggaggaataggtttctgtagataagtttataatttaatcttttgtattttgtgtggtggaccatttcttatttatgactatttttactttactgtctcccttttttcaggaactggcatttgacccgtatgagtcatatgctcgggatattttacgacccggattccatggccattttcttagtcagttatcaaagcctggggcagcactttatttgcaggtatagtgattgttaaattgcacaatgttagaaaagtaaactctaaaaaatattaaatcctttccctttttagtccataggcgaaggcttcaaagaagctgtccagtacgtcctgccccggctgctgcttgcccctgtgtaccactgtctgcattactttgaacttctgaaggtaaaaaaactcagattgttatttataaagcattcaagtgtcatcgtttgccacttcacttgcaaacatgtgagcatccacacacattagtctatgttctttttctttgtttagctgagaagcaattttaagcacgttatccaaaagactaacgtgctttctgactacttaactgtaaagcagttgcccaggtttatttattttacttttatctgcatttattttatgctgactttattcgtgtgccatgaagttttgtttcttcagtttcttctggggtatctttttctgtgcagcctcctcttctggctttggaacggtcagtgaggatcatgtcaatgtggcaggggggccatgtatgggttaacccggccatgagctctggaggtgcgtctgtctgtctgtctgtctgcctttctgtcggcgtctcaggggccgtgttcacctggatttgctcagtgactagaaatctgtctaaacccttaagttcagcattactctctcatttttaagtgtgtgaagcaaaaattcagcactcttttggctactgtccgtgtgtccagccccactgtttggcctgggcacacctaccgccggaacggcacacattgcttctttaaagtgacatccttcagatccttggtggctttgtggatatgcatacccttgatggcctgggcagtctcccgggtgttcttaaagtgaactcgaaggtttgagcctcttgatttgtatgattttgtggggttttctgggtcaagccagtgttgaaccatcttcacaggtcacctctggccacttagaggaagagcccagttttatttttaatcatgtggtctgtttgcttatatggtgattctttgaaagcaactttgtatatatgcatccacatctccatctgaggacctcaatagctacagggactctcctcagggacccaatatgaaaataaggctaaagtaataaaaactgttagttcaatagattttcattgttcagcactgcagcaatgtctgttaaactcagtgttgttattattttagaagcagtgaatttgtataccagtaaaagttctccaactgatcatagttcaaaatattaagtaaaaaaattctaaaggattagtagccacataaaacttgaaaattagtttataaataaaagcaagaagctttaatgagaatttgaaaggttataaaatccaagcagtttaataaggaaaattaaggattgcaagatggcactgtgactggcactcgtcacagaagcctgacagcttgatgttgacccctgaagctcacatgggaagagagaaccagtgtcccagagttgtgcctgaccttcatgtccatactctcacacacaggcgcgcacgcgcacacatgcgcgtgcatacacacacaagagaacttataggatggaaagagagatggcttagcacttgctgctcttctagaggacctgagttcagtttctaacaccacactgggcaactaacaaatgacctgtaactctacattcagagagctccagtgtctttgtctggcctctttaggctcctgtgcacacacagcgtacaaacagacacataattcaaaatggcttttaaagaaaaagttagttaggtaccaagttcaaccttgtctcaaaacaatcagaaaggccagcaaggatgtgctactactgtgtgagtgactcctgggacccatgtggtagaagggagagacttctgcaagttgcccttcttatctgtctccatacatggacacataaaagcaagcgtgtgcacactctaaataaataacttactttttaaaaaggaatgctttttaaaattatctggtatggtggatcaaacctatagtaccagcacttgagagagactaaggcaggtagattactatgaatttgagaccaggcaaagctacatagagaattctaagccaatccgggctacagtatgggaaaccttgccttggggaggtgtgggagatgattttcatatagataattaagacttctcaggactttaggatgtaatgttgttctactgtgtgtgtgtgttcctggttcatagtatgacttgccttacattgcaaagcgtatatgatatggtagtacatggaacagggcacggatctgtccatacacacactcatcttttttccattctggattctttcagaatgaatgcatgacttgaatttttatttatttccatgtgtacacacaagcaaatgcacacacaagtgcaccaagtgtacatgaggccagaggacagctgacaaagttggttccctcctgccaccattgtgggtcctggggattaaccttgaacccttgttcctgtcaagctgtctgccagtcttactggcgcttcagctgtgtctgttggtttaccgctcagctcatttttgtaggggaggattttcaaggtgtaatactgtgtatgtctgtaggcaggtggtgcataagtatgcgtgacaggagtccacaccggggagctgaagaagtcttcagttattcatcaccttagttttgtgtgtatctgacagggtcttttattgaatgtagaacctgccaattcagctagaattgctggccagccattttaagggtctgcttgtgtctgtcttgccaatgctgagattatagctgcctaattgtggtctttttgtatttttaaaggcagggcctctgtatccctggatgtcctggaactcaatatgtacactagactggtcataaactcacagaaatccacctgcctctgcctcctgagttgtgggattaaaggcgggtgtgtagtgtctaactttttaagtggcatttgaacttgggtcctcatacttaggcaagcattttaccaactaagctattttcccagctgcctcaggttctgttttgagatgctggtatcatgacatactctaaataaatggagaactggtcaatatacactattagaaggtttgaaaagttgtatgatacaccaatgtatttgtaggttacttagggaaactattgaagaggttccaatgttcagtgaaccaaaagatgccccccactgcaccctctgattcttggtgttctattttcttttctttggagaattgttatgaatcctaaatgcccatctatgtactcagtaattctggagacagctgattgcatgagattgggcaggtggaaccgaatcataatttatctgtatgtggaatgggttcagaatttggtgacactgacgtctttctacctgttgtgcagctagagaaaagtcactttatttttttgatccctggttttcttgtttataacctgcttatttcacaaggtaaggcattcaaacagtgcatttgtaaaggttacttcatgaatgacaatgacatcggcacttgcatgttttcagcactggagatgtttcttactgtctgtaatgctggccactaaccacacccacattttcctgcccaccagagctctgcttttctttatagtctctgtctttgttggctagtgtgggccccacccatcacaccacctttgattcttctctcttccttactggcagcactcatgatttaacatcagaaatgaccatgtattcagcctcaagtgtccatttgtagtgacatcaccttcatatcactgtttagacacaataacaacttctttatatcatctttgtaattccttgaactctgagatggaaaggtacagttggttccctggcacctgcaacaggaagtctagattcttgagttccactgctgctgtctgtagttttatctcagtcgtcagttctgcccatgagcttgagcagccctgggtatgccagctccgtgcatggtgccatttttgttctttttcctcccccctggcctggtggaatccctctttttctaagcccccttttatttgagagtttgttgggttgcagggtcagatacccctttgttcccaagctgctgctgctgctttcacacctccttacagatctgtcatattggtattgtctgcctcgtcttcagacactatgttccctgaggaaacagaacaaagcctgtatgcttctgaattctgcctagcacagtacctggcatttaaattgtttattaaatgctcattaaataatgaggagcaaaaataggtattttctcaattcctatctgttgtagctttaaaaagtttaactgtaaatttatgtatatgtgtttatttgggaaacttagaatgccttaaactttacaaattcataggatagaattctgctgttatttgcctaacagtgtcagacaaagaaatagagtaatgtaatgtttcctgtgggttggggacattaggaagagatttgtcaacggatacaaaacttgagttaggactgaagaaggaaagaagtattaaactttatagtgttaatcgaaatatgattaaaatgaatttaataagcttactcagaaaatattaaatcacatggaagtataggattaatctaaggggctttgcctaactttgagttagcttcctaacatatgttacctaggtaatgtaggaagataaaggaaataggctctgacttcattagaatataagtgttctgcagttttcccttttttttttttttttttttttttgtaaatttgctttttcaaacccttttcgcttatcagaagaagtgagcatttgccacaagccttgaaatacaacctcggctccatctgcttaggtcttgtttgtggtgactgagactctgactctgtgaattcagaaaatgtggcttggggatggggacctaaaggccactcctagatgaatacatataagattacaacatcacagcccactctaaaggctcagggagattgtagctggggatggaccacttaagcattagctagggtctgtcccacactaaccaagagctctcctgtctgagtgcttgggtgaattccttactggattgggtctttttctcatgacagaaggaataataaattcaagagaatttcagcctagtgtagaacatgcttacagcatccagggcctggaacaaagattcaagactagccttcaaaatggaaaaacaaaacaaaaacaaacccatatacacatacatttatgcatacatacatacataacgtgtgtgtgtgtgtacacatacatatagtgcctatagcaataataataatattgtatagttttgaaaactgctgagcagattctaagaatttacatctgagaaaaatatttgacagtatatatttttaaatattttgtcaagcaccatattgtataccataaacatatataatttttacttgtcaattttttttgagacagggtttcattacttgtcaattaaaaagtaaaatttttcaaataaaaaattttattaagattttatttttaatcatatgtatgcctgtttgtgcgttcatgcgtgtgcaccctttctgtgtgaaggtgcctttagaagctagagttgttagacaccctgggactgcactttcaggcaactgtgagcaactgggtaggtgctgggagacaagttctggaagaacactatgtcctcctcttagtcagggccatctctttgatctaaattttgactgattttagtactacttgaatttttaaaattatttcctcaaaattagacagtccttaggcccttttattagttagaaacattaaagttaatattttatgaagtggaaaaaaaacttcctttgttgttgtttcttggagacagggtttctctgtgtagctctggctgtcttggaatctctttgtagaccaggctggcctcaaactcacagatctacctgcctctgactcctgacggcttggatcaaaggcgtgtgccaccatacctgaatcaatgtgagcttttgaaaaatcatatgctcctataaggtgacttttttatatgaaattttgctggctttattaagcaaatgtagattcttacaactaactgtagtgaccaaaactctgattactaggagttggttcacccaaacttaagcagcttcagttataccctcaagaattaccccgttctctttgcagtatgctgactccatcttactgaaggaaaagtgagttttctttcattttaaaaatcaggttaaagggggagtgggtgggtaggggattgggggggtgggtatgggggacctttgggatagtattgaaaatgtaaacgaggaaaatacttaattaaaaaaaaataaaacaatcaaaaaaaaaaaaatcaggttacctgatgcgccagaaaataaacctcttgcttttgcatcggggaaaaaaatcaggttaaagtctgttacgtatgtagtatgtactgttatgtagtatgtactgctgatattttctaaggctataccaaactataaacttagtggctgaaaacattagtcttcagtagtttattctttctgctctagaggcagagagcaggagttgagagggcctgcatcttcgagggtctaaggaacagcctcacttgctctgaggaggcagcagccatcagggttcccctgagcttcatggagagcctcgctctggacgctctggacgctctggacgctgtggatgtggcctctgcctgcatcagatcaggcacatcacttcccactctgtgtcaggcagcgtctcgctgccctttcctttctcacagtcgagctttagggttcggccataatctagcatggtttcatttgattacttaaacctgcaaaaacctatttctaaaaaggttttatttatttcagttaattgtagacattagtggaaaggtctttggactaacagtcatgacccttaagttctggtctttcctgcctattcatctaagtaaatgttactcattttatattatgttggagaagagtagcttctagaaatacaatcattaattcatatgttccttccttcttaaattagggaagccattctagctattctgtgttctgattaacgtgaactttaatcagttacacactgtggagggggaaaggaatgtaagtaactcagtagtagaatgcctgcttactatgaacaaagtcctggcttcagtccccagtaccacaaaaaccatctacagtttgttttgtgttaaaattgctgagtcttattcttgaaaatacttctgtaaattgtgttttctcccccccccccttttttttttggttttttgagacagggtttctctgtgcagccctggctgtcctggaactcactttgtagaccaggctggcctcgaactcagaaatccgcctgcctctgcctcccgagtgctgggactaaaggcgtgcaccaccacgcccatccggctgtgttttctttagaagctccttcacagcatctgtgccgtggtttcctgggagccgctctgtccgtgctgtccgctctgtccgtgctgtccgtgctgtacatggactataccatcagtactgctttgcctttgtttccttctgatagtcaggggccaggagcagatatgaaaaagcccagctctgtagcccagctagccttaaagttgaggggatctttctgcctcagactcccaagcgctggactagttatgggccaccacatcttatgcaggggcctccctactgcttatatctaaggaacccaaaagtcatcaagggtatgagtgactccttttctatgaaaaggtaaatttgggggctggagagatggcttagtgagcactggctgctcttccataggttctgagttcaattcccagcacccacatggtggctcacaaccatctgtaatgggatctgatgccctctctggtgtctgaagacagctacagtgtactcatacatagaataaatacatctttacaaaaacggtaaactttatcatctggataggccatacacattgtcattatcttctgcacagggcgtacacactcttactatgctttagaatgccttcttaggtgaggctgtgcacacacaataccatcttagtagagttttggtgttggtaacggtcgctgtggaaagcaatgagaacgcttctttgctgtcatttacatgactgcagctgctttgtttctgtggcaagaataagccgcctctttaaggataattagctttgttttacatgatttcctaatttaaatcaattaaaaaaaaaaagaatggacagacagaaaggtttttattagttgtgtgtgatgaccacgagccttgaaccccaacacttgggagatattcagtcgctcctctgagtttgaggccaccctagtctacatcgtgagactatctcaaaacagtctttcattacactgaaatgcggaacacttgcctgttaactgtgaggcaaaaagaacatttaaaagtatttcatcagagagcttcatgagttcaaaaacttaggggctggagtaagctgtgctgacccagtgcttttctagcacccgtataaacagtggcacagacctgtaacactagcactagaggggagccaggcctcaggattgggagttcaaggccagacaaaggcatacaaaactgtgtctcagaaaaaagaaaagaagaaaatggaagaaaaaaaaaacacacaaaactttgggtttgtgaattttaaaacactaacagagaggctgacggggtggcttagtggttaaagagcactggctgctctcacagaggacgcaggttcagtcccagcaccaacatgccagctagaaactgtctgagtctctatttgaaggggtatgacagcctcttctggccttcaaggcacattgtgcacagacatacatgcagccaaaatacccatacacagaaaataaaacacaagcagtattgtccatatgccaatatattcatatacaaaatgcaagttaaatgatacatgaaggactctgaaacagattttgaattgaaaaccagtgtatccctaaacatgttttgggtatatgctctatattagaattctgtacattgggaattctgtatatttgctgagttgtaacaaaaacaggagccagagaggtggctccctagggaagagcacttgctgctcttccagaggacaagagtttagttcctaatgtccatgtagggtggtttgggaacatctgtcaccgcagcactgtcatctgacctatgagggcactgcatgtataagtccatatccacacccacacacactgcactcacatgtataagtccatatccacacccacacacactgcactcacatgtataagtccatatccacacccacacacactgcactcacatgtataagtccatatccacacccacacacacttaaaacatctttaatcagaacaaaatacagaggggacaatactctccctattggcacatcttgctctgtatgttaatgacttgaatgcttctggactttacattttaaagactttttaaaaaataatcatttatttatgtcgggaggggtaagcagaggatggagtagcacgtgtttttggagatcagagaactgcttaagggagtcatttttctccacccaccatgtgggtccttaaggagaactgaggctgtcaagcttggcagcagctgccttgctgagcagtcctgccagccctggactttatttttgattctatccttaagagtatccttgtgcctagagccatgcttaaactcctatgggagtcggaaacagttctgtgttgcctcttctcaggaacatgaccaatgagtacatacgtgacactgcttttttcaaggcttaacagttctttctaaagtggttcctcgtggttttcacatggaaaacttggtgatgtgttactacacagtactacacagaaaagtaaagttctcagagacagagccttctgcttacagagctcaggctgaccttagactcccgctacagtgacacgcatgtgctgccaaaccttgcagaaacgataataagaactgctgtttttctttggagacagcttctcgtgtatccgaggctgccacttcttcctgtgtcctttgattatctgcaaccatgtctggactacatggtatcagagaatagaactcaaggctttatgcaaactaaacactaccaggctacatcagcctagaaaaatgcttcaaacaactgaaaggctggagaggtggctcagttgttaagacacttgttgcttctgcactggaccctagttcagctcccagcatccacacaatgggttacagccacttgcaactccagtaccaggggatctgaaattctcttctgacttttttgggcatgaagcactcatagggtgcactttcagacattcaggcaaacactgacacatgtgaaataaattgaaaaaatatatctatagaacatttaaaattactgaagtagggaaagctgaatgagcatcatttatccttaaataaagtgaggtcctccttctgccctttccacagcagttagaagaaaagagtgaagatcaagaagacaaggagtgtatgaagcaagcaataacagccctgcttaatgtccaaagtggcatggaaaaaatttgctccaaaagtcttgcaaaacgaagactaaggtaaatattctcactttaaagtctcttcctttctatcctgaaagttgtggtacaagttcaggagccttagcccccccccccccccccttgagtaaacaatgaagaaaacagtattagtgacaagcttggtctttcagaggaagtgacatcaaagccaggagagtttgttattgtttgaaaaacctttcatatttgtgcattttccctgcttactcccagacaggacctcctgaggagcagctggtaagctggaggggacggagcacagtgtaccgggcagagctgccagcgtcattgttgtagcagagtgaaattagcagtgttgcttagtttgggaattgtataactcagacattgattcagttagcaggtctactttcccattataacatgtgctgtatgcttttatctttgagtcttgtgcatttaaaaatacttaattcatatctcaatttttttttactgtgttgggctactttttaatagttatctttctaaatgtttactattcaagacagagataattgttttgtacctgagtttatatagttgaacatcactgttatttttataaatctgaaaaaaaaatctgtgcttagttcttatagttatgattatttgtggagttagtaaatatcacgtgagtgatgttgtaaattatattttgccctgtcaccttatctgcatgaactctcagatctgtcttccgtgtgctaacagtgtctttccctttaccccagtgagtctgcatgtcggttttacagccagcagatgaaggggaaacagctagccatcaagaagatgaacgagatccagaagaacattgatggctgggaggggaaggacattggacagtgttgcaatgagttcataatggaaggaactcttacacgtgtaggagccaaacacgagagacacatatttctcttcgatggcttaatgatttgctgtaaatcaaaccatgggcagccaagactccctggtgctagcagtgcagaataccggcttaaagaaaagttttttatgcgaaaggtacagattaatgataaagatgacaccagtgagtacaagcatgcttttgaaatcattctgaaagatggcaatagtgttatattttctgccaagtcagctgaagagaaaaacaactggatggcagcactgatctctttgcagtaccgcagcaccctggagaggatgctggacgtaacggtgctgcaggaggagaaggaggagcagatgaggctgcccagtgctgaagtgtacaggtttgcagaacctgactccgaggagaatattctattcgaagagaatgtgcagcccaaagctgggatccccattatcaaggcagggacagtgcttaagctcattgagaggcttacctaccacatgtacgcaggtaagaaacacgcggtggctagaacggtttcctgcttaaacgaattgatttgatgggtgggttactgtccctgaaatagaaaactaacaacaagcaaatccttctctaggagaggagcattggctaaaaccgtcactctgtatttctttgaagtttttatcttttctatcatatttacaaagagaaacggtcacttgtctttaacgttacccagtaaaaagcagtagaaataagaccaagcctcaacatgattgtctaaaaggtagaattactcagtataattatttttttcttattctataactgggttacaaactaagtgatgcattaggtattcacccaccatcaaaattgtgctggtggcaaaaatgcgtattttcttaatctccattcctacatctatttaggaaatctggaagccatttccatttcagtattttgttcttaaagttacttatgcaaacagttttaccttaacaggttttaaagaaaacctagagagatgctaggtagaattcagtacagtggttaaggggtaaagggcatactgagccgtcttgtgtggtctgacacacagtggggcgtttgatagctgccatttcagaattgccgtggagcagatagcgctccgcttagactttgccccttcaccagatcagggtccctttatgtcccagaaccatagttttcatctcaaaaatgaacatcagatctacaccatagtgtgttgtcagaaaacatacacgaaatactgactatgaaagctatttctaagtttagatggaaatttttaatgtcttttctttaagagaaatgtgtgatttaaaattatataactcatcatatggtattcttaaatacctgactatgaaaattaacctctccctatactcctcattcaaggatattcctatttttaggaaatgcaagtttctggggaagaatatttattttcctgttttttaaaatgtcctctaagtgagttctgtttcctttggaagctattctggtgctagtaagattaactctcaaaaatatcctttagttttcccactttgtaaaactgaagatcatttaacaaggacttccttcccttcaatttattaaatacaagtagcgcttcgtgtggttgggaactaccaaagggagagaaggtaatttgagtgctgttttttattagtgatctcaaaccgctttaaaatgtgtggttgcctttatctgtatagttctggtatacaagctggagtttagttctgctttaggtatctggactctttgcaggcctttcatagtacatcgatagtgttttccaaagtccagttcttacaatgactcagctcctctgaacacgcatttccagtggcagtgcccaggcgctgaggcacgctgaacatgtcatgtatgttcatgtgtatgagtcacgtcatcccgggctccactttactgtaaacttcaccagggactctatagtcagtgtgtttactattcaaaaatttaaaaaagaaaatttaagctgcctagaagttacataaaaaatagattacctttcttgttatatataaagctattttaaagagctacagtttttagtaattattataaactattcacataatcttcatcaaccttctgtatactgtttaaaattataaaataacaaaaatactttgttaacccaaaattgtggttttcaaatactctaaataatttttcaacaataaaagttcaagttgtctatcttgctacattgtctttgtttttaaatcttgtgaatttaaaacctgttcactgtatcctcaatacagcttggcttgttttttatggaaaggacaaaggaaaagccatataaactcaattaaaaaaaatcagcatgtggattgatggtggcactgcagtgtcacagggcctggctttgtgccctgggtaatcttttgaaggcgtcattcttagagtatttaggttgtctattttacctctgcttgtgaaggacacagttttctctacagcatggtcagcaatgatcactggagactaaatagggcaagctgctcttttttttttttttttaattaaatgtattaattatttctatattctaaaatttacattctgtttctaaaacatttctgtaattttctttgctgttgtatttgacaaaaataatttataattagcatttacaagctacaactgatttatttattgatttgctcttttcgagtgcgtctacacttgaacacaccccgtcagtagatcggtgtcatgtggcccagtagtctttacccctcgtgtgtgcaaagctacctttgtcatgatgtcaccatgcacacctaaggactgtactgctgtcaacttacgcaaaataaagtaacatttttatggtcttaaaataacactgaaatttctaactttataccgttttgatgaagtctagtttactgagattgaatgagattactttaccttttttttaagatttctttttgtctctctgtgtgtctatgcaccatgtgtgtaaagtgctagtggagtccagaagagggcgtcaggtttcctgggacttgctttacactcaggtcctctggaagagcagctggtgatcttaacctctgagccttctgtccgatcccgctttgctttttttatttaaacgtatatgtgtatgtgagtacactgttgctgttttcatacaggctcgaagagggcatcaatcccgttatagatggttgtgagccaccatgtgggtgctgggaatcaaactcaggacctctgggagagcagtcagtactcacttagccatctctccagtcccctgttttactttttaaaattaaaagaaaaaaaattaaatcctccagtattaaagaaaaataaaaccaagagtgtctgtgttataactaagtttttttacattgttctgaagtttaattaaatattttatttcataaatatgttactgatataactggtgtccaccagcaactttataagttgtgagcttgaagtaagtgaaattactgctattaatttactcactgttctttgatgtctttaacctgcagtatacgattatttttttaacctagactaactatcccgtcaagcccattcttgccttactatggcagtatagagtgtgcttttgatagacacccatggatctgtaagatataaaatgagtattgtaaggtctcctccagctacaatgacaacatatgtagctatcacttgttagatgattttacgagcttttaaaaaaagattttaagaactttcatgtgcatgtctctggagtgtgtatatgcagtgccagcttaactgatgtaaacaaacattagtctgtgtttttcttttattcagtctccccaaataaaaagggggttttttgatctggttaattggttattagggtgtttttgttaacatgcagtagaggttgtggcttacactgaaacaaaagctaaaattaataatgcttttttattatatagtaaaagacattgtatataatacatgaggaagtctgataactagtggtgaatatagcacttcgacatcatgtagagtattgtaagttacttagacaataaaaattgaagagaaattgactcacatttgattagttcacgttcagcttggcttcggctaacttgatttctcaagtgttacaacaataacttagacagagctacacacctgtatgccaggagctgtctacacctgagtttataacagaagccaagacccctgtggattgtttgagttgctagaaatcttaccagttaattacagaatgaaatctagaaatcaatttctttttaaaaaatatttatttattgtttatttatttaatgtatatgaatgctctgtcttcttaatgaaagccagaggagggaatcagatctcattacagatggttgtgagctaccatgtggttgctgggaattgaactcaggacatctggaaaagcagccaatgttcttaaccgctgagcgatgtctccagtccctagaaattaatttctattcagcagaatatattttctacccatgtcccactgacactttcaaactgaatttttaaaaactattttaatatgttatatttttaaaaggtatacatgatgaataataaaaatgacgttttaattactctcatggtggctattcatgtggtgcaaatgcaggtatactgtgaggagatagagttttgttttgttttgttttgttttgttttgtttttaattgaaataggtagtaagttctgagcattgtgatgagcagttctgtatgcagttggattctatttgtctcttttaattcagtccctggccggtactcagccttgttgtactttactttgttagctattgagagaggacaggcagccagcccggcatgttaacttcatcagccacctgagtgctgggattacaggtgtttgccactaggtttttccctgacagagcctagttaatactatcagaatagtatgctctataaataatgctttctggaagaatgtgtttatataacatgaattaaaagatggataatgtgcataaatgattacagtgtgacagtctaactgataacttgtctatcatccccagtattactggaccctgactagatcagacttgggggaattcaccttgaacactggcaggaaaattactcagttggattattttaaatttggcagtgatacgaagacagtctccttacctagagtaacaatcacaaagccgtgcgacaagggaaaggggagcaggaagttccttcacagagttctgtggacactgccctgtagctaacctgagctgcagcaactctgggagaaaaaggcttggtggtctggccatgagtggtagagaatgggctgctgaccctgaggcaggagggcagttaagttagctgtgagctgtgccacaccgtttcctcgctacttttgtagaagatggaattaagaacacttaagacactttcctgatgtatttactgctgtttttgttctcaaatataaaatgttcaaaaaatctacatttagatttgagtctgtatcttgcatgagttaggtttgggcgtttaacttttaaagtctctgaacaatttttgatctatagggcagtgctcttctatttttaaccttgcatttttttaagtgtttgtgcgtcagcatagcgtctgtttcctttttttaaggaattcaaaagtgattgtttgtaagtcctggctgaggagttcattgtttcttagggttgaaatggctgtattaaagggagtattgtcacatgaacagacatcctgattaacagtgttctaccatggcaggtgggggaggggtgctctgcataaatagctttttagtgtaataaatgtttcacaagtcttaagaccttgccatattaaatgccaaatgtaaattcaaagtagggccagaaaaaggaagattgatatctcaaatttaatatgctgtattctgaatactagatataatatggatagagttgaagttcagaagatttttgaattattgtgcaccaaataacaaagaattgttcaggggttgaattagctataaggccagcgaaataaccgtggtctggggtatggctcaggtggatgaatgcttgcctaacatgcatgaggctttgggttcaatccctggcacctcatgaactgggcatagtggcacatgcctgtcatctctgaatgtaatgttcaggagacagaggcaggaggattagaagttcaaagccatcctcagttatatagtaagttttgggtcagtctgagatacatgagggcctgtaccaagaacttgagactagcttcagtagttgtttgtataaagagtgtatgaaaacgaagcagaagcagagaaactctgagtgtggtggggtaggtcaggaggaggtcatctctggtggattagctcctctgcttgggttgaaattgtagggtcgtgtctgagtagtccatgtccagactgacttttggttatatatcagaagagacagtcaaatcaagctaccatcttattagtggccatttgttcatgtttgtaccttaaagccaaattctgcctgacttaaatacaggaaaggtcttttaaaataagtttgttactcagtatgaattgttcattgctttagattagaaacaaaacacacactctctctctttctctctctctctctctctctctctctctgtgtgtgtgtgtgtgtgtttaaaccagcatgggaatataggtagcttttaattttttcttaagtacgtaagcttctgccagttttcttggagtattttagtcgttcctcacacaccccaccctccctttttggcaaggctgcttttagcttccagccaaaataagaacaaatgaagtttcagtcaggttaggccacactacagtagtggccactgcggagcatttatttcgttcgccagcaccagaagctcctcttgtgagcagtgtgacaggaaggacagctgtgcattctgacagggcaccagttataaggtcatcattagactgtgcatttctagtgacttctggtgcctctaaccagcttagcagttacagctgcattctggattagtcatgtatgtaaacttgtatagtgacactgaaataggttgataacttgtatatgtttagaattcagagctaggtggggctgatggggatcctctgatcccgtctgccttgatggaagagcaccagggcaggaacaagtggccgtgctctcctgtgctccccactctgctgtctgacctgcgctgctcacctccccagagctcacacagcagcacggggaactggtgtggtcccgtgtgactgtgtggcatggaggtgcagggtgcctttcccggcactgccatcagctagtagcctaaattgaagagccccactttaaaaaatagccatatttttcttaaaacatactcagcacttctcttctgtctgaaacccacagcttttagcctgatgttgggtagcatttgaaaagaaatagttctgggtgtgatgttagattgtcagcctgaaataaacctgggtttggaggagcggtgggcacacacttgcaatgtggagcccagcccagagacactcagaggcctcatctagaatacacagctctctagcaagggcgggcagccagccgagcagcccactgtggccccgctgttgcttcctagacacacgctactttgagaagcctcaccttacaaatagatttgcagaacaggaagaagaatcttgaaagggagggtggtgatggtaccgataaatacctgtgttttaaaatcttgtacagccttctgttttaaaatcttttcttctggatgagactttagtctgtaactgaggatctctgtaactgaagacagacaataaaataccaacaagaaggaaattgttaaaagattttatgtatctaagatacttttactagtaacccactctagccttaggaggtataaactaaaggaacattaaataaaaccaaagaagtttttagctggaagcctggtcaaatatgcctgcaatcccagcactttgggcactttgggcactttgggcactttgggcactttgggcactttgggcactgagactaaaagctagaggactgtgaattcagggccggcctggatagctagctaggccctgtctcaaaagcaaaaacctcccacaataatatcctttgttctgtaatttttttcttcaaagtaaataagtattaagtactttaaattcagggatgtttgatagttaaatcagttcactatcttgatgataatatataccagtagattagatcaatccatgaattttagtttaaggttaaaaacttactgtgtgatcttttaaggtcaaatttaggtttctcagaatcaacttaaaatttttctaaatatactctaatttcactaaactttgtcctagtaaaagacttcttataaaattatgattgataatgtataggtttttactgcgatcagtggatttcccgtcactttatccatgttaataatgtaaacagagaaatgttcttacaagagactcaagttaacagatgttctcccttcttttaaagactttggactaatcgtgggtggaccctagagagatctgagttgtagaacgagtggttttttttcagacagtcttactgtgtgtctctgactggccttgagtcccggagacatgcctacttctgcatctgctgagactgaaggcccatgccaccatacgcaaggaaatggtttttgggttttttgttgttattgttgcttcctccagtacaagaaaatgtcctttccttccttatgcagaagaaaatagcctaggctcctttgtgcccatcccagctccctaaccctaacttagaagcgtgctctaaaaaaagatccaaggaggcaagactagagggtcatctgactcaggaactacttcaaataaaagcaagggctttttacaaccatgttctctctctctctctctctctctctctctctctctctctctctctctctgtgtgtgtgtgtgtgtgtgtgtgtgtgtgtgtgtgtgtgtgtgtgtggtgtgcggcgcgagtgtggagggcatagaggcgggagaacaaccgcctggattgaccgcagggccatcaagcttgtgtggcaaaagactttctcactgagtttgagactttttttttttttttttttttttttttttagcagttataaataaggcttttggcaattaagcgattttaaaaactatttaacttaccttactactttgtaagatttgttttctagttgtatgctttgttaacatgatctaaaggaaattaggaaatgtagttaattaaactggatgtcagacagatgggctgccgctgctgctatctctacaaggtaaatgaacaggcaggagaacttttgggatcctggtagcgatggcaacctggttcagttccctgtccttgcttttcttcactgaatgttccttgccaatgaggagttaagacagggcaagaagtcagttgattatattttacaattagtgttttgttttggttttttgagggtttttgttttgttttatttatttgtttgttttttgctaccaatttatgaagcaagtgaagctagcagtccattatataatccaaagccgtctctctggtaaaacatttaggggctttgtaagcctgagtatttgatctcttttaaaactaaaaataatagttttaatcattgtttatacaagactttaatatttttcctttttgttcctagatccaaattttgttcggacgtttcttacaacatacaggtccttttgcagacctcaagaactactgagtcttctgatagaaaggtctgtcggttttaaatgtttacgttctttgtttttaaaaggactaagatatgttccccataattgtgttaataagcttaactgttgaactcttgaaaataaaagctaactttgattttttttaaataatcaaaattttatattgctttagtacttaaaactcccaacttctcagggtctcagcagcactggggattgaaacgtgaacctttgttttaatctaagcagtattcccagcctgaattaatcaagttaaagaactctgtcagtatggatgacttagaacctcagctgggcacatgcctataatcagaacttgggagacagaggcaggaggatcagagctcaaggtcgtctttgactgtcataggaatttacggttcccctgaactatatggaactatgtctttaacataatgagacactagaaattcagattttaatggttcataagttctaaacaagttttcaagttactacatattgagtaaaatgaatcttgtcaatgagcaaatgcttttatcaaggaaaatatttttaatctacccaaagaacaatcaagtttcaagcattaatcatccttaaaattatgtctcctgatttaaagttatctacagactaaaaatggacattggcctcatttgttttaaattttacatatatttttattttgcttctagttttagctgttgacaaaactaaccttttaaaaatattaacttaaaaatattatcattagattagcctttacattataaaagtggatttttacttatgtgtctgtatatctatagtaatttttatattatctcttgattgtactgataaatataaatagaacatgaatttggatttgatataatattttcattattttttgtttcatgttagatttgaaattccagagcctgagccaacagaagctgatcgcatagctatagagaatggagatcagcccctgagtgcagagctgaagaggtttagaaaggaatatattcagcctgtgcagttgaggtaagcagtggagacacgtctgcagcctcaaacctgggtttcaaagtggggatgttcaaagcggggcagtggtggtgccatcccagcacttgggaggcagaggcaggccagtctgagttccaggccagccagggctacacagagaaaccctgtctcagaaactgaagccaggaaaacaaaagtggaaatgttcgagaaactgtccctaagcatggtggagggaagcggtgtgaatgagagtctcgtttgaattgctacagctttatgagaccgttgccttgtttcatgtgtgcactcaatgttagattctgtgttgtgtcgatgccacagggtgttaaatgtgtgtcggcactgggtggagcaccatttctatgactttgaaagagatgcagaccttttacagagaatggaggaatttattggaacagtaagaggtatgtttttcttaagttcctacttttacatgtgataaaattaccaatatggttactgccagttgataccattagagttcatttgaaaatattgaactttcttatcatacagcatttagactggatgtgtggtgcgtacctttattcccagcacacaaaaggcagaaggagtatgatttctatgagttttagtacagccaggactacagtagtaagaccctgtctcagaaacaaaacaacaaaacccagcattgacaactgtaaatcactcagcagccaccctgctgactccacacacttccatctgttctagaacatcctgctgaccccacacacttccatctgttctagaacatcctgctgaccccacacacttgcatctgttctagaacatcctgctgaccccacacacttgcatctgttctagaacatcctgctgaccccacacacttgcatctgttctagaacatcctgctgactccacacacttccatctgttctagaacatcctgctgactccacacacttgcatctgttttagaacatcctgctgaccccacacacgtccatctgttctagaacatcctgctgactccacacacttgcatctgttttagaactggttcttttagtctcaggttaagccagagccttaactgaaactgtggttacccttgatacaggctggaattcttttaccactgtaacaccattgataaaagtgcatggttagataagtagagcagatcaggaagaaatagtgtattacactgagagattgctttttaaacatcagcactaatcagaaacataattttgagtctttagactcattcaatttacttatgaaaaactaatgttgcttatctccaaggtttcctttactttcaaaaattctgtgattatatgactccaagtttgcctagacaaactttgtttttgcatctattgttcagtctaaatgaaaatcagaaaataaagggttaagtagattactttcctatacagtacaaaagacaggcatatcaaaaaatagactaatatgatcaatcagtcctcataattgggttataaaatacaatattaattagatttgtgaatatgaaacttattcttgttaatctttcatttcgtatggaatatggattgtgaaaatagtattttgaactaagcttcaaaatgttggaggtgaaaaaaaatcaagttactttaaaatatgtttaggaaaggtatagatacatgccaaactattgacaatgattacctgtgaggaacaaggatgagagggagatgggggaggggaacttttagtatttactttgctcatttgaactttatagcaatggtttattcatgtatcacttgtattactttaaacatttttttaaaaacaaagtgttaaagagtatttaaatgtttgttaaaatgtatttcaggtaaagcaatgaaaaaatgggtcgaatccatcactaagataatccaaaggaaaaaaattgcaagagacaatggcccaggtcataacattacatttcagagctcacctcccacagttgagtggcacataagcagacctgggcacatagagacttttgacttgctcaccttacacccaatagaaattgctcggcaactcactttacttgaatcagatctataccggtatgttattcaacattcaaactcagaagctatctcaagagttcattttaaaaatggaatacattatctgccttttagggctgtcgtaagatgtaaatgagacagcatatgatgtgtatacagcattaaggcattgcagtcagttctggttgttttgcccccttagtcatcttgatctgcttaaattaactttgtgctctttcagttacccctgcttgggaagctcggttcaaatcctggcagtcccagtggcttggccaaagcctgtactgtcttgtaggtttgaagagtctggtgtgtgcctgatgcatccaaggctgagcacaaagcagaacatagaaactactgcagcagttactccacagtacacgatagagcgactgctgtgttacagctaagcctcagccagttagaaccctttatagtttaaattgattaaactatctgaaaaatatgattctggtttgaaattttacttaaaatctcaaaattattattaatcaccaaatgagaaaaagagctaaatttataaattctcccatctccatttatcatggtccctgagtgaccatgttagataatgtctaaagtttattctcagaggcatttgcaggatggctttctcttctgtccactgtaagagcaagaacaagccaagaatgcgttagtaattgccctgtcctagttggctacttactagataccatttaagtaactacctcaccatcttaacttagtaaataatacctacaagtgctaggaaagacattatgcaaaagtatgcagtaaatgggaaaacgaccatgctgctctgcgcagtcgtgctagcgctcaggacactgaagcagaggactgccatgtgttccaggccagctgtgccagacagcaagaacctagccagggctacatagaagacactgtctttaaaaataaacaaatgagcagtaaatgtattatgcaagagtatctactaaaatagttctaatctgaaaacataaaaaagttataaatattgttttcaccaactttctgttgatgaaagagaacttaaaaatgtcgtttagtttttcttctgtagtaagctatatacgtgaggagaaatgtgacattgccattttatgttgatgattttagggctgtgcagccatcagaattagttggaagtgtgtggacaaaagaagataaagaaattaattctcccaaccttctgaagatgattcggcacaccactaacctcactttgtggtttgagaagtaagtgtgggcgtttcctcctggggcagaggcaggttttgaatccagcggggctgttttgcttctttagtgctctcattcccctttcttgtaaactcagtatctttctaatgtgcattttaatttcactggtactttggtttttaatggttgcctggcactaaccacatgcgtcttactttatcagtctaggctagagatggctgcagcttcttcccagcaggtagatgctcctcccatacgcggctctcattgctccctttctacatttgaacagacctaatcaatggtgcaaatccaacaatgcttcatgacaatgattactctgccgtctgctgtcaccattttatcttacagagcttttttccattcactcgtgtcctctgttgacagtgtgttacatttttatactacaaacccaaaagtacattcagataccttaaattagttgctttttaaacaaggtgagaggaaaaaatgggcatttatagtgtttgtataattctataattacctttactgatgttctttgtgtagactgacattgctgtctggggtccctggttttaagcctgaagagaacctcctgtggtccagtgggtcaactcacaacaagtgtgcagatttattgctgttttgaacagcagctctctcttgagattagttctgttttattctgtctgttcatatctattattgagcccccttgcctttcagtccatttgttttccatttggtgctgtttaaaattttaactctttcctcatctctttctagatgctgctattacacttctgtgcgccttaaccgggctgtcctttagctctgtgaccatactctctgatggcgactttgaaatacttcagttaattttcatctagtcactcaaacaggcagtttctgctccctgcttttattccactgtttaggtcataccttttatttctttatatgctttataatggatacagcaacttttcaatactgccctctgccttccacagctttctctttgctacttaaatgtgatgcggactaagcaggttagatgtggggatggatgcccatagttaggactttgggaagactggttccagtatggttcacattctctctcccaggctgcaccccgagctgctaaatgttgcactactaattcccgtcttcattcctttgtcgtgaacagttccctggtagcacaggttgctgtgaagaataagccaatgaaattctggcttcttggaagtaaagtttttaagctccttaataactgatatttgttctgacctgcaactatcttcctggttcacaccgttcctagctaacacacatttggggctacatatcttccttttatctccagatttctttccagttgcctttcataacaacttccactgttcctgaacacacctttgctctagatgtgacacaattctggagaggacatgactacaagctgtctttacattctaagagcttagagtcaaagtgccaagaatgatgctgtggcctcagggtctagcatggaaccctgtcaggagccaagcaaagagctattttcccagcgttctaattaccctacagcctcagcccataagtgggcaaggggagggctccgtacatcttaaatattaaggaaataaatattatagataaataaatatgaagactgcactcagtgaagccctaactcagcagggtaggaacccatccagatgtgcaccccaacccctcaaaatcccgggctgggattaggtgctcctgccccagggctcaaacaaatgctccggagggaggaagaggaggggacaggagcttagttgaaatactccagagtctcccttttaaagagattattttgtagattttcttgaacaatttttcgtttgtagcttgttcttagggtcacctccaaagactcatccgcattatgagttatggtgagtgggtgtggtttgctttaagatcactggagtccatcagccgagctgcaccgtctgataaagccgagacgtctgtgcgctttcataactggggagcggacaccttagctttgtatactggatattgttttctcagtgaagaagccagagtccacagattgtactgg

SEQ ID NO: 1338 - DNA, 4783 bp, Mus musculus
gtgtgttctagttgggtgcaaggtctagcctaaggcaatgcttgtctcccacctcatcctgccaaggaagcagcaccccgcgggcaccatgcaggcgcagcagctgccttacgagtttttcagcgaggagaacgcgcccaagtggcgggggctgctggtgcctgcgctgaaaaaggttcaggggcaagttcaccctactcttgagtctaatgatgatgctcttcagtatgttgaagaattaattttgcaattactaaatatgctatgccaagctcagccccggagtgcttcagatgtggaggaacgtgttcaaaagagttttcctcatccaattgataagtgggcaatagctgatgcccaatcagccattgaaaagaggaagagacgaaatcctttatcgctgccagcagaaagaattcatcatttattaagggaggtcctcggttataaaattgaccaccaggtttctgtttacatagtagcagtattagaatacatttctgcagatattttaaagctcgtggggaattatgtaagaaatatacggcattatgaaattacaaaacaagacattaaagtggcaatgtgtgctgataaggtattgatggatatgtttcatcaagatgtagaagatataaatatcttatctttaactgatgaagagccttccacctcaggagaacaaacttattatgatttggtaaaagcattcatggcagaaattcgacagtatataagagaattaaatctaattataaaagtttttcgagagccctttgtctctaattccaaattgttttcatctaatgatgtagaaaacatattcagtcgtatagtagatatacatgaacttagtgtaaagttactgggccatatagaagatactgtagaaatgacagatgaaggcagtccccacccattagtaggaagctgttttgaagacttagcagaagaactggcatttgacccgtatgagtcatatgctcgggatattttacgacccggattccatggccattttcttagtcagttatcaaagcctggggcagcactttatttgcagtccataggcgaaggcttcaaagaagctgtccagtacgtcctgccccggctgctgcttgcccctgtgtaccactgtctgcattactttgaacttctgaagcagttagaagaaaagagtgaagatcaagaagacaaggagtgtatgaagcaagcaataacagccctgcttaatgtccaaagtggcatggaaaaaatttgctccaaaagtcttgcaaaacgaagactaagtgagtctgcatgtcggttttacagccagcagatgaaggggaaacagctagccatcaagaagatgaacgagatccagaagaacattgatggctgggaggggaaggacattggacagtgttgcaatgagttcataatggaaggaactcttacacgtgtaggagccaaacacgagagacacatatttctcttcgatggcttaatgatttgctgtaaatcaaaccatgggcagccaagactccctggtgctagcagtgcagaataccggcttaaagaaaagttttttatgcgaaaggtacagattaatgataaagatgacaccagtgagtacaagcatgcttttgaaatcattctgaaagatggcaatagtgttatattttctgccaagtcagctgaagagaaaaacaactggatggcagcactgatctctttgcagtaccgcagcaccctggagaggatgctggacgtaacggtgctgcaggaggagaaggaggagcagatgaggctgcccagtgctgaagtgtacaggtttgcagaacctgactccgaggagaatattctattcgaagagaatgtgcagcccaaagctgggatccccattatcaaggcagggacagtgcttaagctcattgagaggcttacctaccacatgtacgcagatccaaattttgttcggacgtttcttacaacatacaggtccttttgcagacctcaagaactactgagtcttctgatagaaagatttgaaattccagagcctgagccaacagaagctgatcgcatagctatagagaatggagatcagcccctgagtgcagagctgaagaggtttagaaaggaatatattcagcctgtgcagttgagggtgttaaatgtgtgtcggcactgggtggagcaccatttctatgactttgaaagagatgcagaccttttacagagaatggaggaatttattggaacagtaagaggtaaagcaatgaaaaaatgggtcgaatccatcactaagataatccaaaggaaaaaaattgcaagagacaatggcccaggtcataacattacatttcagagctcacctcccacagttgagtggcacataagcagacctgggcacatagagacttttgacttgctcaccttacacccaatagaaattgctcggcaactcactttacttgaatcagatctataccgggctgtgcagccatcagaattagttggaagtgtgtggacaaaagaagataaagaaattaattctcccaaccttctgaagatgattcggcacaccactaacctcactttgtggtttgagaaatgtattgtagaaacagaaaacttagaagaaagagtagctgtagtaagtcggataattgagattctacaagtctttcaagagctgaacaacttcaatggtgtcctggaagttgtcagtgctatgaactcgtcacctgtttacagactagaccacacatttgagcaaataccaagcagacaaaagaaaattttagaagaagctcatgaattgagtgaagatcactataagaaatatttggcaaaactcaggtctattaatccaccgtgtgtgcctttctttggaatttatctcacaaatatcctgaagacagaagagggcaaccctgaggtcctgaggagacacgggaaagagcttattaacttcagcaagaggaggagagtggccgagatcacaggcgagatccagcagtaccagaaccagccctactgcttacgggtggagccggacatcaagaggttctttgaaaacttgaatccaatgggaaacagcatggagaaagaatttacagactatctgttcaacaaatccctagaaatagaaccccggcaccctaagcctcttccgagattcccaaaaaaatacagctatcccctaaaatctcctggtgttcgtccatcaaatccaagaccaggaaccatgagacatcccacacctctgcagcaggagccaagaaaaattagctacagtcggattcctgaaagtgagacggaaagcacagcatctgcaccaaactcccctcggaccccactgacgccgccccctgcatctggcacctccagcaacacagatgtttgcagcgtgttcgattctgaccactcggcaagcccttttcattcaagatctgcttcagtctcatctataagtttatccaagggcactgatgaagtgcctgtcccccctcctgtaccccctcgaagacgtccagagtctgccccagctgaatcctccccatccaagattatgtctaagcacttggacagccccccagctattcctcctaggcaacccacatccaaagcctattcaccacgctattcaatatcagatcggacctctatatcagatcctcctgaaagccctcccttgttaccaccacgggaacctgtgaggacacctgatgttttctcaagctcaccattacatctccaacctcctcctttgggcaaaaagagtgatcatggcaacgccttcttcccaaacagcccatccccttttacaccgccacccccccaaaccccctctcctcatggcacgagaaggcatctgccatcaccaccactgacacaggagatggacctccattccattgctgggcctcctgttcctccacgacaaagcacttctcaacttatccccaaactccctccaaaaacttacaaaagggagcacacacacccatccatgcatagagatggaccaccactgctggagaatgcccattcttcctgagttcctctaagctgggatagtttcctagcccccagatccattgctggcaatggatgcactgaacatgccagcactggggagttcaaatgagaactccaaacactaacgactctacttcacgatgtagtataagacaatgagttttaacctacatggaattatggaataaaatggtattccagcttagaatgtggaaactgattgcacctggaaatcacgtgaagggacttttctggccattgggcagagtcctcatattgtgaagtgatctttatcattaaagggatggaaaacagtctaatgtccaacaagcccatatgttgacagtttttgtaattcaaaatattatgcacttttaaaaaatcttaaacagggatctcctcctttgttttcctttgctttactcttctactttagaatattttcgtaaaagttattcagaggactgtgagaaaaggctgtggtacctgaccttgttgaaatcaaggcccagcactgtactacagtcctgtttacagattattacagtgatctgaatgggtaccgaggcttcaccaaaagaggtactttttgttattgttattgtttaagaataattatgccaatttaagaacatcccctacccacccccactcacaaacaaaatgtggtggtgttgcctttaaacaaaaaatgtcaatgtcattaacatgatggaagaagaacattttaaaacgtaactgtcaagtatcattt

SEQ ID NO: 1339 - DNA, 4011 bp, Mus musculus
atgcttgtctcccacctcatcctgccaaggaagcagcaccccgcgggcaccatgcaggcgcagcagctgccttacgagtttttcagcgaggagaacgcgcccaagtggcgggggctgctggtgcctgcgctgaaaaaggttcaggggcaagttcaccctactcttgagtctaatgatgatgctcttcagtatgttgaagaattaattttgcaattactaaatatgctatgccaagctcagccccggagtgcttcagatgtggaggaacgtgttcaaaagagttttcctcatccaattgataagtgggcaatagctgatgcccaatcagccattgaaaagaggaagagacgaaatcctttatcgctgccagcagaaagaattcatcatttattaagggaggtcctcggttataaaattgaccaccaggtttctgtttacatagtagcagtattagaatacatttctgcagatattttaaagctcgtggggaattatgtaagaaatatacggcattatgaaattacaaaacaagacattaaagtggcaatgtgtgctgataaggtattgatggatatgtttcatcaagatgtagaagatataaatatcttatctttaactgatgaagagccttccacctcaggagaacaaacttattatgatttggtaaaagcattcatggcagaaattcgacagtatataagagaattaaatctaattataaaagtttttcgagagccctttgtctctaattccaaattgttttcatctaatgatgtagaaaacatattcagtcgtatagtagatatacatgaacttagtgtaaagttactgggccatatagaagatactgtagaaatgacagatgaaggcagtccccacccattagtaggaagctgttttgaagacttagcagaagaactggcatttgacccgtatgagtcatatgctcgggatattttacgacccggattccatggccattttcttagtcagttatcaaagcctggggcagcactttatttgcagtccataggcgaaggcttcaaagaagctgtccagtacgtcctgccccggctgctgcttgcccctgtgtaccactgtctgcattactttgaacttctgaagcagttagaagaaaagagtgaagatcaagaagacaaggagtgtatgaagcaagcaataacagccctgcttaatgtccaaagtggcatggaaaaaatttgctccaaaagtcttgcaaaacgaagactaagtgagtctgcatgtcggttttacagccagcagatgaaggggaaacagctagccatcaagaagatgaacgagatccagaagaacattgatggctgggaggggaaggacattggacagtgttgcaatgagttcataatggaaggaactcttacacgtgtaggagccaaacacgagagacacatatttctcttcgatggcttaatgatttgctgtaaatcaaaccatgggcagccaagactccctggtgctagcagtgcagaataccggcttaaagaaaagttttttatgcgaaaggtacagattaatgataaagatgacaccagtgagtacaagcatgcttttgaaatcattctgaaagatggcaatagtgttatattttctgccaagtcagctgaagagaaaaacaactggatggcagcactgatctctttgcagtaccgcagcaccctggagaggatgctggacgtaacggtgctgcaggaggagaaggaggagcagatgaggctgcccagtgctgaagtgtacaggtttgcagaacctgactccgaggagaatattctattcgaagagaatgtgcagcccaaagctgggatccccattatcaaggcagggacagtgcttaagctcattgagaggcttacctaccacatgtacgcagatccaaattttgttcggacgtttcttacaacatacaggtccttttgcagacctcaagaactactgagtcttctgatagaaagatttgaaattccagagcctgagccaacagaagctgatcgcatagctatagagaatggagatcagcccctgagtgcagagctgaagaggtttagaaaggaatatattcagcctgtgcagttgagggtgttaaatgtgtgtcggcactgggtggagcaccatttctatgactttgaaagagatgcagaccttttacagagaatggaggaatttattggaacagtaagaggtaaagcaatgaaaaaatgggtcgaatccatcactaagataatccaaaggaaaaaaattgcaagagacaatggcccaggtcataacattacatttcagagctcacctcccacagttgagtggcacataagcagacctgggcacatagagacttttgacttgctcaccttacacccaatagaaattgctcggcaactcactttacttgaatcagatctataccgggctgtgcagccatcagaattagttggaagtgtgtggacaaaagaagataaagaaattaattctcccaaccttctgaagatgattcggcacaccactaacctcactttgtggtttgagaaatgtattgtagaaacagaaaacttagaagaaagagtagctgtagtaagtcggataattgagattctacaagtctttcaagagctgaacaacttcaatggtgtcctggaagttgtcagtgctatgaactcgtcacctgtttacagactagaccacacatttgagcaaataccaagcagacaaaagaaaattttagaagaagctcatgaattgagtgaagatcactataagaaatatttggcaaaactcaggtctattaatccaccgtgtgtgcctttctttggaatttatctcacaaatatcctgaagacagaagagggcaaccctgaggtcctgaggagacacgggaaagagcttattaacttcagcaagaggaggagagtggccgagatcacaggcgagatccagcagtaccagaaccagccctactgcttacgggtggagccggacatcaagaggttctttgaaaacttgaatccaatgggaaacagcatggagaaagaatttacagactatctgttcaacaaatccctagaaatagaaccccggcaccctaagcctcttccgagattcccaaaaaaatacagctatcccctaaaatctcctggtgttcgtccatcaaatccaagaccaggaaccatgagacatcccacacctctgcagcaggagccaagaaaaattagctacagtcggattcctgaaagtgagacggaaagcacagcatctgcaccaaactcccctcggaccccactgacgccgccccctgcatctggcacctccagcaacacagatgtttgcagcgtgttcgattctgaccactcggcaagcccttttcattcaagatctgcttcagtctcatctataagtttatccaagggcactgatgaagtgcctgtcccccctcctgtaccccctcgaagacgtccagagtctgccccagctgaatcctccccatccaagattatgtctaagcacttggacagccccccagctattcctcctaggcaacccacatccaaagcctattcaccacgctattcaatatcagatcggacctctatatcagatcctcctgaaagccctcccttgttaccaccacgggaacctgtgaggacacctgatgttttctcaagctcaccattacatctccaacctcctcctttgggcaaaaagagtgatcatggcaacgccttcttcccaaacagcccatccccttttacaccgccacccccccaaaccccctctcctcatggcacgagaaggcatctgccatcaccaccactgacacaggagatggacctccattccattgctgggcctcctgttcctccacgacaaagcacttctcaacttatccccaaactccctccaaaaacttacaaaagggagcacacacacccatccatgcatagagatggaccaccactgctggagaatgcccattcttcctga

SEQ ID NO: 1340 - DNA, 96592 bp, Homo sapiens
acctggctgtgatatcagtttataataatagcaggttctttagtttgtttgggtttttgttgttgttttggtctctgagtagcttcccaaatcacaggggccacgtactaattgctctttcccagaatgcctagatccttaacctttgcctatgtttttcttagatgctttttttttccctttttttttctttttgagacggaatctcactctgttgcccaggctggagtgcagtggcatgatctcagttcacttcaacctccgcctcctgggttcaagcagttctcttgcctcagcctcctgagtagttggaactacagtcacacaccacgatgcccggctaatttttgtatttttagtagagatggggtttcaccatgttggccaggctggtctcgaactcctgacctcagggtatccacctgccttggcctcccaaaatgctgggattataggcatgagccactgcacccagcctttcttagattcttgatcagtcattccagctgggacctcctggatccttctaaatactcagaaccaagcatgttggttatgttacaggccaacagtaaaaggttgtcttctgacatccaactttgtgctttggaatttagggatataaagatgctttttgcttctactttgcatgttagaattttgtggttggtagtgaacttttgaatatacttttatttttgaattctctccagaattacttggtaagttttctggaattaaagaaaaagcctagtgttaaatgttattttaaaagagttgatgcgacattgaggatttcaaggttctaccagcatttctaattgagagaatagtagtttcctctggaaggaaacttcctatgaaagtcatatagtgatggcatttattctaagagtggatatggtaggtgagaaccacagagttgaagggaatctggagggtcattctaggctactcagcttccagaaatcacatcaatggataacaccaaagaatcacactgttttttcaagtagagagtaaatgattatatatttgggtcaaaaaactgaagtttggttatcagtgaatatagtaatcacagaacaaaacaacactttgttgtgagttagtgatataaactaacacagtagtataaacctaccccagagagagggggtttgccctgtttggtttattattttgggttcagttggaagagaatagaatccattctagctaaacaaaaataaatttattttgggccaggtgtggtgactcatgcctgttgtcccagcactttgagaggctgaggcaggaggactgcttaaggccaggagttcgagaccagcctggatggcatggcgagaccctctgtctacaaaaacaaaaacaaaaaattagccgagtgtggtggcatatggctgttagtcctagctatctttttttttttttttttaaacgtagtcttgctctgttgccgaggctggagtgcagtggcacaatcttggctcactacaacctctgcctcccaggttcaagcaactctcctgcctcagcctcctgagtagctgggattacaggcatgtgccaccatgcccggctaatttattttgtatttttagtagagatagggttttgccatgttggccaggctggtctcaaactcctaacctcaagtgatccacccgccttggcctcccaaagtgctgggattacaggcgtggtgagctaccttgcctgaccagtcctagctatctgaaaggttgagatggggatcccttgagcccaagagttcaaggctgcagggagctatgattgcaccactgcactccagcctgggtaacagtgagaccctgtctaatgataataataatacattcattcagagaatacagaatcattggaaggctaatgaagtagattctggttgagctttcaggaacaagtcccaaagccacaccacagaaccaggccactaagagagtaatttcaaaacaattatgatccacagagaactgccacaccatgagtctagccattgctgctgccacataaaactagtgactgaatggtgcttgctaacagaaatatcagagttgcggcttccaactcacttctgccttctttttttttttttttttttttttttgagagggagtctcgctcttgtcacccaggctgggttgcagtggtgtgatctcggctcactgcaacctccacctcctgggttcaagctattctcctgcctcagcctcctgagtcgctgggattacaggcgcccatcaccacgcccggctaatttttgtacttttagtaggcagagtttcgccatgttggccaggctggtcttgaactcctaacctcaggtgatccatccacctcagcctcccaaagtgctgggattacaggcgtgagccaccgtgcctgggctcacttctgccttctatatctcactctagtgtatctgatagactgggagctatactgaacagattacgaatacgttcgttgttgacagctcaacttcattaactgtcaggaatttgaaggattctattgcgataacataaataacaaaaatttgaatgatgctttttttcagtcactagttttatgtggcagcagcaatggctagactcatggtgtggcagttctctgtggatcataattgttttgaaattactctcttagtggcctggttctgtgatgtggctttgggacttgttcctgaaagctcaaccagaatctacttcattagctttccaatgattctgtattctctgaacgaatgtattattattattattgttagacagggtctcactgttacccaggctggaatgcagtggtgcaatcatagctccctgcagccttgaactcttgggctcaagggatccccatctcaacctttcagatagcttttttttttttttttttttttgagacggagtcttgctcccccagactggagtgcagtggcacgatcttggctcactgcaagctccgcctccggggttcacaccattctcctgcctcagcctcccgagtagctgggactacaggcatctgccaccacgccaggctaattttttgtgttttcagtagagacagggtttcaccgtggccaggattgtctcgatctcctgactttgtgattcgaccgcctcggcctcccaaagtgctgggattacaggcgtgagccaccacgcccagcaatgctttgccctttcaccttgattataggagatggtgtttggaacagctacttcccccacgtacaatgactttccacctggtggtggtggcaatatttggatgacctcggtggcatcttcataccttggagaaccagaaaacactctttttgctcaatagcacgttgtatgtaacatataaacatacaatgccttttttgtggggagtggggaggcatacttttaaatcgatcttttggagtttcatacaaaattatagttcctcttgggaagaccttttaggtatgctgtctcttacagggggttgggcatgagcctcccataagggtcagaggacaaaggcctgtctgagggcctgcttcaacttctttcaggcaggtggctgtgagaggaccgagctggctatggcagcaacccatgaaagtgagtgataacaacatttattgtttcctgtggcgttgctttgctttgctattgactggtagcacttgtagctttaaataaattgaggaagtatgagagagtaaatggaagaaatgttgagtaagtccttcttgaaaatgttttcaagtgggagaatattagtggtaaatttctaactgtcttttaacattttaattgggcttggatcattcacattttccccaaatcctttctaaattaaaaaaaaggtaaaggccaggtgcagtggttcatgcctgtaacgggtgcagtggttcatgcagtggttcatgcagtcccagtacattggaaggccgaggcaggaggatcgcttaagaccaggagttcaagaccagcctgggcaacagaacaagacccccatctcttaaaaaaaaaaaaaaatacaaattacaaaataaattagctgggcttggtggtgcatacctgtagtcctagctacctgggaggctgaggcaggaggaccccttgagcctaggagttcaaggctgcagggagctagtatgatcacgctaccgcactccagcctgggtgacagagcgagaccctgtctcttaaaaaaaattaatttaaaaagggaagcaaaattacaatctgtcaaattattggctgggtgcagtggctctcgcctataatcccagcactttgggaggctgaagaaggcggatcacctgaggtcaggagttcgagaccagcctggccaacatgactaaaccccgtctctactaaaaatacaaaaaaattagccggtcttggtggtgtgtgcctgtaatcccagctactcgggaggctgaggcaggagaattgcttgaacctgggaggcagaggttgcagtgagccaagatcgcaccactgcactccagcctgggtgacagagtgggactctgtcccgaaaaaaaaaaaaaatatattagcatgatagttagcatatttcagtacaaatttgtgattaagctttttgttatgtatacatatgccctccctcttatagtatcagtgtgtttaatacttgcatttttttgttttatttttatttttttgagatggtctcccttttttgcccaggctggagtgcagtggcgcgatctcggctcactgcaacctcctccacctcccgggttcaagtgattctcctgcctcagcctcctgagtagctgggattacaggcacccaccactattcctggctaatttttgtatttttagtagagacggggtttcaccattttggccaggctggtctcaaactcctgacctcaggtgatctgcccgcctcagcctcccaaatgctgggattacaggcatgagccaccacgcccagcctaattttttattttttaacacttgaagcaaaagtttatagttagactggaaatttttcattaaaaataactcttaattagtgttttgaataagtgccatttttatgtggttgcaaattcaaaagtcacaataaggggtctagacaaagttggctgacacctataatcttactactttggtaggccaaggagggaggctctcttgagcccaggtgtttttagaccagtctgggcaacatagcaagacccccatctcaacaacaacaaaagtcacaaaaaggtacacggtgaaaaatctccctttcatctccagccacccagttttcatccctgtggcaacaaaaatctttgtagccttgctgatatggtttggctgtgtccccaccgaaatctcatcttgaattgtagttcctataatccccaagtgtcatgggagggacccggtaggatgtgattgaatcatgggggcgattactcccatgctgcagttctcatgatagtgagttctcacaaaatctgatggttttataagggccttttcccacttttgctcagcacttctccttgctgccgctatgtgaagaaggacatgtttgcttccccttccaccatgattgtaaagtttcctgaggcctccccagccctgtggaattgtgagttgtttaaacctctttcctttataaattacccagtattgggtatgtctttattggcagcatgcgaacagaccaatacggtaaatgcagagaaattatttgagtcaaatgcttatataataaaatgctgcattccttatatatatatatatatgaggaaccatacttgcagtactatacatcctgcacttttcattttgcagcatatcttagataatgttccacagaggcctggttattttaaaataactttataggttccactgtatggatttactattatttattgaactagtcccctattcctactgatgattatttaaactgtttatttctagggcgttttttgttttgctttacttctggtataataaacaacactgcaatgaataaccttgtctctaagtgacttcatataagagcaagtatatctacaggacatattcctagaatttgctaggtcaaagagaaactttgatattatctagttccccttgacagaagttgaaacaatttatagtcctaatacacttacaatatattagaatgcttgtttcctcatatcttcaccatcatagtgtgtaatcaaactttttcatctgtgctattctaataggtgaaaaatgataacagtataacccccaaaagagaattatctttttctccacatcctcaacagcatttgttattatctgtcttttggatataggccattttaactggggtgagatgatatcttattgtagttttgatctgcatttctctaatgatcaatgatgttgagcaccttgtcatatcccatttgccatttgtatgtcttcttttttctttttttgttttaaattttttaaaaagtttttttatagagatggggtctcattatgttgcccaggctcgtcttcaattcctgggctcaagggatcctcctgcctcggcctcccaaagtgctgggattacaggtgttgagccactgtgcctggcccctttgtttttcttattgaattttagccttttaatttgtaggagctcttttatattttactgaaattaactacaaaaatgaattgcaccagcttgggcaacatggtgagaccctgtctctaccaaaaatacaaaaaattagccgggcatggtgacacgtgcctgtgattccagctactcgggaggctgaagtgggaggatcacttgagcccaggaggcggaggttgcagtgacccaagatcatgccactgcactgcaatccagcctgagttagagtaagaccccatctcaaacaaacaaacaaacaaacaaaaaacccacaaaaatgagttgctgctattttttccagtttgtcattttccttttggcttatctggtgattttttttgcccttttttttttttttttttttttaaagagacagggtcttactgtgttgcccaggctggtcttcaactcctggcctcaagctatgcttctacctcggccactggagttgttgggattacaggcatgtaccaccatgcccggctcatacatttataaaaattgaatttatcggtcttttagatcttgtgtcatagtgaaagtgtctttttccgttctgaggttataaatgaatcattgtatggttttattgtttacatttaaatctttgacatatctggagtttttgctagtgtattgtatagggtatggatccaacattttttctagatagcccatttgtctgaatgagaaacttttttttttttgagacggagtcttgctcttgttgcccaggctagagtgcaatggcgtgatctagctcaccacaacctccacctcccgtgttcaagcgattctcctgactcagcctcccgtgtagctaagaattacaggcatgcgccaccttgcccagctagttttgttatttttagtagagagggggtttttccatgttggtcaggctggtctcaaactcccgacctcaggtgatccacccgcctcggcctcccaaagtgctggaattgcaggtgtgagccacctcgcccggccctgaatgggaaactttttactgctgtcattcttggactatcctccacatgcacgtggatcatatttctgtttgctcagcccagacatcagaactcagatgcctgtagagactaggcaagttacataaaagggtgaagagtgccaggtgggaagtatagccaactggaaatggatggcatatttttataaagagggcagccactacccggtgcctgctgattactctcttgcacgaatgcagtaggtcccagtgttgccagatctttgtcaagagaagctgaaaatatacatttttatatgaagcctcttgattttaaaatgttaacaattaaatttaaatacagccttagctaaacaaaatatgtcttcaggcctgacttggcccagaaaagccttctgatattcctagccaagaatgagatttctaacaagtttactctcctatgagtaaagagaacatacatggtctagtagtttgacagcacagtagtttatagctggagtctgggaacaggagagaaaagtaaggaccctctatataagccaaagtcttcgctctcacagactgaaacattaatgggagaaatacaagcattttaccatcccaccttttatcccaagtacatgtgaatggatatggccatttattagaggatgttcttgatttagtggatactttagtggattagaaaaataatcttattttccaactctgccattctgattttgcccaaatgaaaaagtggtgcatgttttggggagaataattgctcagctactgatgccggaactgaattgtagtactgacttattttttgtaccctgttcgtcttttccctttctcactgctggtggctagggacagggagtaaaatatcttctttacaacctgttaaaagtaatgtgctcagcctctttagtgggatgaaatttgtggtaatgagttaccagagcctatgcctctttggattgaaaagcttgtcaggatcttttctgggttgctaatgagtgtttcctagacgccgatccaggttttgtaggacctgaagcctacacaatttggatgacacgattaagaaaacaattcgaaaatatcttgaaagttttgtaaaaacgatatgattttgtgaacgcacaggggcccgtgcaagtgaaggacctttcaattcaagcttgatcaacgtcactgtcatctgccccttctgaccctaccaccaggctaagggctttccacgcctcatctctcggtccccacaccatcaccctaagaaatagttactgtatctcctaacgatatattatatatagtacctactttgtgtaaacatacggtactcatgaaaacaagccacgtagagcacaaatacgttaaatatcctgtccagcccgaatgcccctttctctccacgtccctatgcagcctcccacgacggtagtcctggggctccagcgctacaagagtggcaccgagtccggattgtcttaagcaggtcgagaggagggagcatatgggtaaaaagcagtcaaactgaagagtctggagcggcccccagcacagtctcgggaaaagcggactcccccggggccccaggccccgcacccccgcgccgggctggcgcctgtgcctgctccgcggcgcgcatgctccgtgttaggcctcttgggctattcgggataatgagcgccgggccgagggggcgggccgagcctcggctgctgggactcagggctcagcggcgaccccaaggcactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggtcagtgctaggggcggggcggccggcgggtggcccgtggccccccgagcttctaacggggagcaggtcgtccctcccacagggctcgagtccccggggccgagccgtttctcgttggctggcaatggggggctcacaattgcctgttgcattctgaaggacgtttctcaagttttttttttttgcctggtcccggaaggaaggttttgttatgatcataaaactggatttcatgttgcagtcatttcgtcaggcaacttccgccgttgaccaatttgttgtcctcaggctggaatcgggcaagagaaagtcccgctggtatttagacagtttctaaaacaaaagcacattttcaggccgggtaattacttttaattaagttctttgggagtgttccccctaggcggtttgcttgtcaagggtatccacttatgaggcaatggttttttgtaatatggatgtttcacatgtgtgaaatgtcagtgagtcataatattcttattcattttacagttctcaaggtaaatttaaagcgccttcccacttcctgcaaacggtgtcttacctgtttacaagagattacccttagaaaatttggtcagtgtcttcagtgtcttcacgaccaaattgcgatttaggacttgaaatcattttaaggaacaagaaaggggcaactcctgcaaatcagtctttcatgtttgggtgcattgctagggtgcatctttcctgtagatggtggcggtcttcctctgtgaatttaggtagtaaccatacgatcatttttataataaatccttctgtaagatcaagacatttaaagactgtgaataggtgcgtgatcagctgtcatgcctgttgagcaggggctttctttctttgccgttaatgcagacttagtctcttctgccttttgtgcaaaataaccaagaatacattctaaaataaggaaaaaataaagattaatttaaaagactatacttggaaaatatatcctcagacattaaatttctataaatgaaaggaagtagtgtattttaaagttaaagacattttcctcatgcgatgagagttgcagattttcccttattttcataattcttacaaggaagtattgctttcctcagggcaaacactaagtcgtatctttttaaagaacctggcagaaatgactagtggcagctagacagttattccattggtataccaagtgctaaagtattaaattgaccttacttccatgtgcagcccaattctgtaaggagagggaaagaaatgaaaagtgtgctgagtggtgaaaatgaactctggcctgaattaaaagcaaagggggaaatgcctagatagtaattagccctttgaccacagacaagtgtgagtgcagtaatcaggtaggcctatattgttggcaatgtgacgcaggtatatacccatttataactttctggtagcaaatagtatttgggtgtgtgttgcataacttgttcaataggtagctttgattctaataatcctttatgtccagaaacagatttatgttttctttttcttcaaatagagacagggttatgctatgttgcccaggctggtcttgaacttctggcctcaagcagtccgcccacctctgccttccaaactgttgggattacaggcataaaccacctcgcaccagacccagatttttttttttttttttcaagttaggctggagaagccaagattagcatccaatcctagtccattgctttggtgctattactttgcatttatattgtgcttgttttcctggaactcaggtgccttgtagatactatgttatattccacagttctagtatgttctttatgaaataaatacatctaagaaaatttggtcttttgaggtgaattcagaaaacattttctattaacttactgttgtgatagaattgaaatacatacgtatggaaaatttttttatatttttggaaaaattttggtaaaagtaattaagattatgtccacttttatggtatttaggacattgcaacttgtaggtctgtagtgcctgctaagagctgtagctcttagggagctaaaggttcactctttctttgcaggaagttttaaattctggtatgcatcagccaccttgtctttgtaaaatgagaatttctaccattttgggggagtctctgtcttcacattcagagcatctagaacttggcatccttcctctagctgaccagatcgttacaaagacaactaggatttgattggaatatctctctccttcaattggtgttgccattgtacatgtggtgtattctagcttcattaattcacttaaccattattgaacacattttacatacttgacatgatgcgggatcctaagagtacaaagttaaaataaaggcccctccaaagatgtataccatctaaaccaaaaattctaaaatttgaggttttggtttatgtaaatgagagcggttctgagctcagagttcagtaaggggtatttgtgtgtctatgaaagcagcaatgtagcttacttggctctgtcagtttagtccacttggacatcttggtggaacctccaaaactgttagaacgtaattttcagaaaggtaaagtcatcacttccatgcaaatgtaaatgaacatgtatcaattattttgattcagcccattgatgagggaactagtaagatgttaaagtcacttaatatgaaaatttgaggaggtatttataggcaatttaataagggaatattaagactgttgggttacatacagaattagttaataccctacaagaaacataaaagagtaggctttgggttatattttcctctggctaaaaattacttgcatctcagtgggcgtggtggctcacacctgtaatccagcactctgggaggctgaggctggtggatcaactgagtttaggagttcgtgaccagcctggccagcatggtgaaaccccgtctctactaaaaaataccaaaaattagctgggtgtggtggtgtgtgcctgtaatcccagctgctcaggaggctgaggcaggagaatcacttgaacctgctaggcagaggttgcagtgagccgagatcacaccactgcactccatcctgggcgacagagcgagactccatctcaaaaaaaaaaaaaaaattacttgcatctctatctgctgaaaagctgtaacttaatcttatagatgtgtaaaatagtcagtagaaattaataaaagattcaagcatagcactgtactgaaacacagccagtattcttttgcttattttccagttttggctagtttttatgaaaactggatatctatgtctatatccatgtatatatccatatatacccatatatagatccatatatatatgtatttgacaaagtcaccattgtcaacattgaaaattcaagggatttttaaaaaaccaatctcaagtattcattgcattacatagaaacacagagatgggctgggcgcagtggctcatgcctgtaatcccatttgggaggccaaggcgggcagattacctgaggtcaggagatcgagaccatgctggctaacacggtgaaaccccatctctactaaaaatacagaaaaaaacccaaaaaattagccgggcgtggtggcggacgcctgtagtcccagctactcgggaggctgaggcaggagaatggtatgaacccagaaggtggagcttgcagttgagccgagatcgcgccactgcactccagcatgggcgatggagtaagactctgtctcaaaaaaaaaaaataccaaaattagccaagtgtggtggtgcatgcctgtgatcccagctactcgggaggctgaggcagagaatctcttgaacatgggaggcagaggttagagtgggctgagatcgcaccactgcactccagcctgggcgacagagcgagactctgtctcaaaaaaaaaaaaaaaaaaaagaaagaaagaaaaagaaacacagagatagacaaataggtttatggaaaaataattttgggaatagaaatgtggtgttctttagctttttgcttgttcttaaacttttaaaatagaacctcacctagatcatttaaaaacagagagctacaaagcagagtgaaatgacactactaatggataatgcatggattgttaacattactgctaaattatgtatcttccctaaaagagcctagaacataattgccttcaccactgctccccaagatcattgaagctattgtgttacttggggaaaaaagagcatggtgtatatttgtaaatgcagtttattacctgtgtcgttgaaatcccttggtactatatgcatgtgttatttgattatatgttgagataaatcagcattcttcatatgggaaatatgcctcaaaatcattttatcagattttacagtccctgatatttattttgtagatgtcttttctgtaaggtgtttttcaccaggctagccatagaaaagaacatggctgttttcttgccagctgtagttaaaaatgtcagagaaagctagaaagaattggttgaattactttgttcctgagtccaattagattcaggttaaatatcgacctccccaccctgtgacaatttgctcttagatatctaaaaggcaagaggtgtgagagaatgtctgggttaattaatagcagtctacggcaaggaaaaagatcggtaggggctttgatttaaaaatggttttgtgaagttctactgagatcctagtgtttctgcgtttgtacaaatgtctcttggaagtttgttttagaagatggcactggatctttcctgaggcccacaagaaaagtacagggtgatctgagaaaatataactggtgtcattgatatatgagagtcaaagaagactttaagcaagcaacatttgtgcttctttctggattatatattcaaatatagtaatattactgtctccaggctggtcttgaactcctgggctcaagcgatcctcccaccttggcctccaaaaatgctgggattacaggtgtaagctacgtcgcctggctgcagacactgttcttgatacggaagatgtagcagagcccctgctgttataaagcttgtgttctaagtggctgtggcagagagacagacaataaggaagtaaacaattatctgaaagatcagtagaattaacaagaaaaaaaaagggcgggggggaaggatttgaggctgaggggaaagtaagaacatgatttgtttgtttgtttgttttgaataggtctcagattctgaatttaatgacttattttaaaaaacaagaagaataagtggatgaagctagtatggtagactgtaggtacactgagttaaggtctctgcctgagaataggaagtcctgttgggttctcatttacatagcaaagtaattagattaacttgatcagaattgctttttgaaaagattacttcaagtcaaagccaaaaactaataagagatcctgtgatttttgtgacatgagcctgttctggaattcctaaagccgctgaatgtaacagtagaactcgagggagtcatttggaattattccaaactaataatgacccaaactgacccgaagagttcagccagaactagatgagcggtaggaatgtactttaacttgctgtacttggctccctgtcagcaatgattaagtagccttctatttttggtttaattttggtatggtatatttggagcaataatattccattaaagtgttttatgctgagtattcaaagcattacctgtgttaccccttgacataaatcaactatatgtcttttgtattaaccatggactctctttcaagggaacagtaatttgattatatcctgcatatttgaatcaaaaggaattttaatgtaactagtggatttagcattatctcatgttaaaaattaacaaccaaaaattattttcttccatgggccaggtgcagtagctcatgcctgtaatcctagtactttgggaggctgagatgggaggattgcttgaggccaggagttcaagaccaacctggccaacatagcgagaccccaatgtccataaaaaattattttcttcttttacataagaatatatgctagtacaaagttttttcaaatggataaagtattacacattcacattttaacatgtagaagtgaagcaacaagatgaaaataataccaagatctagatataaggactagtattagctcttctaagtaaagttttctgtactccagttttcttcctcattaggtcattttgtaaactcaaacactatttctctctctctctccttttttttttttttttttttttgacagggttttgctctgctacgcaggctggagtacagtggcatgatcatagctcactgcagcctccaactcctgggctcaaatgatcctcccactatagcctcctgagtagctgggactacaggcatgtgccactacacccagctaattttcttatttttttgtggagacaaggtcttgctatgtcctctggctggtctcaaattcctggactcaagtgatcctccagccttggcctcccaaagttctgggattacaggagtgagccacctgcctgccaaaaactacttcttacatacaaagtatattatagttctttcttaactgacctattagcagcatttgacagttgatctcttctttttttgaaatcctttcttcatttggcttccagaagaatatcaagctttcagggattttttttctctgaatattccttctagtttcccttcccttgattcctcctcatctttctgtgaccacatccttctgacctccccagagcccatttatatatatgtgtgtgtgtgtgtgtgtgtgtgtgtgtgtgtgtgtgtgtgtgtatatatatttttttttttttcctgagacggagtcttgctctgtcacccaggctggagtgcagtggtgcgatcttggctcactgcaacctctgcctcccaggctcaaccagttctcctgtctcagcctcccgagtagctgggattacaggcgcgcaccaccacgtctggttaatttttttttttttatatttttagtagaaatggggtttcaccatgttggccaggctggccttgaactcctgaccttgtgatctgcccgcctcggccccccaagtgttgggattacaggcgtgagccactgcgcctggccaatttttagacttctatttctattaacacatcctcctttggagatgccatcctgcctcattgcttcacgtataatctaaatctgataattaccaaatttacatttctggctcagacctctttcttaaacatgaatgttcaactctttttttgagacagggtcgcactctgtcacccaggatggagtgcagtggcaagatcacagctcactatagccttaacctcctgggctcaatgatcctcccacctcacccccctgccgcccccatatagctgggactacaggtgtgtgccaccacacccagctaattttttgtttgtttgtttgttttagatggagtctcgcttttttgccaggctggggtgtagtggtgcaatcttggctcactgcaacctccacctctcaggttcaagtgattctcctgcctcagcctcccgagtagctgggactacaggcgtgtgccaccacgcccaggtaatttttttgtatttttagtagagacggggtttcaccatgttggccaggatggtctcaatctgttgacctcgtcacctgcccgccccggcctcccaaagtactgggattacagggatgagccaccacgcccagccccaatttttaaaaaactttttgtagagacagggtcttactgtgttgcataaactggtctccaactcctgggcccaagcattcctcctgcctcagcctccaaagtgtttgagttacaggcatgaagcaccacacccggccaactttttacttgatatttccacagaggcatctcaaccaacactgtatccttttcttcccctgcaaacttgtttcttttgtagtggttaacatatcaataaatggctactccatccttccggttgctcaaactaaaaatcttaagttattcttgaatattgtctttttttataccacacatctaatttgtcagcacatccttttagctctacctcaaactatatatttagttaccgttttatactttttgacttttaccacctggaaccaagtcatcatcaccaatctcctggaatattgaaatatcttttcaactggtctctgatcatctgctcttgtcctatttagtttctttttctccccaaacacaaagagataagtgagatcatttcactcctttgttcaaaaccctctcagtgcttctcagaataaaagtcaaaaaagtcctcccaaaggtttactaggtcctctgcagtctagggctgccccacctcccgcttttacctctctgacctctttaatattgtcccttgtttgttctgcttctgccccatactggctttcttgtttctataacgtagacatgttttagtcttaggacttttgtacttgctgaattttctacctgaaacacccttccctcagataatcacgtggctggcccttttacctcctttaggtctttatagtcagacatcattttcttggagagattttctcttacagcctatctaaaactgctacatcctcctgcttcccagacagtcccacatcagtgttcacagtattttttcccataaacctgtatctccaatataaatgatgtatccagttctcaagccagaaacctagtcatcattcttcccctctttctcatgccaggctaacatgtattcatcactgaatctacttgattctttctcctaaattaggagttttctaactttttttgctgtgtatccccaaaagaattttgaaaaacttgcacatttttatgctgacatctagaaattttcattttacatttaaatagttgcagtagatgtaatttcatatgtgttataaatactgatgttttaaggtaaaacagttgcatcagtcttttaaatgtgctgaatggaatttaaataccaaaataatttgatatccaccatcattttttaaaaatacacatgaaaagtgtgtctttaaaagttggaaattttacattgtcctttttttctctgtgaacttttttcattatatttcccctgcataattctaatatgatatttttagatttaagtctttaatcgcacttttttatttatactccttacaacaacaaaaaagtctacatattgaatttaaaaggattttccctacaaccgtaaagctttaaaacctgtcttttgaactgaattattattattattattattaaagtctcattctgtcacccaggctggagtacagtggcatgatcatggctcactgcagcttcaacctcccaggctcaagcgatcctcccatttcagcctcctgagtagctaggactgcaggcacatgccaccacacttggctaattttttaaaaatcttaaagatgctttctttttattttcatgggcctgtcccctcaggaggatgtatttttccactaggctagaggatggaagaggcaagatacttaaatgaaaatatttgtaattatctctttgtttagtgtctaggatttatttattgcacttcagagcaacatgtatcctatagagaatttcaagataagtgagagatctgcctttcttagtaaaatgagagggcaactgtgaaaacaggtataaaaggagaccctgctttactcactgtgtgcaggcaccttgtcaggcagatcttctttaggaaagagtacatatggctgtttagaaagtgtcctgacagacgtgggtgtttggcctgggaatttattaaacataagtgaatgaaacaaatttaatagcgatcttttcccagttcacaggggaaaaaaagcaattattttttcaattttatttttcttccataaattagaaaaaaaaatctttgttgtctgctgcaatttacttgctagtgagtagtgaaagattgtaaaataaatgagcgaatgatcatggaggttttaaagggaaaatggcttttaatactttttggtttttttcttagaaacatgttcctgtagtttgattttaagttttaaagtcattactagcattgtccctgctgtgatagaatatgagtcttaaaatttcacgttctgcaaagaacactgatttccaaatgatctgccactggaacaaattgggaaccatttttctagcctgtactgtcttgggtttacaagcaaatgacctgcctttatgggaaggtgcttctgggtcataggccattcaaagaaaactttgatgacaaaaatttttgcttcagctaatcttttttacatatttgattatattatggtaagctctcacctaatattaagtagaaatagcttcttggcctgtacttatctgcattttaaataaacttacattgtgaaagcctgctgaaagtacctaattaagagcatggactctgagaattattaatggacagtgggaggaatagagaaacgtaagagagggaattccttcatttataatgttgtatgagaaccaggtctccagatacatttccagtgaaatgaaaacaaattttatggagtttaaaattttttccagtatccagataatttcagtgaggccaagagatctgtttgctgctgtgaatctatttaacaagtatttactgagtgctttctttatgcagggtctgttctttttttttttttttttgagatggagtctcgctctgtcgcccaggctggagtgcagtggtgctatcttggctcactgcaagctctgcctcccgggttcacgccattctccttcctcagccaccctagtagctgggactacaggcgcccgccaccacgcccagctaagtttttttttttgtatttttagtagagatggggtttcaccatgttagccaggatggtctcgatctcctgacctcgtgatctgcccgcttcggcctcccaaagtgctgggattacaggcgtgagccaccgcgcctggcccaatgcagggtctgttcttttaatgacatactagattacctgtatgctaagcatacaggtgtagggaaataggaggaggagaccgaaaacaagaaatgggagctggtgtggtagtgcccacctgtagtcccagtcacaagggaggctgaggtggaaggatcacttgagcccaggagttcgaggcttaacagtgagtggtgatcacaccactgcactccagcctgggtgacagagcaagattctgtctccacacctctcccctgccccccaaaaaacaaacgagaaatggttcctgatcttaatgagtttagagtatgcagctgtggtttcaatttttaattatacactttgattagaaaaatgttgccttagaatattatattttagaattattttttaaaaccttattgggatgtaattgatataaagtatatatttacagtacatatatttacaatgtacaatttgatgttttcaacaatgtgataagttatatatacacagtaaaaccatcccagtaaagctagtagacatatccttcagccccataaatttcctcttgactgtaattctccctcctatttctccccactctcaggagacatcccaagccatcactaatctgttttctgtcattatcgattgcattttctagagttttatattaatactgatagaatcatacagtacatactcttttttttcaatctggctttcagcatgattattttagattcatttatgttgcatatatcaatagttcattcctttttattgctcagtagtgtattccattgtgtagatatactgtggcttgtttatccattcacttatttatgtacatttagtttttcagatcttggctattcaaataaagctgctatgtatatttgtgtacaagtctttgtatgaagatatgtttcaatacaaagaatggaaattgctggtaattaccaaagagtggttggatcggatagtaggtggatgcttaacttttttttttttttgagacgaaatcttgctctgttgccaggctggagagcagtggtgtaatcctgactcacagcaacctccgcttcccgggttcaagtgattctcctgcctcagcctcctgagaagctgagattacaggcacgccccaccacgcccggctaatttttctatttttagtagagacagggtttcactgtattggccaggatggtctcgatctcttgacctcatgatccactcgtctcggcctcccaacgtgctgggattatagccatgagccaccacgcctggctgcttaactttttaagaaactttcaaactgttttctaaagtggttgtatagttttacattcccaccagcaatataagagatcctgttcctcccgccaatacttggtaatttaattttagccattctaatagcagtgtaatggtactttgtggttttagtttgcatttccctagtgattaatgatgttcaacatctttcatgtttttatttgccttccatatatcttctttggtgaagtgtttgttcagatctttggcccatttttgttgagttgttttgtttttttgtttttgtttttgtttttttttggggggatggagtcttgctctgtcgcccaggctggagtgcagtggcacaatctcagctcactgcaccctccgccttccgggttcgagcgattctttcacctcagcctcccaagtagctgggattgcaggcacccaccatcatgccctgctaatttttgtatttttagtagagacaggattttgccatgttgcccaggctgatctcaaactcttggcctcaaggaatccacccaccttggcctcccaaagtgctgggattacaggcatgagccatctcactcggccttttttttttttttttttttttccttttatcgaagtttcattatataccattctcttaatactatctttttatctttttctttctttctttttttttttttgtttttaagagatagggtcttgctgtgttgcctaggctggtcttaagctcctggcctcaaatgatcatcctgcctcagcctcccaaagttctgggactacaggcataagccactgcacctggcctatactatcttttggagaccaaaagttttttttgtttgtttgtttttgtttttgtttttttgagacagagtctcgctctgtcgcccaggctggagtgcagtggcacgatctcgattcactgcaagctctgcctccgggttcacaccattctcctgcctcagcctcccgagtagctgggactacaggcgcccgccaccacgcccagctaattttttgtatttttagtacagacggggtttcaccatgttagccaggatggtcttgatctcctgacctcgtgatccaccggcctcggcctcccaaagtgctgggattacaggcgtgagccaccgcacccggccaaaagttttaaatttttatcaatttgtttttttagggactgtgccattagtgtcatatctaggaaatctttgcctaacccagggttacaaaaattttcccttctagaaattttttatttatttattttaattttcaaaaatagagacagggtctcactatgttgcccaggctggtctcgaactcctgatctaaagtgatcctttgtccttggcctcccaaagttttgcaattataggtgtgatccaccatacctagcctgttctagaaattttatagtttaaattttatatttatatctatgactcatttgaatcactttttcttttttaaaaaaatctcaccttgtcttatggtgctgattgaatcattttatatatggtgtgataattctgtatatggtatgtttgtttttttgtatatggatatctggttgttctgtcaccatttattgaaaaggctgtccttttcctttgctaaaggtcttcatgcttttatttaaaaaatcagttgcccatatatgtgtggttttatttctggattctctattctgttctattgattgttttccttatctttatgtcagtgccgtactgttttggttaccatagctttatagaaatccttgaaatcaggtagtgttagcccttcaactttgttcttctttagagttgtttcagttattctaggacctttgtatttccatgagaatgttttaatcaacatatcaatttctacaaaaaagcttgctggaattttgattgagattgtgttgcatctacagatcatttgggaggaattgacatcagaacaatgttgagtcttccaactcatagtttaatctcttcatttatttaagtctttaattcctatcagcagtatattgtatttttatttttatttttatttattcatgtttattgtattttgtttttattttttgagattgagtctcactctgtcacccaggctggagtgcagcagcacgatctcagctcactgcaacctctgcctcccgggttccagcgattctcctgcctcagcctccagagtagctgcccagctaatttttgtacttttagtacagacggggtttcaccatgttggccagcctggtctcaaactcctgacctcaggtaatctacctgccttggcctcccaaagtgctgggattacaggtgtgagcaaccttgctctgccagtattttgtagttttagtatatatacttcaactaaaatttttattttctttttaaattgaattttaatatttcataatgggctgggtgtcgtggctcacgtccataatcccaacactttgggaggctgaggcaggcagattacctgagctcaggagttcaagactagcctggccaacatgatgaaaccctgtctctactgaaaataccaaaattagctgggcgtgatggtgcacacctgtagtcccagctacttgggaggctgaggcaggtggatctcttgaatctgggaggtggaggttgcagtgagccaagattgctgccactgcactccagcctgggtgaaacagcgagactccatctcaaaaaaaaaaaacaaaaaaaacccaaaacatttaataatgaaaacattgccagtattcttaattgatgtttgagatatttgcatccttgtggaaatcttggcagcacaatgaagaatttggcaaaaataaatatcagtcagactctatatccaaaaggatttatttccacattgtacctgaaactcaaatgttaattactgaacaagtgcattagcaagatttttaatttaaatgtgaagatggaaaactgaaaaatataaattaggaaataacatttctataacttgtcaaatgtagtggtttatcagggtaaaaagttaaagtgcttttgtgtgtgtctacacatggatttatagtatgagactattttgttttttgtttttttttattatactttaagttttagggtacatgtgcacattgtgcaggttagttacatatgtatacatgtgccatgctggtgcgctgcacccactaacaattctatttatagtgttacagtaaggaaatgccttctggcaatttgaaaatatggtgtaactaaaatacaggtctgacttgttaatctactgttaaagactggaaattattttaattgctctttttctgactaggctttcaaaaaatatgataggcaaattggttctgtcgtggtaattttatgtttactgtctctgtagaagtgtaaagcatggttctcttccattgtcctcttgatgtcctgttacagcatttatgggtgagattttaacattgtgtgtttatttttatgactgttttcatatttgaaattaagaagtttggcataagaaactttgatgcttgatgttcaaattgctttgtagcttatttaacaaaatcataatcacagaaaaagaatccatcccagttagacattatcttaattctcatgttcaatcattttcactgagtggggcccttggctttttatggaaagatgttataagaaacaaccttgccgggcgcggtggctcacgcctgtaatcccagcactttgggaggacgaggcgggcagatcacgaggtcaggagatcaaaaccatcctagataacacagtgaaaccccgtctctactaaaaaatacaaaaaattagccgggcatggccgtgggcacctatagtcccagctactcgggaggccgaggcaggagaatggcgtgaacccgggtggcgaagcttgcagtgagctgagatcgcgccactgcactccatcctgggggacagaacaagactccgtctcaaaaaaaaaaaaaaagaaagaaagaaacaaccttgcctcagggaggggggcctgaggaggcaggaggattgtttgagccaaggagttggtgaccagctcgagcaatttaggtaggcctcatctttaaaagaaaaagaaaaaaaaaaaaaaaaagaaacggccttatgaagtctactgccacacttacaatgtaaatgtttatttatttatttaaagatggagtctcattatgtttggaagcctgaaactcctcggcccaaggaatcctcccacctcagccactagagtagctgggactacaggcaccccactacgcctagttaaatgtctacttttttaaaaatgtcttttaaaagtcgattgatctattagaaatgtatggctaaaatgtaattaagttatctctggctgtgttaaagaagtgcagggtataagaggaaatatttatttctccaaaacctaatttgaatttattagaaaatatgttagaaacatatttctaacatagaaatacattagaaagcctgattttttttttttattattggtcctatatgaatttctaattgccttactgctagactttttggaccagacttcttcaaagagtagtctttccttactatggccttccacttccccattccccaattcaaaattatttttctttatcaattagtttgtattttgtcaaaattatttatgtaaataaaaagataattcgctctgcaaagcttgttatgaaaaatagcattacttcccccttaaacacaaaattttctgtttcctagagaaaaccattttaacttttcaaagtgatttatttacttctatatttctaagaaagaaaaagtgcttatattgctatttcatgtttttttctgttttggatgttatctgttgacttcctaccacggagggtaaggatttaatattctcttttttctctttttttttttttttcttggcagggactcactctgttgcccagactggagtgcagtggcacaaaggatttaatattctttaatatgcacatacattcccctccaaccacacacacactttccactttctcttcccccacttcaaagttatatcttaatttgagttggattaatattcaaagtttacattattatgactgtaaatgctatttttggggtttttttttggggtgggggggacagggtctcactctgtcggccaggctggagtgcagtggcacaatctccactcacctcaacctccacctccagggttcaagctgagattacaggcacgcaccaccaggcccagctaatttttgtatttttagtagagacggggtttcactgtgtaggccaggctggtcttgaactcctggcctcaagtgatccacccccaccttggcctcccaaagtgctgagatcataggcatgaaccaccacacccagcctataaatgctatttaatctgctttttcttttctaactcactgcttttactggagttattaattatcttgttttcttgtttgtgtgtttttctatgtagtacacttattaccaaattcaaactttttaccagttttctaaatatcctatcaagattttcatcccattgcatactctgtcaagtttgttttcttgagacagtctctcccagagccttctgacctgcaccagtgtggactggtcacctttattcctgttttacagctctcatcctataatttcctttcattttatcctgggcattcctttgacctttcttctctattgattcctttattttctttattccatatttttctttcttgattcatacccttgttttagtgtagtacaaatgacagaaggttaatgagaaagactacgtgagagataaagttttggaccttattctatctaagaatgtcacgttagcatggcatttgatattgctggtatcttggattccaggctgaacatcattaccatctagcttctagtattactgttgaaatctgaagctaatgtctgcttctcatatataatctactcctcctcacttccctgtcctcccagtcttgtaggatattctctttgtctccagggtcctgacattaaaattttgttcagtgacatgggcactagaaaagccctttagacttattttattgataatttcccccctcaatttcctctgtttgctagatgattctcaaacttttgaaaacctcatttatggtgaagtgtaacatataatcagaaaatgtgtaaaggataaatatacagtttaaggaacacctatttaacactcaggtaagaagacagaacattgtcagcacttttctcaggataactctccaaaaggtaaccgtttttgtggtattcactgttttgattttctttctttttgagacggagtctcgctatgttgccaggctggagtgcagtggcatgatctttgctcactgcaacctccgcctcctgggttcaagcgattctcctgcctcagcctcccgagtagctgggactacaggtgtgcaccaccatgaccagttaatttttgtatttttagtagagacggggtttcaccgtgttggccaggatggtctcgatctcttgaccttgtgatccgcctgccttggcctcccaaagtgctgggattataggcgcgagccaccgcgcctggcctgttttgattttcttaatagtttttccatctcagcgtgtatcccttaacaccattgtttaatttgttctgaatttgtttattttttatttttgtatttaattttgtctgactttgtgaatggaatcccattgtatgtattctttttatctggcttctttctgccaacattttttcagggtgcatccacattttatgtagctgtcattattactgcatttttttgactgtgtgtattccattgtattaataagccacaatttatctgtcccattctggatgaatatttgaattcttttctagttttggaaggtattattaataatgttatttatgagccttctagcgtatgtcttctggtaaacatttctctagagcattgctgtctagaagagatacaatgtgagccacacatgtaatttaaaattttccctcctaggctgggcatggtggctcatgcctgtaatcccagcactttgggaggacaaggcaggaggattgcttgagcccaggagttcaaggccagcctgggcaacacagcgagaacctgtctcaaaaatctaaataataataataataattaattaaaaaataaataaaattttccctcctgagtgaattaatgcaggaacaaaaaaaaaacaaatgctgcatgttctcatttacgggtgagagctaaacatggggtacccatggacataaagatgttaacaacagacaccggggactaatagaggaggtagtactatgctcagtacctgggtgatgggatcatttgtaccccaaacctcagcatgacacaatatacctaggtaacaaaatctgcacatatacccccttaatctaaaataaaagttaaaaacgaaaattatcatagccacagttgaaaagtaagaagaaacagatgaagttgattttaataacatatttttaacccaatctaatcatttcagcatgtgtcataaaaattgagaatttgacttcttattttaatactgaatccttgaatctggtttgtattttacaccaacatcccatttcaactcagtggagctacatttcaggtgttcagtacccacatgaggctagcgtctattatattggactgtatagctctaaagaaatatatgtaaatctatcctgaatatatatatatatatatcctatagtggaattgctcagtcatagactatacatatcttgaactttagtacttaatggcaaagtttttgaaagtgattgaaacattttacattccagtagcagtgtgtgatcgttcccattgctccacatagttaccaacatttgatattatcagaatttttagttttgctgcctggtgagtggatagttttcatggtcgtttaatttacatttttctgattacttaagagctagagcactttttaatatatatataggctatttgaatttattcttttgtgaagtgctagtttaagggttttttgcccattttttctcttgggatttttatcattttttttcttactgaatttttaggagttctctatatattctagatatgagccttttgttacatgtactacatatatcttctccaactctgtaacttgcctttttactttcttaaagatgtcttttgagaaacctaaattttaaagtttaatataaagtttatcagttctttccttcatagctagtaattttttgtgtcctatataagaaatctttttcaatcctgaaatcatgaagatattatctagttttacactgtcagagctttattgggtatatttatttattaggcctaacatgcagctaggattgatttttgggtaaaggttgaagtaggagttgattttctttttctgcagtggttcaacactattcatacacttccctgcctccctgcaactctctgccacacctcatactctacagtgccatctgtgtaaataagcgtctatatatatgtggacttgtttgtggactctgttatgtcccattgatttctttctctatccttatgccattgtcacattcttcattactatagctttgtaataaatcctgacaaccattggagcaaatccttgtacttccttacagacatatgactttgttgtcagtaattttaaaaaaagaatatatgactgattttcttagctttttgcacttttatttacatgttgaaattatcttggcatttttagcaaaacaacctgcttggttttgattgtgattttataactgcatgtatcaattttgagagaattcagttgtatacaatattaagtctgacagttcaccaacgtggtatcatctttcatttatttagctctttaatttttcttaaagtctagttttctccctaggagtcatgtgtaccttatcaggtactcaaggtacacggtattttaaattctactgtaaatgctatttaattttttttttttttgagacaaggtctcactctcacccaagctggagtgcagtggcataatcatggctcactgcagcctcgacctccgggttcaggtgatcctcccacatcagcctcccgtgtagctgggactacagttgcgtgccaccacatctggctaattttttgtagaagtggtgtttcaccgtgttgcccagactggtcttgaactcctgggctcgagcgatcctcccgcctcagcttcccaaagtgctgggattacaggagtgagccaccgcacctggcctaaaaattttgtttgctagctttgttgctggtacatagaaagaaaagtttattttttatgagttcaggtaatttatgtgtacaatatttttgtcctgcatgggtacattattttgtcctccatgggtgcatggattcttcagagaagcagaaccaataggagacacacacacacacacacacacacacacacacacacacacacacacacgacatttaaggaaataggctcatgaggttatggtggcccagaagtccaagatctgcatttgtcaagctgcagacccagaaaagccaatggtataattctagtcctagtctgaaggcctgagaaccagaagagctgatgatataaattccagtctgagtatcagtctgaaggcagaagaccggtgtcccagctcaaatacagtcaggcagagagaaagaattctttctcagccttttgttctattcaggcctttagtcaagtggataaggccacactggggagggtagtctgcttttctcagtctaccaactcaaatgttaatctcctccagagataccctgacagacatacccagaaatagtgtgtaaccagttatatgggcaccccaaaattaaccatcacaatgggcagtcagatgatctgcaaatttgtttcttctttaccaattctgaaattttctttttcttggtttactgcaatagccaggacctccaaatataatgtggaatagaaatgataatagaaaatatccttttccttgatctccaaaggaaagctgtcagtgtcttgtcttactattaactatgattttattgtagctttttttgttttgttttgttttttctttgagatggagtcttgctctgtcgctcaggctggagtgcggtggcatgatctcagctcactgcaacctctgcttcccagttcaagcgattcttctgcctcagcctcccaagtagctgggactacaggcacctgccaccacaccggctaatttttgtatttttagtagaggcggggtttcaccgtattggccagggtggtctcaaactctgaccttgtgatccccccgtctcagcctcccaaagtgctgggattacaggtctgagccaccgcacccagcctattgtagctttttagtatacatcctttatcaaatgaaagaagttcacaaagagattttttatttgtttgtttgagacagagtctcactctcacccaggctggagtgcaacagcacgttatctcggctcactgcaacctccgcctcccgggttcaagcgattctcctgcctcagcctcccaagtatctgggactacacgcgccttctaccatgcgtggctaattttttgtatttttagtagagatgggatttcaccatgttggccaggctggccttgaactcctgacctcaagtgatccacccgcctcggcctcctaaagtgctgggattataggtgtgagcctccgtgccgggcccacaaagagattttatcatgaatgaatgttgaatatttttcaaatggcttttttacatatatattgggatggtcatattatttttctttttttcttttcttttttttttttttgagatggagtctcgctcagtcatccaggctggattgcagtgatctcagctcacggcagcgtctgtctcccgggttcaagcagttctcctgccttagccacccaagtagctaagattacaagcctgtgccaccacacctagctgatttttatatttttagtagagacggggtttcaccaggttgtccagtctggtctcgaactcccgacctcagatgatccacccacttccagcctcccaaagtgctgggattacgagccaccatgcctggctgtgattgtataatcttatttgtatacattatggaatttagttaggtgacactttacttaggcttttttttttttctggattcataagtgaaaatggcctataattttgttttcttttagagatgaggtcttgctcattcccccaggctggagcgcagtggcaccatcatgtctcactgtagccttgaccttctgggctcaagtaatccttttgctttagccttctgagtagctgggactacaggcatatgccaccatgcccagctaatttttttattttggagagatgaggtcttgccatgttgcccaggctggtctggaattcctggcctcaagcgatcctctgaccttggcctcccaaagtgctgggattacaggcatgaaccactgtgctgagctaaaaatggcctataattttcatctttctttttgagtttttatataaagtctagtcccaaaataaattggagagtatctttttaaaaaaaattttctaaatgttcgcttaagattgttgtattgcttcctttatgtttgatgagtttgtcaatgaagccaggtagacccatataatgggctataatgcaagtctcaacaaatttcaaaagattgaaatcatagaaaatatgttttctggccaggcatggtggctcatgcctgtaatcccagcattttgggaggcagaggtgagtggatagcttgagctcacaagttcaagaccagcttgaggtcaaggctacagtgagccatgattgcactactgcattccaacgtgggtggcagaatgagactctgtctcaaaaaaattaaataactaaataaaaatgaaaaagaaagtatgttttctgacgacatgtgattattatagaaatcaattttaaaaaccttttaaaaaatctcatgtttaaaaattaaagaaatttgcttctagattcttaaggtgaaagaagaaaccataatggaaattagaaactatagtccaccattcttatccttgggttcttaatccatagattcagccaacctcagatcaacagtatttgggaaaataatggatggttgcatttgtactgaacacatacagacttttctcttgtcattatttcctaaacaatacaatataaccactattacatagcatttacattgtattaggtgttacaagtaacctatagatgatttaaagtatatgggaggatgtgtgtaggttgtatacagtgttacaccattatatataaaggacttgggcatccatggatttgggtatccacaggtgtcctggaactaatttcccacagacactgaaggatgactgtattttgaactggatgattacaaaaatattccatatgaaaatatgtgtgtttttacaaaagtagttttagagaaaacgtacatattagaaaagaaaggttgacaaaaatgagcaaagtatccatctcaagaagttggcaaaagaacataaaaagcagaagaaataatgaagataaagcaaaaataaatgaaatataaaacaaacataaaataggatcataaaagccaaaagttggttctttaaaagattaataacattgataaacctctgagatgctgatcaagaaaagaacgaatacacaaataactaatattagaaatgaaagaagggattttactataaatcctatagacttacaaaatatgaggctataatgcacaattttatgctattttttttttttttttgagatggagttgcccaggctggagtgcagtggtgcgatctctgctcactgcaacctctgcctcccaggttcaaacaatcctcctgcctcagcctccttagtagctgggattacagacacgtgccaccacacccagctaattttgtatttttagtttcaccatgttggccaggctggtctcaaacttctgacctcaggtgatccacccacctcggcctcccaaagtgctgggattacaggtgttagccaccgtgcctatgctaattttttaaaactctcattttgttcaggcatggatctcttaggaaatggcaaagtctaaatcgtagactaatcattgtttggcaatggttggtttagtggtggcacgtgatgtgatgttaggaagaattctatggtaaattttgagacttcaaataaaatggttaacttcaatgctgtgttttttgtggggagggttttaaattacttttgcttaactatgaggctattcaagttatctatttttgtgttagtgcttctgatatccttctgacttcatggcataaaaagttaaagcaggctgggtgcagtggctcatgctataatctcagcactttgggaagctgaggtgggaggatcacttgagcccaggagttcaagatcagcctgggcaacatggtgagacttcatctctacaaaaagttttaaaaattagccaggtcatggtggcacacacctgtagtgccagctacttgggagactgaggtgggagggttgcttgaccccaggtctgcagtgagcctgggtgacagagtgagaccctgtctcaaaaaaagaaaagaaaggaaagcaatacttttttaaatttctttcaacaaatatttataggacacctactgtatgctaggtactattatttaccatatttcttatatccagtcagactggattattatttaggacagaaaatttagaaacaaaaacggctcatccctagaaggatgcagctgcttaaaaaaaaaaagaaaagaaagaaaaaaaaagaaaaaaaggtggggtgcttagcatagctggtggtgacagtgctattgtgaaagctgagtagcacctatttcacagagcacctctataatttgtaaaggagtatggtttttcagatgttacctttattactgggattcatgacctgcgtagacttcaagtaggtttattgacttcagggtatccacagttcctctgaaattgtatagaatagtttatgtgtatatgctttttggtgatagggaagagagggttcaatggctttccatagatttttcaaagggtccaaaaatgcttaagaaccactgctctgtgggttaagaaaagtttacagagaccaacaaatagtttttttcttcattttgtgttttatgtctgttttgagtaaccattatagtaaaatattatatataagattctctttgacttttgttcaatttatattattttgccattactttaactgataacttttttctaaaggttcaggaacaagtgcatcccactctctcagctaatgaagagtctctctattatattgaagagctgatttttcagctgcttaataaattatgcatggcccagccaaggactgttcaagatgtagaggtaaaaattattttgtcatttcaaaaagtcactcaagcactgtatgaattaatttttgtatctatatcattctaatttattgtgaaaactaaaaccactgaaattatgtatgatatatatggtcagtttgtttttgacaaaaatgtcaaggcagttcattgaggaaaggcaagtttttcagaaaaaaaaaaacttagaacaactgggtacatttatgaggggaaaaaaccttgaaacctatctcatgccgtagacaaaaattaattcaaaatggatcatggccttagacataacagctaaactacaaggtttctagaagaaaattctggaaaatatcttcataacctgggtttaggcacatattttttagagaggactcaaaacatagtactttatattgaataataaggccaggtgcggtggctcacacctgtaatcccagtactttggctgaggcgggagaccgtctcaaaaaaaaaaaacaaaaaaaaaatgttctctatgtcagttgagatgatggttacacagacataagcatttctaaaactcaacaaattgtacattttaagatctgtgtattttactgcatataaatattacctcaataaaagattagtgtaaattttgaggacatttgctcagtgatttaaaaaaatgtatatgtatgtgtgtgtgtatatatatatatatctgaaaaactgtttaaattagtactaaaataattgttttgccttggttacatgggagtatttttggatttttagcaatatctgttagggagagttttacttcttttgtataaaagcaccctgtgcacataaaattaatattaataaaattggtattattttctcctgctaaaaacaaatgtctaatagtacagctatcaaaaattattttcatttttattttttgagatggagtctcactctgtcgcctgggctggggtacagtggtgtgatcttggctcactgcaacctcagctacccaggttcaagctattctcctgcctcagcctcccaagcagctgggactacaggcgtgcaccccaggctaatttttatattttcaaaaattacttttatactatactgtttacatttccttttgttttgaaatttgtttctataagcaacaactttctttctttctttttgtgaagtggcatgatcatagctcactgtagccttgaactcctgggcccaagttgtcctccggcctcagcctcccgagtagctgggactacaggcacgtgtcactgcgcccagctaatttttatttttatttttgtaaagactgggccttgccgtgttgcccaggctggtcttgaactcctggccttcagtgatcctccctcctcagccttccaaagtgctgggatacaggtgttagccaccatgcccagctacaacaactttcagtataaaggaaaatcttaatttgtagtgattgagctattaagattttccaggattcttggaattaaagcatttttttcccctgttctctgctgccaattgtttgggttttgttgtgttttgttttaagagacagggtcttgctttatcacccagactagggtgtagtgacaggatcatagctcactgtagccttgaactcctgggatcaagcagttctcctgcctcagccttccaagtagctgggactacaagtgcatgcaaccatgcctggctaatttttaaatttttttgtagagacagggtctccctacattgcgcatgctggtttcatactcctggcctcaagggatcctcccacctcagtctcccaaagtgctgagacttagaggcatgggccaccatgcccagcctctgctactagttttgaacatgaaataaacagactgaaagcatatttttcaatagctaaatttgctaaaatctgagactataactataaatataggaaaccctgctaaattagagtttaattcagatctcagtagttcttgtttttcatgccaatgaatcactgattaaattaaaattagatgaactgcctaggtgcagtggctcacacctgtaatcccagcactttgggaagttgaggtggacacaatcacttgagcccaggaatttgagactagcctgggcaacatggcaaaactctgtctctacaaaaaatagaaaaattagccaagagtaggggtatgtgcttgtagtcccagctactcgggatgctgaggtgggaggatcactggagtctgggaagtggaggttgcagtgagctgagatcccgccactgcacttgcacttcagccagaagtgacacagacagagtgacaagagtgagaccctgtctccaaaaacaaaaaagcaagatgaacacaaaggctaagattgtttttgtcaaggtacgtattttcataagccattctgagctctctcacccatttcatcttccaagagatacatgacgtcttttatttgaagctctaagattaacgaaaggagagtggctgtatactaatgattaaaaatgaatgaacaatttctgctctgctaggtaaatagttttaactctagaaacctaacttaaaatcactaatacactatttcatgttcgctttaatctttcttatatatcctatgtattgttttttcctttttccggttcatcttaattatgtttaaagctttctttttgaagtttacctttttgttttatccatgaaaattatgtggaaaaattttgatagtcctgttgaccttttttttttttttttttctgttgggggtctccctctcacccaggctggagtgtagtggcatgatctcggcttgctgcaacctccgcctcctgggttcaagcaatcctcccacctcagcttctgaagtagctgggactataggcatgcaccaccaccatgccgggctaatttttgtatttttaatagagatggggtttcactgtgttgcctggctggtctaaactcctgagctcaagtgatccacctgcctcagcctcccaaagtgttgggattacagacgtgagccaccgcgcccagcctgaccttttttttaagccaaaaaatttatttattacaggaatcagaatgtattgtgtcactattatctgctagcattaagaatagagatcaagttgaattttgtatgaatttcctatttatgaacacttttattaatactacaatggttctgctgtgattgagcaggagcgagttcagaagacctttcctcacccaattgataaatgggccattgctgatgcacaatctgctatagaaaaacgaaaacgaagaaatcctcttttactgcctgtggacaaaatccatccttcgttgaaggtaacaaaagattaaacattagttggggggtgttctttataacaagtaatattttatttctatatttataaagcattaatgtagcatggtctgtgttagtgtgtatatgtgcacttccatatgtatgcttgtacatacacatcgtatatattaatatgtatacaaaatgattatgctctggtgaaattggattgcttttcaaacaatattaaaaattattaatagtgataatgcattactattattttgtggcatcttttttttttttaagtagagacagggtcttgctgtgttgcccaggctggtctcaaactcctgggctcaagtgatccacctactttggcctcccaaagtgctaggataagagtcatgagccatcaggcctggcccattgtggcatctttatggcatcttccaatgactgctactctgactaattcctatgtagtaggccatgattctcagtcatttgttgattaagaaagtgtataatttcagaagctactgtgagttcagaactgtctttaaaattaatttatattatcacagattattttttatatactggaaaagtggactaggacctagtttggctattgcatattaacgcatagggcaaaatatgtttggtgtatatggattttaagagttttgtagcaaattcaagccccccccgccccgcctgcctcacacacacagacacttccatacctcccctcagtagaaactactgtaattaggggatactggttttaaagcagagtccttgaagatagcagatattttgatatttgtcagatgaattttggttaatgtattaagaggcttttagtggagtccaacccaagatttctatatcaagatcaactgttgttgtttgataaaaggcagagttgttagattagatgtctcttaaaagaaaaaaaatcccctaatacagggaccaaagattcattttatatcccgtggtacccatacatttagacatgtagttaatagaaaattttttataagcaaggatgttaaataggaattttttaagtgtgtaatacttgacagtgctacattttgcaattaaattatttattcttttcacaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggtaagtgttacaaggtatttaaatttaacttgaatagcaactatactaatttctgcctcaatctttttgtgtacattattagataagtaatctttataattgctagtactggaagagagaaaaatcctggctttacagagtaaccatgatatttccaggtttttaagcatatggcaggatggggatctctttttttggtcaagaatcttttacttacaagaaaaaaaacatccaaggcctcaaaacaatttaagtagtttcagttttatatttttagaaagagaatatatagagttctactcaggtacttttaagtgtaagtaattttgaagaccctactttggtttcacagcatagcttagtgaggcacaggggagagaaaattagactgcaatgttgaagttactcccctctgatcatttttttgtttttatatctgtcttctttcctggctgtaagctacttgtgggaagaaattgagtcttccatattcttctatattcctttacttaccttcttattcttcttcctgttatttgagacaaggtctcactttgtcacccaggctggagtgcagtggcacaatctcagctcactgcaaactttgcctccctggctcaagcgatcctcctatctcagcctctcgagtagctaggaccacaggcgtgcatcaccacgtccagctgtttttatattttttggagagatagggtttcaccatgttgcccaggctggtcttgaactcctgagctcaagtgcttgcctcagcctcccaaagtgttgggattataggcatgagccactgcacccactgaagctataacgctgaataacatagcaatctttgtgttagaaggtatttattttactgcaaaataaaaatattataaacagataattacagaacaatatgattaaaactatcatactagtaagtccaaggtacagtggagaaagtaatgaactttagcacgggtgaggccagaaggactacagagaaaatgcctaaatgaaactctctcagggtgaacaaccttcaggacctagcacatgctggtggttctcagccttgactgcacatcagaattaatagaaagctttttaaagaatgctgatgcctgcatatcacccccagagatttaattggcctggattggatctccaaacctcagtgttctttgaaagcattccaggtaattctgatgtgcagttataatgactgagaccgattgtacgatgccataatttcagaaatgacttttcacttacatcatggtagcaattccttgttatctctattttgacttacaaaattatggctacttttttttttttttactttgaaaatatcttagacttttagaaaagttggaagtacaacaaaaagtaagcccttgccacttgaaccatatgagagtaagttgccaatatagtatgtcctataaacaagaacattctgctacattaccacagtatgactgacagtcaaaatccaggaaatgaatacatttgatacattataccatctaactttcaaacatcattcaagttttgtcacatatcctaatgatctttttaccaaaatcattcattccagaatcatatattgtttatgtgtcatgtatttttatcgtcttcagtctggaataattcctcattcctcccttaacttcaaaaaaaaaaaaaaaaagatggcaaagcaggccaggtggtggatcacgcccgtaatcccagcactttgggaggctgaggcgggcaggtcacttaaggtcaggagttcaaaccagcctagtcaacatggcaaaaccccgtctctactaaaaatacaaaaaaagtagctgggcatggtggcatatgcctgtaatcctagctgcttgggaggctgaggcacgagaatcatttgaacccaggaggtagagtttgcactgagttgagattgcaccactgcactgcagcctgggtgacaaagcaagactgtttcaaaaaaaaaaaaaaaaaaaggtggaaaagctgactttattcaagagaggccatggcaataggcacagggaccactgcagtgtaatcctgtggttggggagagagatgttagaatcaactctcctcccttaacttctataacctggacgcttttgagagttacaggtcagttactgtgtagaatgtccctcaatttcggttttctctgttgttttctcttggttagaatcaggtaatggtctttagcaggaatatcatagaaattgtgctgtgttcttctcattgcattttctcagatggcacacaggcacatgatttcattgtgtctcattagtggtggtgatgttgacttcgatgacttgattaaggagttatctgccaggcttttcatctgtgaagttactgttttcccttttgtaattaataaatgaatattttgtggagtactttgaaactgtgtatcttattctttatcacactcaaatttaatatggactaatgaattgttattttattcaatgggtcataatctgttacttcattatttagatgttgtaggccaggcaccgtggctcatgcctgtaatcccagcactttgggaggctgagacaggtggatcgcttgagctcaggagttggagaccagcctgggcaacatgtctctacaaataaaaaaaattatccgggcgtgtgcttgtgactatagtcccagctatttgggaggctgaggtgggagaatcactggagctcgggaggttgaggctacatggaatcgagatcacgccactgcacaccagcctaggtgacagagtgagacactgtctcaaacaaaaaaaagttccggttgttccagatttggttattaggagccctagcttggtttttctgttcctgtcattatttgagcactttattttcttttccccttcctatttattaatttatttaattataaattgacaaattatagttgtatatatttatggagtacaaggtaatgttatgattacaaagaaaatgtggaataattaaatcaagctgattaacatttattacctcaaatacttattttttgtggtgagaacatttgaaatttactcttagctagtagaatgatggttacaaggctaggaaaggtagctggagtgggggaaatggggatggttaatgggtacaaaaatattgttagaatgaatgagatctagtatttgatagcacaacagggtgactacagtcaacgataatttgttgtatattttacaacaattaaaagagtttaattggattgtttgtaacacaaaaaaaggataaatgcttgaggtgatggagactccattttattctgatgtgtgcattatatgcctgcatttaccccatacatatatacacctactatgtacccacaaaaatttcttttaaaaattgaaatgacaaaaaaatttactctttttgcaattttgaaatgtaaatacattattatttactatattcaccatactgtgcaataaatcttacaaaaaagacccaattcctcctaattgaggttttgtcccccttcccttcagcctctggtaaccacattctactctgcctctatgagtttgttccagattccacatgtaagtgaaaacacatatgcattttctttgttgtttgttttttgtttttgttttatttcttttttgagacggagtctcactctgtcgcccaggttggagtgcagtggtgtgatctcggctcactgcaacctccgcctcccaggttcaagcaattctcctgcctcagcctcccaggtagctggaactacaagtgcccaccaccatgcctggctgatttttgtgtttttagtagacggggtttcactatgttggccaggctggtctcgaactcctgaccttgtgatctgcctgcctcggccttccaaagtgctgggattacaggcttgagccaccacacccagcttctttgtttttgagagcttgagtctccctctgtcacccaggctcactgcagcttcaaacccctgggctcaggcaatcctcctgcctcagcctcacaagtagctagagctataggtgcctgccaccatgcccagctaatttctaaattcttgtaggaatggggtcttgctatgttgcccaggctggtctggaattcctggcttctagtgattttcttgcctcaacctcccaagatgctgggattacaggtgttggccactgcaccaggccataaactatttttttttaataagtcattcctttatttgaagcatttttccatgtcctaaatcttcaccttttgagagtttaaaaaaatcttcatgtggcaggattttcagatccccttgttatattgcttttagactgatttctaaaactgtgaagacaatagtccagatttggtctgaccaacagagtatattgaaatgcatgtacgtatccttcattctatatgctattctttaataatttcagcattaatattttggcaccacgttactctgtgtacttgttgagtctgcagatttctaaactcccgaggactgttccacatgaagtaccattatgttaggtctttgatttctccaacttgtgcttgttgattttttgttattgttgtaagaatgaacgtgaatttatccctagaaaacttcatactgttattgaggctatgttccagcatatgtagatattttaaaaattgaattctgtcattcagcattttagatactctacccaggtttttgtaaagtgtacaagtctgataaaccttgaattaaaattatttagtaaaaatgttgaaaaggccaggtgcctttgaatctgagaggcggaggttgcagtgagccgagatcacgccactgcactccggcctgggtgacagagcgagactccatattattttatttaatttatttattttttattgttgagacagagtcttgctctgtcacccagtatggagcgcagtggcgtgatcttggctcactgcaacctctgcctcccagtttcaagcaattctcctgcctcagcctctcaagtagctgggataacaggtgcctgccaccatgcctggctaatatttttgtatttttagtggagatgggattttaccatgttggacaggtgggtctcaaactcctgacctcaggtgatctatccacctcagcctcccaaaatgctgggattacaggtgtaagcccctgcgcccagccaatactccatcttaaaaaaaaaaaaaaaaaaaaaaattgaaagggattatataagaaatgagatttctagcatatgttattagtggcattcttctaggttaaaagttaccacttttcttcattcctgccttttagttagctattatttcacattttatttaattcatgggtcaacaaactttacctataaagggccaggggataaatattttaggctttgtgggccatacgtctttcttgcatctactcttctctgctcttgtagcatgaaagcagccataaatgaatgagcatgggctatgttccagcaaaactttatttacaaaaacaggctgcaggctggatttggcctgtagtttgctggtccttgtttcagacattcctgtcatgatcccctatttgtcacaagagactgtcatatgcttagctaaaatccagatgacttggccgggcatggtggctcacacctgtaatcctagcactttgggaggccaagacgggcagattgtctgagctcaggagtttgagaccagcctgggcaacatggtgaaaccccatctctactaaaatacaaaaaatcgtccagacgtggtggcgattgcctataatcccagctactcaggaggctgaggcacaagaattgcttgaacctgggaggcggaggttgcagtgagccgagtaccacttaactccagcctgggcaacaaagtgaaactatgtctcaaaaaaaaaaaaaatcccgatgacttgatatgtgggtctagttatgtaaccctaagtaatgagattgtatgatgtggtatgatcttagtatatccaaactgatatctagagatcactagttcaagagctcacagaccatttgtttaataaattatttgaatatatggtttctagggatatctttaatttgccagacagagaacttgagaatcaaccctatttctttacagttaaaaataaaaataacatgtggctatatgaggtatgctagcatatcaaagattgctgagaattagatgatcataggaaagaaccatagaatttaacttctagtatataagttactattaatgaaaatagtatttaaaactggaaaaactgaacataaatgcttaagaaggaaattgatgtttaggaaaggtaaaggccaggcacagtggttcacgcttgtaatcccagcacttttggaggttgaggcaggaggatagatggagcccaggagtttgagaccagcctgggtagcatagcaagacatcatctctacaaaaaatttaaaaaaagaaacaaagaaagaaaggtgagataccctggggaatatagcaagacctcatctctactaaaaataaaaaaaatattagctgggtgtggtggtgcatcccagctacttggaaggctgaggtgggaggattgtttgagcctaggacattgaggctatagtgagctattattgtgccattgggcaacagtggacaaaaaaaaccaaaaaaaaggtgagagaataagagggcacaaagctgctctgaggaagcttagttcaccagatctagatatactagcagttgagttctgtattttctttcttttgtttttaacctattgaattatacttttttttttccttctgagacagactctcactctctcaaccaggctggagtataatggcgtgatcttggctcactgcaacctctgcctcctgggttcaatccattctcctgcctcagccttctgagtagctgggattacaggcacttgccaccacgcctggctaatttttgtatttttagtaaagacagggttttgccgtgttggccaggctggtctcgaactcctgacctcaagtgatctgcctgccttggcctcccaaagtgctaggattacaggcatgagctactgcgcctggcctttgtttttgtttttgtttttttttaaagacaaggtcttgctctttcgcccaggctggagtgtagtggcgcaatctctgcccagtgcaacctctgcctcccgtgttcaagcgattctcccacatcagcctcctgagtagctgggattacaggtgcgtgctaccatgcctggctaattttttgtacttttagtagagacagggtttcgccatgttgggcaggctggtcttgaactcctgacctcaggtgatccatccaccttggcctctaaagttctgggattataggcgtgagccacccatgcctggccagaaaaatctgaagctaacaggagtggggtatgaatatattttctctttcatggtagtattactccatctgtttcaagagctagcttgctcgctcctttttttttttttttttttttttttttttttttgtgacaaggactcacctaagccggagtacggtggtgtgaacacggctcactgcagcctcaacctccagagctcaagtgatcctcatgccttagcttcctttgtagctgggaccacaggcttgaaccaccatgcctggctgtgtttaaaatttttttgtagaaactgggtctctctttgttgcccaggctggtcttgaactcctgggctcaagcaatcctcccagtttcagactggtgaccttctagtgaatagggtctctaggtttgttttttaaatttttgaattatttgccatccatttatatttacagatctaaaaattttacataaaaatgtaaatcccagacttttcatgaaaaaagaaaatcagaatgcctaacagaaaacagctggcactgagcagcacacttcctctttaggtgcatgtaccttccggtttaccataatccccactgtttcttatatattataatgttacttgcctgacccctgtagcatttaaattcaggaactttggtattatgtgaccaaaagagttttaagaatggaactctggagtgggtggtagagaaggtaagtcatagaggaggccccactgacagaatggtgtatcagaagccaagaagagaaaaattgtttggggctggggggtttatatgtgttttttcttatttagagataggatctcattctgtcactcaggctagaatgtggtggtacaatattagctcactgcagcttcgaattcctgggctcaagtgattctcccacctcagccttcagagtagttaggaccgcaggtgtctaccagcatacctggttattatttttttttacttttggtagagatagaatcttgctatattgcccaggctggtcttgaatgcctggcctcaagtgatcctcctgcctcggcctcccaaagtgctgagattgtaagcatgagccaccatgcctcgccctgagagttttaagagttttaagaatgagagaatggtcagctgtgtcaaaaactagagaaaacaagtaggaagactaaaacacaccattagatttgacactagatcaatagtgagagcagttttaatatagtaatgggcttgctaagtgaatgggagcaagaagttacagctagcaagtatgacctactctaaaagggtctctggtggggaagagaagagggtggtagctcttctgtgtgtttttatgtcttatgtcttcctttattttgcatgtctgtttgaaatcagagttcatcaccaaattccctgtgtagccttactggtttctttaaatttaaagtggctgggaagtggggatgatggtctccaatgacaagaaggtggattgcatggagtaagcagtggggaagggagggatttgagagtgtcacagaacatgagattaggaaggtgggttggagttaaattatgaatggcctttatcctaaagaagttaggattttatgcagaaggcaatgaaatccagtatcatttttatgtatcatttatttttagtaacatgattttagaactggggttgggaagacctgtggcaggcagatcaaattatgaaacttgtgtatctttttaagagatggtgattgtttagtggagtaatctaaagcctgcggtaagatggagagagctgaccagatttaaaagatgcttataagatatttctgagttagattcaaaaagattaggaaggcagagttcatgtttactttattagcatattttaccaacatgtggtacagtttatggtgatcagtagatgtttttcagaatgaatgaatgaatatctgttattgtgttgtcagaatttcctctcatccctttgaagtttttactttttgtagtttccttttcagggtatacctttatgctgaactctctgggtacgtttcggtcagtcttaaatatataattaactaggtccaatcatttttttttaaaaaaagtattattaattataaaatgtatggtcacagccaggcgcagtggctcacacctgtaatcccagcactttgggaggctgaggcaggtggatcacttgaagtcagaagctcgagaccagcctgaataacatggtgaaaccccgtctctattaaaaatacaaaaaaaaattagccaggcatggtggcgtgcacctgtaatcccagctactcaggaggctgaggcaggagaatcacttgaacttgggaggcggaggttgcagtgagctgagatcatgccactgtactccagcctgggtgagagagcaagactctgtctcacaaaaaaaaaaaaaaataaaaaataaagtatagtcaactttctttttcactttgatttatagctagttcttgcctgttggttgacctaagtccatggtagcatttctgaaagaagaagtggttgctacaacaatttaagcatctgtgagatgtttgggtttagcaaatgaacgtaatagcagtggtcattgtagtaaatgtgcatcagaaatgcatcgcactgatctatcgtgtgcctctaccatagtagcatttcacttttctccttttaaccctactcaaatatgtactgtcatccttataatatggcaaggaactaccatgttgaatacctactatttgctagatgtagtagtatgcattttatatacattaccacattgaattcttcttatcagctacattttactcataaggaatgtgactttcaaaagaataaatgtgttcataatcatagtcgagtagtggctgaactgggatttttggctcgggttattgttccccaaagacaggcttgctttttttttttttttttgctattatgtgtgtgtgtgtgtgtgtattacagtatacatatatacatatacatatgtattagtacatatttcaccattagttcatatctccagaaatatttattttgccatactcgattttatttgaatatttcccaccttcaacaactttttttccttttattctaggttttatcatataaatttacttataatacacacaactcattgtgtaatatttgtgtgtgcgtgtgtgtgtgtgtgtgtgtgtgtgtgtgtgtgtgtgtgtgatggagtctcgctctgtcgcccaggctggagtgcagtggtgtgatcatgactcaactgcagccttgacctcccaggctcaagcaattctcctgcctcagcctcccaaatagctgggattacaagcgcctaccatgacgcctggctaattttttgtatttttggtcgagacagggtttcaccatgttggccaggctggccttgaactcctgacctcaagtgatcctcctgccttggcctcccaaagtgctgggattacaacacccagccctgtttaataacgtatagatttcaagtactttgaggcagtttttataaaagtaaagaaaataaatttatacattattgatttctgtttctcaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgtaagtacctttttgggtttgaaattctgtgtaccccaaaaaaccagaccagcttaaaatcatagtcacttttttttatttttttgagacggagtcttgctctgttgcccaggctggagtgcagtggcgtgatctcagctcgcaccactgcagcctccacctcccgggttcaagcaattcctgcctcagcctcctgagtagctgggattagaggcatgcaccaccacaatcggctaatttttttatatttttagtagagatagggtttcttcatattggccaggctggtttcaaactgccgacctcaagtgatccacctgccttggcctcgcaaagtgctgggattatacgcatgatccactgcacccagcccataaatagtaactttaaatactttatgagtacattaaaaatactttcatgtatttgtgggctttataaacatgtgaattgttatataataggtacagtgacaatgaaaattaggcacaaaattagaaggaggtttatactggggtgaaatcattttccgttatgcagttctgatatttagagtcattcatttggaggtggtgaaaaagatgtatggtctaggaaaggaagacctctgcatttttctgtcttttggtaagtaccttaaggcagtagtttaaagttttagtttgaagctcagaataccatggggttaaaaaaaataaagttttaacggtggaacttttaaaaataaaagtttatgcagaatgccatgtttaacaaacaaaaaagttttttttctttcttttatcacatgatttatttttccatgtctatgtgtttggcccacactttaaaaataattagtcttgaccgggtgcagtggctcacgcctataatcccagcactttgggaggccaaggcaggcagatcacgtggtcaggagatcgagaccatcctggctaacacggtgaaaccccgtctccactaaaaaatacaaaaaagttagccgggcgtagtggtgggcgcctgtagtcccagctactccggaggctgaggcaggagaatggcgtgaacctgggaggcagagcttgcagtgagccgagatcacgccactgcactccagcctgggcgacagagcgagacttcttctcaaaaaaaaaaaaaaaaaaaagtaacaataataataataataataattagtcttggccaggtgcagtggctcatgcctgtaatctcagctgttttgggaacctgagacaggaggattgcttgaggccaagaatttgagaccagcctgggtaacagagcaagacccagtctctacaaaaaaatttaaaatttagctgggcatgatggcacatgcctgtaatcccagctgctggggaggctgaagtgagagatttgcttgagccaggaatttgagactatagtgagccatgatcgtgccactgcactccagcctgggcaaaagagcaagacctcggctcaaaaaaaagatacttagcctttgtcttatttatcttgtacctcctaacttcctccacaaaataactacattgtgagtaaataagagtgacactcagacacaggtggttgagtatttaaagttaggaacagatttagcttttctcattatattccaaaagaatgagttttaaatgataatcgaaagtgttttagttggcaattactttttttcttttggatatatgtttagtttaacaatgtttataataactcctactgggaatactatcataagtagtcagaactttatgtttttcaaagtactgttctattttatttgacccttataacaatcctgagggatagaatgggcaaatattgtcatctctactttacttgtaaggagattgactttttttttttttttttaaatatagatgggggtcttgctatgttgttcaggttggtcttgaactcctgggcttaagcagtcttccttctcagccccccaaagtgctaagattacaggcttgagccactgtgcctagctggaaattaacatcttaatcaagttagttatagagcttaatcttgaatgtggcttcttttctaccacgttataattggattttgtctctagtggtatgaagaataaaaacctaataaatgctggcagctaatattatctttgtctttttgtgtcccatcagttttcattcctcaggaattaatttttatgggtctcttttcactggattagtgctgatatgacagaaaatgtctattttaatactaaagggtcagatggaagagtgaatcccttttttatctatctctgtatctactataattttttttagcattaagtaaaatataaacttttgagggaaagactatctaaaatcagagcatagtactctgcaaatattaaagaagtgaatgacttaaaaatgatcttaagttactccttttgcccctcatcctatgttttcaaaaagctcgcatttctggaaggcctaatatgtgccaggagcattttacagaaatcatctaatttaaccctaagaccctgatgagctgggtattagcagaccaaatgtgtgataacgggcaaattacttaactgctctatgcctctgtttcctcatttgtaaaatgaggatgatgatagtacctatctaataaggatattaggttattacatttcaagtgcttagaagagtgcctagaatataatgtgcccaatacatgttagttgttattattgtccttttcattcctaagccagggtcattcatctggcatgttgtaaaagggaaaaacagtttttcctctctaatctttttttttttttttttgagacagagtcttgctctgtcatccaggctggagtgtaatggtgcagtcctggctcactgcaacctctacctcccgggttcaagcgattctcctgcctcagcctcccgagtagctaggattagagatgtgcaccaccatgcctggctaatttttgtacttttggtagaaacggggtttcgccatgttggccaggctggtctcgaaatcctgacgttaggtgatccacccaccttgacttcccaaagttctgggattataggcatgagccaccgcgcctgacccctctctaatcttcacactcaacacagaacatttctgtgacaacgtatgtgaggattttttccccatacaccaaagtaattctcctgtgtacaccaactaggtgtcctataatttagctcaattttgacattatttacctctaaatagtgtcagatctcacagattaaggactcagtcccaacacgactgtctcacacttcaggcgccaattgaaagtcccaggttgtgaactgtgctccgaactgatcagttataaattggagttcccatgaccccctccttgggttccattaatttggtcgaacagctcacagaaatcagggaaacacgtttaccagtttattatgaaggactttaaaatgatacagatgaagagatggacagggcaaagtataggggcacagagtttccaagccctctctgggcaagccaccctcctagcacctccacaaggtctgcaaccaggaagctcatcaagagtttttatggagcttgatctctagcctctcacccctgccctttttttttttttttttttttttttgggagacagggtctggctctgttgcccaggcttaagtgcagtggcaccatcttggctcaccataacctctgcttcctgggctcaagcagatcctccagcttcagcctcctgagtagctgggactacaggcacacaccaccccacccgactaattttgcattttttgtagagatggggttttgccatgtttcccaggctctttccccaattttttagaggtcagtgggtggggctgaaagttgcaaccctctgatcctttttctttttctcatgagtcagtttggtttcaagtaacccttcaatcctctaatcatctggtctttttggtgactggccctatcatgaggttatctaggggccctactgtaagtaacctcattagcataaactcagtatttatcaaaggtactcattatgaataacaaaagacattattatcactcaggatattcttagcgttttaggggctctaagacaggaaccagggacaaagaccaaaaatatgtttcatattataccacatgtggtggagccaggatccaagctcaggtctgtcaggttccaaagcccgtgatgtttccattataagatgccagagtgaataatagttggccataaccgggatggtcagtcatatgatgtgtttgtgttcagagggcttgaacctgtcttatcctagatatatggctatctgccacatatgatgttttagtcagtgataagactataaatacccatatatatgacagtaatcctgtaagattatactatatttttactgtaccttttctctatatagatatgtttagatacacaaatacttaacattgtgttacagttacctacagtattccatacagtaacatgctgtacaggtttgtagcccaggagcaacaggctatacctatatggcctaaatgttgtagtatatcatctagccgtgatatttgcacaatgacaaaatcgcctaacagcgcatttctcagaacatacccgtctttaagcagtgaatggctgtaattcacagacgggagcttggatgaaatctgtaattccttctcagatccaggagatgggccctaaattgtgaaaccagattgtaacaggattaggagttatcttcattctcatcccagctcttaccattaatctataagactatatagcctaagctataagtaaaacctagggctctgtaagaccttgatcaagtcttttagcatctcagccagttttaaaacactcaaatgccagaattctttatgtaaaaagtagcttagaatcatccacagtaggaggttttagatttaacaaaactatctagaatctatattttgtagtatttttattgtctgttatccaagagatttttaaaattctcttcctgttcatgattgatttttactgtcttggaatatattaatttgagattcaatgaagatatacccttaactcttatattgtttctttttttttttgtacaagcaagtctctttatttccaaagtacgttgacctctccaacccaagttaaaagaatacacagtatgattccatcttttaatatattaacatcaagatgtacatgtttgaaaatggttggaattttatactggaataatgcatactaaactattaatagtttctacctctgagggtcatgggtgtaaggggggcatgaaagtaaacattcatattttactctctctgtcttgtgtttgaatcttttataatgggagtgcattcacatgtaataacttttatttttacaaagaatgagttttcccaagagcaaaatgcaaaaattctgctatagcttgttgacatttaatggaaatatattgctttatataatatatgaattgttcagaagtgataatagctttaatcatgctcccaataaaagatatgctagttaaagaaattctatagtttattccataaatttaaaaacatgtagaaaacgagtaccacccataaattaaatgatgtatttggtgcagggcaggtaagccccaaagttggggcttagctcgggacagttcttggctttgtctaagaaagaagtcaaaggcatgacaatggtaggaacctctgctgaagcggcagcgtacagcagcagcaaaagtactgtttcttgtggagcagggctattccataggcagtctgcctcgagtagcctatattgctctttatatttagtaattttttagcagaattctcaatctcacatttcttaaccttccttctcttttttcaggatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagtaagtttacaaaactacttatattctcattaaagccctaaatgctgtagtaagaaacttagagatgagtcttggcaacatagtgagaccccgtttccataaaaaagtaaaataattatccaggcatggtagtgcccatctgtggtcccagtgactcaggaggctgaggtaggaagcctgggagatcaagcccatgattgtgtcactgcactccatcctgggcgacagagtgagaccctgtctccaaaaaacaaaatttttttgtaagatattctttatgaaaattagaagataccactggccattataaaaagatatttaagatttaactgataacaaactaaaatcacattgcctatatagtgacactttctttatagtgtgtttatggcaatatttatagtgaaagtttatatactagagtagtatataaactagagtagtaacatttaggtttttttttttttttagtggtaagtatattcaagatgaaggaagatacattttattgaccatagctctttaccttctatggattttaaacttaaagttggaaagaagctttatattattttaatgttttccaaagtaaaaatcattttatcttttaaatgactataaaaataatgtagctcattgtaaaaatattcagaaaaatagatatataaattagatgaaagtcactttattttataacacccagagataacttatccttatatatttctgtgcatacatacgaatgtatgtgtgtttgcaaaaataggatcccactattttataacttactgtttttactctgtatatcataaacattgtccatgttaatgtatatacttcaacacaatttttaagtataaataatgtgatgttatatggagacaccataacatattttaactatctattatccataggttgtagagttttttcctttttttttttgttattgtaaacaacactgcaacaaacatatttgcactatgccttgatattctaatcattttttttttttgacatggagtctccctctgtcacccattctagagtgcaatggcacgatctcgtcttactgcaacctctgcctctcaggttcaagccattctcctgcctcagcctcctgagtagctgggattacaggcgcctgccaccacgcccagctaattttttgtatttttagtagagacggtgttcctctctgttggctaggctggcctcgaactcctgacctcatgatccgtccgcctcggcctcccaaagtgctgggattataggcatgagccaccgcgcccagtcatatattctaatcatttttaaggatatattcctggaagtggaattgtagtgctaaagactagatacatttttagaacttggaaacactttgccacgttcacttccagctaagttccagtgtatgtaagcttccttctttcttcaccctttcccttcactaactcggtattaccttattctttttctttttaattctttttttcaaaatttgttttgttttcatatcggttctgcagatatcccattaatttttgccagtctaatgggaaaagaaatctttcttcttctcttctcttttttcttttcatttctttcttttcttttgagacagggtttcactctgttgctcgagctggaatatagtggcacaatcatagctcactgtaacctcgaactcctgggatcaagtgataataatctgtaccatattggtagaaaatatattcttttaaacctaatgctttttctctttttaaaaaaataggagcaagcatttgatccttatgaaacattatcacaggacattctttcaccagagtttcatgaacatttcaataaattgatggccagacctgcagttgctctacactttcaggtaaacttaaattgaaggttttttttttttttttttttataaagcaaataaatatctcactattttatccttcaaatatttgtaattctggaatcctcgtaatccttcaaatcttgttcattctaaacctgttttggattatcttctgttttctctctggagttctgtctgttcttattgtagaaatcttttatagtacaacatcatgagtactgaatgaccagaagaatttggcacatactagatctggggtataaagatgaatttggctgggtgcagtgactcatgcctagaatcccagcattttgggaggccaagacaggtggatcacttgaggtcaggagtttgagaccagcctggccaacatggtgaaaccctgtctcgactaaaattgcacaagttagctgggcgtggtggtgagctcctgtaatcccagctactcaggaggctaaggcaggagaatcacttgacccggaaggcggaggttgcagtgagccgagatcgcgccactgcactccagcttgggtggaatagtgagactctgtctcaaaaaaaaaatagaaaaataaataaaaaataaagatgaatctggagtgtgatttcaggattatgttccctataggaggaagatttggagaaatcttaaaaagttgagataacctcaacctcctatgtactcatactgatttttctatgaggcctacaatttaaaggagataaatactgtattgagggagagtatgcaagttagttggttcaggaatacacttagataaaatgaaaataagtggagagatacaaataaaattttatttttactatctcaacactaacaacaaaagttatgttggcataggtaatacttggctaaatatgtaaaacttctacatctaaactgacttttccagccagacgtggtggctcttgcctataatcccagcactttgggaggctaaggtcagaggattgcttggacccaggtgtttgagaccagcctgggcaaaatagggagacctcatctctacaaaatataaaaacttagccgagtgtggtggcgtgcacctgtggcatgccaggagaattgcttgagcctgggaggtcaaggctgcaatgagtcatgatcacgccactgcactccagccttgggtacagagtgagacccagtctcaaaaaaaataaaaataaaaaataaactggcttttaccccttgacgtttgaatatggtaaaaatccttatagtcctgaaacaaacaagcaaacaaatgaacaaacctttcttcactctagtagaataattaactagagtgaagaaagttttttcatttcctctctcattttttctttgcagccaattgtctttatattattttttaccattctttatgaaaacactaccatgtatgttttaatcaggatataaattgcctttgacaagtaacttaattgccaaatccagtggatatttttatttcatacttaatgtctgtagtatttgttactgctcttatctcttggttcctgtatacctgaaggctgggcgtgatgtctcatgcctgtaatcccagcactttgggaggctgaggtgggtggatcggatcacctgaggtcaggagttccagaccagccttgccagcctggcgaaaccctgtctctactaaaaaatgcaaaaattagctgggtgtggtggcatgcacctgtaatcccagctactcgggaggctgaggcaggagaattgcttgaacccgggaggcggaggttgcagtgagccgagatcgtgccactacactccagcctaggtgacagagcaagaccctgtctccaaaaaatatatatatatatatgtgtgtgtatatgtgtgtatatatatatatatatatatatatatatatatatatatatgcacacacacacacacacacacactagcgggcatggtggtgcacacctgtagttctagctactacagaggcagaggcaggaggatcacttggaggcaggaggatcacttgaacccaggaggtgggggttgcagtgagccgagattgcaacactgcactcaagcctgggctacagagtgagactctgtctcaacaaaaaaaagaaaaagaagactgagactgggtgatttataaagaaaagagatttaattggctcagagttccacaggctctacaggaagcacggctggggaggcctcaggaaacttacgatcatggcggaagccaaaagggaagcaggcacgtcttcacatggtcaaagcaagaggaaggagcagggaggtgccacacacttttaaacaactagatctcctgagaactctattacaagaacagcattaaaggaagaaatccacccccatgatccagttacctcccactaggccccacctccaaaattggggattacagttgaacatgagatttggacggggacacaaaatcaaaccatatcagctcctgtgatactacatgttcccaattttcgtcttctctgatttcttcttctcagtctcttaattattatagctattatccaacttctgttatcagcccctgtttttctgttctgtgctctccttgggtgacttcatgtctatatactggtgacttcttatttgtatttccaggccatcactttcttttaagcactgtgtaccgtgtacatatgtgtatgtatctatacactttcatataaccagctgccttgaattgatgcacttggataccctaaacgcacttcaaatatgacatgtttaaaactgaacttaccatcttctccctgccttctgtactataaattcccattgtttattatcttccacttctctattgtcaaaaatttgttatcatggaatacaaattatacttaattctcaaaattacttcaagagaggaatatttttaaagttaactcatatattcatataaagtatgcattaaatacacagtctataagaactttggatactcattaaaagcactcaacacatttcttgtttcagtcctattttattaggaatttttgctgtggaatttgaatgttaaagggcccagttattaataaagctgtcatcctagatattcagtgaaattggaagagttagatgaaatcctttttcgggccaaactcaattgttttaacttaaaaaaaaattcattcagtttaagataaaataatgcttccttaataaaactaaaaacaaaaagcatctttagaagctgtgtagcgtactttatttatttatttatttagagacagggtctcactctgttgcccaggctggagtacagtggcacagtctcagttcattgcaacctccgcctcccgggttaaagcgattctcctgccttagcctcatgagtgactgagactacaagtgtggaccaccacgcctggctaattttggtatttttttggtagagacagagtttcaccatattggctaggctgttctgttgaccatgaggcaccatacctggactgtgtagcagacttaaaaaaataagatttgaagttagaacttaaggctttgggccaattaatagttttgtttgtttgtttgcggcagaatctcgctctttcacccaggctggagtgcagtggcgcgatcttggctcactgcaacctctgcctcttgggtttaaggagtcctcctgcctcagcctcctaagtagctgggactacaggcgcatgccaccacacctggctaatttttgtatttttagtagagatggggtttccccatgttggccaggctgttctcaaactcttgacttcaggtaatcctcctgactcagcctcccaaagtgctgggattacaggcgtgagccatcacgcccagccccagttaatggttgtgttaccttgagcaattcacttaatctctgagactcagtttgctcatttgtaaaatggtgatcatcataatatatacctcttatagttattaggaaattaaatggtaatgtatatataaagcataagcataatgtttgatgtgtattaaatactcaaatgtagctcctgttattatcagaggactccttacactgtaaatacatgctacaaaaattttagaatgcactttatcaggcattttagtacaaataagcaaaacagttgatcttgtagactaattttgaagtttcatattggttccagttcaagcactgtatataaaatatccagaataattcactatattaattagtttaatactgtcttagtctattcaggctgctctaataaaatatcataaactggatggcttataaacaatagaaatttatttctcacagttcacatttaggaagtcccatatcaagaggctaacagatttggtgtctagtttggtgccctagtgagggtttgctcttctggttcatagatggtgctttcttgttgtgtcctcacatgatggatagcacaaacaagctcccttaggccccttttataagggcactaaccccgttcacaggggctctgccctcatatccaatcacctcctaaaggccccatctcttaatactgttgcattggggattaggtttcaatatatgacttttgagggaacacaaacattcagatcataacaaatgtgaaaatgaattaatctttaggaaaattggtggcactttttgtgtatcctagtaagaagtttggttactgggtaataagtctgttgaaaagattataatttaacaaaatgtgaaaattatggtaatatttatgaagatttttttaaagcagcatatcagattctttctcacattttatattggtgtggttggtgtttttcttatggggagaaatactagtaagtgaactatatagacatttaaaattaacatgagttaaatccattataaattttagaaaaccatttattctacagtagtttccaaaactggggtatacctatcccaagctatacactaagatttttcaggatatataaaggcacagagagctttaagggaatctgtttctagtcttcggagatcttgtttatgttttttgcattgtcttttccaaagtctcttacttgttaccttttgctgttatgtatttcccattatgcattgatccaagatgtaaaaacctctagggcaccaaacaggaaaaaaaaaaaaaaaaaaaaaagtattactcctattggagagttcactgagtaccaagcaaaagagttcacaaaagaatgttatagggggatgatagtaaaaattcttggtagccaaaatgtcatctatctatgttatgtcatatctatctgtctaagaattaagaagtgatatggttatcacaaagatttatgttaaccttattgtaagtacttcatcatcatttgggataaagaagaggagaagcttgtaaagttctcataccttgatgtaatatgtcagaagcagttgtagtttcctccagaggcttctaatccttgagaccatgacattaataatgtttgtttgaatttaacaataaagtttgacttctgacaaactgagtctgatgttgctgtttattttgacagtgaagatcgactttgtcaattaagttgtatgacagacgtttttcataaatgagctaaatctgaaagttattcaattattgtttggtgaaatagttataaatcacatttacagtatacagcattccctgaaatgcatcttttgtaactatttaaatttaaaacattttaaaattgtgcaggagagtacatagcttttcagaattcctttagggtatatggaagccagaacataagctgtagaggattattgtgaaagctattttagccacataaaagaaaattaatgtatatatttctctaataacttaaaggaggaaagggagaaaagaacaacttgatagcacttcagtttcaatatagaatatgcattctgttgtagttttgataagtctgtatctcaaatttttagtagccgtttctgttaggcactgctgttgcatatccttgatgtcagagacatacatactgtgatatctttttgctttgcagtccattgctgatggttttaaagaggcagttcgttatgtccttccacgtcttatgctggtgccagtgtatcactgttggcactactttgagttactaaaggtaaggttttataacagaatctcaaagtacttatctaatagaagagtttactttttaaaattaattttggagacacacagtaccagtcttttaattcttattttatgtaagtaataatttttatatgtaacattgctctaaatttctatcttgttatcttataaaggaaataacttttgaagttaatatttttttctgtgcagtgttgtattcttcctctcttagctgggacccaagcaacacattaaaaatatataacttaaaaaaaatgactctcttctctattttaattaactagccaaccactagtcctggtcacattggctaagagggtttggaggctagtgattaattggtggcaaaagtagctgtggcttaggatgagtcaggccattatagtcaatgacctgatcttaaatgcagacctagtagcaaggatttttaaaaagcaatcatctaggtaggggaaaaatttttttaaattatatggtcaaaccagcatttttaaatgttggccagtattagagggcaactctaagactaatgataggacctctaataagacatgaaccttatttttaaaaattaaggcatccaaatatatgcttatatattattcatatgaagcctgcatatcttttgatgagttctttatggatccactagtatccatggagacttacacaatgaagttgctcatctatttgtggataaaagctgactactgccgggcgcggtggttcacgcctgtaatcccagcactttgggaggccgaggcgggtggatcatgaggtcaggagattgagaccatcctggctaacatggtgaaaccccgtctctactaaatgtacaaaaaattagccgggcatgatggcaggcgcctgtagtcccagctacttgggaggctgaggcaggagaatggtgtgaacccgggagacggagcttgcagtgagcagagattgtgccactgcactccagcctgggcgacagggcgagactccgtctcaaaaaaataaaaaaaaaagctggctacctccagtatcaaatgctgtgggtagtagcactccataaaaaagaacgtaaaaaagagataagtattcattagaaataatcatatatattccttgcctagatgcctacaaggtatacatagaattattatggcttttattttaatgttactaccatggattagacggaaaaagtcgtaactgtctatctaaaccaacgatgtggtatcctaaaggagaggtacgaaataatcaagcagaaagatactttgcttctaaagagcagttaaaaagttggaagctgggcatggtggccacaagcctatagtcccacctacttgggaggctgagataggaggatcacatgaggtcaggagttcaaggccagcctgagcaacatagcaagaccctgttaaagaaaaaaaaattgagaaagaacattttactgagcaagatatgtgggaattacagttgaaaatgggccataatctgaaagtagacagaagttcttagatgttagctagagtcagtgaaaatcagtagcagtaatagagagaaatgaatggattgtcaccagaaaatctccatctttcacgtgctcactttggtaatcactcctacctttaaaagatcaagggaaattgtgtaaggaattagaaatgggaaaagaaacactcactgatgagtactcatgcttgtccaaaggcagcagatactctttattactaggtagtagtaattttgggcttcaaagaatgaataaagagagccaggtgcggtggctcatgcctgtaatcccagcactttaggagtccaagggggagggaatgacttgaggctaggagtttgagaccagtctggccaacatggcaaaatcatgtttttagtctctactaaaaatacaaaaattagctaggggtggtggcacatacctgtaatcccagctactcaggaggctgaggcaggagacagcttggacaacagagcgagactccatctcaaaaaaaaaaaaaaaaaaaaaaaaaaaggagtgaataaagagaaactacccatgtctgatcaatgaaactgtaaccgttagaataaatatggaatatactcagttttaattaatgcacagcaacaacaagaacaaatagaaatgtggaatggaaagacaagccttagaagagattagaaatggcaaaagatttgaatcacttcacaaaacaggatatccaaaatggcagtaaatgtgtattcaaaccattaatagtcaaggaaatgcagttaaaaccacaggataccactacatacacatcagattacagaaatttgaaagtctgaaaatatccataaacagcagcatgaactatttgcattctgttaggaatgtaaactgtataacccactttggaaaactgcttggcattaccttttaaattaaaaaatatgtatactgtctgactaggcaattccacccttgaatatatactctaaagaaacaaaatgcaggcacatgtatgccaagagaaatgtacaagaaagtctgtagcaggtgtcagtaatagcaaatcctgtttgccaaccagaaaagggtaaataaattgtggttcattcagataatgaaagaaacttacactagaacaatacacaacatcaatgacgcttacaaataaactttgagagatgataatatttcattggtgtgttataccatattttatttatccattcatctgttgatagaccgttgaattttttttttttttttttttgagatggaattttgctctgtcgcctggctggagtgcggtggcatgatctcggctcactgccacctctgccccctgggttcaagcagttctcctgcctcagcctcctgagtagctgggactacaggtgcatgtcaccatgcccagctaatttttgtatttttagtatagacagggtttcaccatgttggccaggatggactcaatctcttgacctcatgatctgtccatcttggcctcccgagatgctgggattacaggggtgagccaccgcgcctggctgactgttggatttttttctaccttttggttactataaataatgcttctgtgaatgtgagtgtacaaatatgtctttgagaccttgctttgaattattttatgtatatacccaggagtggaatggatggatcgtatggtaatgttatctttaattttttgagtaactaccacactgtttttcatagtaatggcaccattgtacattcctaccaacagtgcacagggttctgatttctccacatctttaccaaaccgtgttaatttctttttctttttcttttttttttttgagatggagtttcactcttgttgccctggctggagtgcaatggcatgatcttggctcactgcaacctccgcctcccaggttcaagcgattctcctgcctcagcttcccgagtagctgggattacaggcgcctgtcaccacacccagctaattttttgtatttttagtagagacagggtttcactatgttggccaggctggtctcgaattcctgacctcaggcgatccacctgcctcatcctcccaaagtgctgggattataggcgtgagccaccctgcctggcctgtttttttttttttttttaataatagtcatcctaatggatacgaggtggtatctcattgtggttttgattttaattttcctaatgactagtaatgttgagtatcttttatatacttgttaactatttgtatatcatctattttattgtgttgtttttgggacagggtcttgctctgttacccaggctggaatgcagtgatacaatcatggcttactgcagccttgacctcctgggctcaggcgaccctcccacgtagctaggactacggatgtgtgctaccatgcccagctaatttttaaattttttgtagagatagagtctcaccatgttgcctaggctggtcttgaactcctaggctcaagcaatctgcctgcctcagttttccaaagtcctgggattacaggcatgagccaccatacctggctatattttttttctttggatataagaattatgttataaagttacttataaatcaagaagtgattttttttcttttccttcttgcatgaagattgaattatatgttaagataataatctaaaattatgtttaaaaagcagtttgtagaaatttatctaaaatttatcttagaaagtggggtaaggtgcctcatgcttataatctcagcgctttgggaggccaaggtgagaaggtcacttgagcccaggagttcaagaccagcctgggcaacaaagtgagaccttgtctctacaaaaaaaaaaaaaaaatcagattagctggacatagtggtgcatgcctgtggtcccggctactagggaggctgaggcaggaggattgcttgagtccaggaggtcaaggctgcagtgagccatgtttacgtcagtacactccagcctagatgacagagtgaaactctgtcttaaaagtaaattaataaataaacaaaatttatctgagaagaaaaatgaaaacagtagtttgtgatcaaccttatggggcttaaatttgaaaagaacaaaaaagtattatctataaagtgaatatattatagatatatattctatatatctgccatgagttaactatatatatgtaacaatatatattgccatgcaatataaattgttgcatggcaacaataatataacattattccaacaatgtatataacaatatatattgccatgagtaacaataaaccaacaatgtactttgtttgttttttgaggcacggtctcactctgtcacccaggctggagtgcagtggtgcaatcttggctcactgcagcctctgcctcccaggttcaagtgattctcctgcctcagcctcccaagtagctgagattacaggcgaccgccaccacacccagctgatttttctatttttttttagtagagatggggtttcaccatgttggccaggctggtctcaaactcctgacctcaagtgatccacctgccttcggcctcccaaagtgctgggattgcaggtgtgagccactgtgcctggcctgtttgtttgtttgttttttatttttatttttattttttttgagatggagtcccactctgtcgcccaggctggagtgcaatggtgcaggctcggcttactgcaacctccacctcccaggtttaaacgattctcttgcttcagcctcctgagtagctgagattacagatgcgtgctaccatgcctggctaattttttttaatatttttagtagagacggggtttcaccatgttggtcaggctagtctcaaactcctgacctcaaatgatccgcctgccttggcctcccaaactgctgggattacaggcgtgagccactgcaccaggcctaacaatgtactttgaaataattttaggtaactatatatggtatcctctaatttcttgtcatatagttgtttttccatcttgttttatcataaatctgattttggaaaataaaaaataatatttaaacactaaatccaagaataaatctctcttggtagatcaccaaagcagatactttaaaacagtgggttaaaactgttccaggattgtgttttctactactaaagggatgtaataacctttgagtcacactagtccagccttctttcttatgattctcatcccaaagtaggcttaacatgagacagaatttattttggatgagtactgagccaaaacagtatcacgaaacggcattctatagaatgggaaaatatttgtaaattatatatctgataaaagattcttatccagaatacataaagaactcctacaactcaacaacaaaaaacaagctgactgaaaaaatgagcaaaggatttagacatttctctaagaaggtatataggcgaggcacagtggctcatgtctgtaatcccagcactttgggaggctgaggtgaaaggatggcgtgaacccaggagtttgagaccagcctgggcaatatagtgagacctcatctctacaaaaatttttaaaattagctgagcatggtaatgcatgccagtagtcacagctacttgtgagactgagatgagaggatcacttgagcccaggaattagaggctgtaataaactgagatcacaccacggcactccagcctgggcaagagagcaagaccttatctcagaaaataatctatgtctgtccttttttactaaggacatgttaactctctcattttagaactggtttattcaaaggcaagtaatgttctcttactctcctaactccctggtcattccttggaaatttagtaatggaaagaataaaaattattctctctcaagaggaattaatttagtttaaagcttaacaggaaaacttagtaataacttcaatgaggttcattgaggaagatcaaccagtatttcaatatgaaacaattgagtttataggtaatatttttttaccttttactttgaaaaacagaaaaaagttacagaaatagtggtgagcacccttcacctggactcactttttttttcttttttttttttgagacagagtctcactgtatcgcccaggctggagtgcagtggtgagatctcggctcactacaacccccacctcctgggttcaagcaattctcccacatcagcctcccaagtagctgggattacaggtgcacaccaccacgccattctaatttttgtattgtttgatagagactgggtttcatcatgttggccaggctggtctcaaactcctgatttcaggtgatcctcctgcctcagcctcccaaagtgctgggattacaggtgtgagtcattgcgcctggctaccagttgttaacattatgcaacatttgcttgttatcattcctgttttttttagacagagtctcactcttgtcgcccaggctggagtgcagtggcccattcatggcttactgcagccttgacttcccaggctcaatcaatcctcccatctcagcttcccgagtagctagaactacaagagcatgccaccatacccagctaatttttgtttttttattttttgtagagaaggggttttgtcatgttgcccaggcttgctttgtcattctttttgtgtgtgtgtgagtatattcataacataaagagcttgcaatctctattgaaagaaatctctcaactcttaaaaaagaccataaagaggattttactacatatttactttttcagtactgacatatgattcaggtacatatgaaagaaagttaataacagttaactttcttatgtgtttttttttaaagttagtgttttttttaaaaaagcacgtaaagaaatatgatcacgggttttttgtttgttttggggtttttaggttatttctttttagagagggagtctcgctatgttgcccaagctgatctcaaacttctggcctcaagtgatcctcctgccttgaccttccaaagtggagagattacaggcatgagcccgtgtgcccagcctagtcataggttttaatggatttaatttcccaccaaattaccaactccactcttatgaaaatctagagagtttattactaataaaaaagaattgattacatgttttatttcacacctagactgaactcctagtacagtgaattagagacaaattcataatttattgaaattccccttgctgtgggcacatatgtccatagtagatgtagcatttggtaggagtttcaagaaaagcagggtaaatatttcagtgaagtctcatacagagttaagaaaaaacttacatgaaatataaaatcttagacaggatacacttatagacaactaaggataatgatgagtatcaggtagcaaggaatatattcttcagctaggttcataagatattacccattaaagctaggcgcggtgggtcatgcttgtaatcctagcactttaggaggccaaggaaggtggattgctggagctcaggaatttgagaccagcctgggcaacatggccaaaccccatctctacaaaaaattcaaaagttagctggatgtggtggcaatgcctgtagtccaagctactcaggggttggggggttaaggcaggaggatcgcttgaacccgggacatcgaggatgcagtgagccgagatcgtgccactgcattccagcctagttgacaaagtgagactttatctcaaagaaaaagaaaagatattacccattaataaacaatcacttttatttttaattttaagcatatgtagcaagggtatcttttctctttgacctcttttccagagtacactcatttcattttatttcttaaactcagtagttatccagtttgttttcaacatagaaagaatccctttcaactcagtggtcatcagatttagacacagaccagtgttttgcgtagctgtgtctggtgtcatggtagagccacggggtattagtgtagcaaaaaagcagagactttggggtcagagctcctgggtttggatataaactctcctatttatattgggcaaattacttaatttctctgtgcctcatttccttcatctgtaacatatgattatagtacctcgtgttacagagttgtaataaaaattaaataagctaatgcataaaagagcgtgcacagagcagagctcaaaaaacattcattattggtctaaatacttaacaaaatcatacagtagtcatttattccagttacttctgacaaccacctagtggatacctaccacatgcaggtaaactgaaaaggaataaaacatgtccctaggcattaagatgtttacaatttagtgaagaaaatagatgtcaaacaaataattacaatattataagagcctaatagaggtagtactatgagatcaatgaagcaggagttactagctctgcttagggaaggcagaaaaaaattcctattgatttttcctttgttcagtggagtaaaaaaaaatacataatggttttgggtattcgtcctactgagagagagaacagtgtgtgcgcgggtgtgtgtgtccttatttatttgcgggagtcatgaaagacaaatgcttaggaactctccagaataaaagagacaatagaaacatgacaatttagtgcttcactgaccagttcctgttttgggggaaaatattaccttaaaggatgttattaaaacagttggcaaaattggaatatacactatagattagattatgcagtagattactcggtgttaaatttcctgaagttgatcactatactgtgattctgtaaaagaaaatccttgttgtaagatgagctatgagaaatattaaaggagtaaaggagaatgatactatttgagagtaatttgtgatacatttgacttttccttatattccaaaaactactgcaaaaccattcagccgtagtcccccttcctctggaaggaactgagtggatagtatcacaactactaaaaaaacgatctgcacacactggcacacagaatgatgaagcatgtgacaaaatgttaaaaattggtgattcagagtattacaggagttatttgtgttacttttacaacttttctataaatttgatatttcaaaagaaaaaatttaagagggaaaaggcataatcagaaggcatcttcaagaggaagcatttcaactgtatcctagtggctaaattcaccgggtggataaggaggtcagagactgttgtgtagaaagcgaatgggggcatgaaagtacattacttgtttgcacatagttcagtacagtaatttttcttttctttttctttcttttttttttttggagacagaatctcgccttatcacccaggctggagtgcagtggtgctatcttggcttactgcaatctccacctcctaggttcaagtgattctcatgcctcagcctcctgagtagctgggattacaggcatgcaccaccacgtccagctaatttttttttgtattttttatttttattttcatttttttgcgggggacagagtctcactctgtcacccagactggagtgtaatggcacaatctcagctcactgtattctctacctcccatgcttaggtcatcctctcacctcagcctcccaaatagctgggactacatgtgcacatcaccacgcccggctaatttttgtattttttgtagagacagggtttctccgtgtggtcaggctggtcttgaactcctgggctcaagtgatctgcccgccttggcctcccagtatgttgggattacaagtgtgagccaccttgcctggcccagtaatttctgtgtaagatgtttggaacacattcttttaagtatctgtagaatattagttggatattcattaatatgatgtttatcaaatctcactgctgaaaattcaagaaatatttagcaaattatcagattattatgccaaacagagccgttgtttaatatacttccattaccaggaaatcccactctaaatatcctcaattttgttctcctttacagcttataattattacatggttatttaaaaatgacacgtggaagagtttgagcagccttaagaccaagtagacaatgaaaatcatacctttttggtaggatatcactactggtgataatttagatatttggataaacaaaaacaagaataaaacagttctaattaagtgtttgatgtcatcaacattcatatttattaaagaaatattttagagtggagctgagaagactttctgtaagaaatctttaaagcagcaaaataagtgattttgccagtaactttcacctgtagaagtcagaataaccaagcacagatcttttttcaaactttctatgatattttgactttgcttccatcctttctattgcttagtctagagattaaggtattacttctaataatagtcatttacattatttatgttgctaatctcttgatgacaagacctctacatgtgtcttgaaataaaatcaaatggctctgtgcttcatatagagactaatttctaagacataaataaaaggtaatggacaaagttgtcaaacaatagccagttagttctttgctgaggaaagggaaccattgctgaatgcttttgagattgctcttggaatataaggaaaattttaatttatcacaaaatctctaataagttaaagatcacaaaatagatttaagtttttaaaaattttctgaagtgatcataattccccatatccttgcataaatatatatttataaatacataatatatataatatctatatgatgttccactttgaactcttctttcaaaagattaaaacagtttgagggcagcctgggcagcatagtgagaccccatctctacagaaaaattaaaaaaaaaaattagccaagcatggtggcacacatctgtagttctagctacttgggaggctgagatggaaggatcacttgagtccaggaggttgaggcaaggctgcagtgagccatgatcacctcaccgtattccagtttgggtgacagagtgagaccctgtctcaaaaaaaaaaaaaaaaacaaaacattggagcacaatacaatacaatctgaattatttattataagtaaatttgctttctttctgagagtgaaatacaagagaacattttggggcaaatgaaatagaaccagagttttagagattaataagtcagtttctaaatcttctaaagattgagatagaattaattttcatggtttcttgacatttcatattgtaaaaaatagcagtggaatcctttgagagatgctgtttacggaaaagtttatgatagattgaagtgttaaaagttagtacccttgattatgttatataacaaagatttgtaaacttgaaattgctaaaacaaagtaatcattagagaatatgaaatagtttatagttacttattttctctattcatagttgctaatgaataaaagtaagttgtaagcttcatgctttaggtgttttaaactttttaaatatgtttggaaaatgtggcctggcacagtggctcacacttgtaatttcaacactttgggaggcagagatgggaggatagcttgagtccaggagtttgggaccagcctagtgagaccctatctctacaaaaaataaaaataaaaaaattagctggatgtggtggcatgcaactgtggtcccagctactcgggaagccttatgcccaggagatcgaggctgcagttagccctgccactgtattccacccttggtgacggagtgagtaagaccctgtctcaaaaaaataaaaaataaaaataaaatgtccgaatggtttttacagttgcttttttttttcctgattactatgctcatgttagtttatatctgtattgtgtttatgtttatagaaagaaggttgggccaggactggtggctcatacctgtaatcccagcactttgggaggcagaggcagaaggatagcttgagcaggtgttcaagaccagcctgggagacatagcgagaccctgtctctacagaaattttaaaaattagctgggtgtggtggcattcgcctgtggtctcagctacttgagaggctgagagtggaggatcattagaacccaggagctcaaggccacagtgagtgagatcctgtttcaaaaaaaaaaaaaaaaaagaaagaaaaagggttggtttgagaggtcagtaggtatatataaaattatagctgtttttattaagtatatataaaattaacttagagttgataatatttgttgctgctttttctattactagaaagttgggggaagaatcaaacaatgcagttttgatttttctttctgttttttcttagcaattgaaagcatgtagtgaagaacaagaagacagagaatgtttgaaccaagctattactgctctcatgaatctccaaggtagcatggaccgaatttacaagcagtattcacctagacgtcgacctgggtaattccaaagtgttgaaaacgtgaatgcctctgcttacttcgctgtctctgatgcctggttttcaaagaagtgtgatttattgtgatagttacattattgaaagttgtgcttgtcatacttttatatacttttatgttggtcttttactctcttttttccttttcctttcctttttttttttttgagaaggagtctctcttgcccaggctggagtgcagtggtgtaatctcagctcactgcaacctgcaaccttagcctcctgcgttccaatgattctcctgccttcgcctcccaagtaactggaactacaggagcccaccaccatgcccagctaatttttgtatttttagtagagacggggttttaccgcgtcggccagactggtctcaaactcctgacctcagcctcccaaagtgctcggattacaggtgtgagccgctgcgcccagcctttttttcttttttttaagagacagggtctcactctgttgcccaggctggagtgcagtgatgtgatctcagctcacagcagcctcaacctcctgggctcaagcagtcctcctgcctcaaccctctggagtagctgggactcgagtagctgggtggcacatgccaacacacctgcctaatttttgtattttttgttgaaatagggttttgctatgttgcccaggctggtcttgaactcctgggctcaggtgatctgcctgctttggcctcccagagtgttgagattgcaggtctgagccactgcacctggccaacccagcctagtcttaagattagcattgttggctgggcacggtggctcacgcctataatcccagcacttcgggagtccaaggtgggcagatcgcctgaggtcaggagtttgagaccagcctggccaacatggtgaaaccccatctctactaaaaatacaaaaattagccaggcgtggtggcaggcacctgtaatcccagctactcgggaggctgaggcaggagaatcacttaaacctgggagggggaggttgcagtgagccaagatcgtgccattgcattccagcctgggggacaagagctccaaaaaaaaaaaaaaaaaaaaaaaaaaaaaaaaaagattagcattgttatattattaggatagacttaataaatgtttaaaaatataatctatgaaagaaatttaggattttttgtaattttagttcttatagagccagtagtacttctctttcataataatgaaattgagggctgtattatttagtggcaaagttagaactaaatgctgtgcgtaaaagctactgtttggttatttaatattttactcacttgatttgagatggtttatgcttgaaaccatttgggttgctagctattgaataagctatattgtttgttttttctagagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcaggtatgtgaaactcattacaactgctgacctagggcctgggacccaaaagctttttaaggatgctcaaaaatatttgaggcttggggaaaaaatggattgcctccaaaatataaaaatactgcaaaaacaaaaggaataaataagagaaggaattaaaggtctaaaaatgtaatattgttaacttcattaattattgaataaatattcataaaatatgcatattcatgaattttttttttttgagacagagtcttgctctgttgcccaggctggagtgcagtggcgctatctctgctcactgcaagctccacctcctgggttcacgccattctcctgcctcagcctcccgagtagctgggactataggcgcccgcaacaatgcccggctaattttttttttctttatttttagtagagatggggtttcaccgtgttagccaggatggtttcgatctcctgacctcgtgatccgcccacctcggcctcccaaagtgctgagattataggcgtgagccacctcacccagccatattcatgaatttcaaatttgaaaacaatcctcgcttattaaggatataccatagtatattctctatgtcagtatttctctatgtatggcagggataccatggtatcctgccagtaccatgattgttaggaaaagccacaatctgaggagccaaagtaaaaagaaaaagggaggaaggcctccaaatatggtactttgagttaattaaactgaatacattaaacatgaaacctattttatgctctgccttttcagatcccaattttgttcgtacttttcttaccacatatcgttcattttgtaaaccacaggaattgctgagcttactgattgaacggtaagaaaaatatgtatttcagttatattgacattttgtgaaaaattaactgtattttgtaaagtgcctagtacctaataaatactcaagttaattattgaacatattttatttggcattaaattggcagtattactattctcttcaaatggagtactccctaaaatctgtttataaacacagatcttttcagctcttagaaatatttcaagtggtaatcagaaagactaatttagaggatgaaagcactatattttaatgaatattgttctgtgtaataaaatgatattttcttaaaagagacttttctacttaccactatttttttttttggaccgtagactactttgccaaatactttccacttttaaaacaaacttgttatgaaaactttcaaaacacatacaagagcagatacaagaatataataaacccatttattcatcaaccaccttcagtaattatcaactcattgtttcatctgtttccctacaaatttaaacaccccaccccatgattattttgaagtagatcctagacaacataattcatctataaatatttttctatgtatctctagaaaatacgggatcatttttaataatcagatatcattactaaacctaaaaaatcagcaattcctttattatgattaacttttaaaaattagtgttgggttgaatttgttttacctagtattatagtggcattttaaatgttttatagtttaaaatgtagaatctggactccagaatgatttttagttttacgttttaaaacttactaaaacttattattataccaaagcttattaactgtattatcaagatataattctagatctctatcactatgttgttttatcaaactaaatttaccagactgagtcagtgtaatgtgctatgaggatctacttagttgtttccatgtccagaataaggaaagcacacgttagacttatagtttagctgtatttcctatgtttgagcaaggttttttatctttatcttatccacttaggtaaattatttaaatattgttaaatattcggttttggccctctctttgaatttgtactcatttaaataaatttattagcctactttcattttaataatataaatattaaagacattgttagataagcaatttctgtcatgttctttaaattccttatgaattctttccttggctcttttccctggaccttttctgtattatcagtgctaaaagacaaaactttagtttttataaaagtaagaatacaaaacgtcagttttgtatagccaaaggacagttttttgtagtatatcatacctcaagggaagtttaacagtaatccacttttcgtggaagtggtaggaaagaaggttgcttgctgttttcctccttgtattttcattatgtatgaacggatttttctccttttgcttttcttcttaggtttgaaattccagagccagaacctactgacgcagacaaattggcaatagagaaaggcgagcagccaatcagtgcagaccttaaaagatttcgcaaggaatatgtccaaccagtacaacttaggtttggcttgaatattttttatatatatatatacacatatatatatacacacacacacatattttatgtgtcagttttcaatatatagttaacacaaaagctctcagcttttaattcaaatatagggaatatttttaacttcacagcagttaagttaaactaaaagagttctttctcagtgaagctattcttaaataccctgaagaaattcaaatatttaaatatcctatgtttgcatcacatatctctggcatgtgatatgttatgcttacgtatcaggatacctattttttattgtaagtaaaaattataaaatttcatgtgagctttcctgctgtcaaccttttttcacacttttttccttcatttccctttgcgatcatacagtaatcctggctttttttacaatttataatatttgtggaagttctagcccttttcccacttatctctcacaaaatatatagacatttgttagtttaattgcaataatttctaaaaatgtgtttgattgtagaagcttccagttaataaatactactgtgtgccggggattaccctaaatgctttatcttttttatctcattcttacaacatgattactattcctactttatatataaggaaattgaaacctagcaaggtgaagtaatttgagctaagttatgtaaagggagtggcaggacaagattcagactcatgtctgactttctttgcgtgtgtgtgtgtgtgtgtgtgtgtgtgtacgtaccactaagcattgaaaattggaagcgccttctcttagccctctttactgtccaagtaaccaaagtattatcttcctccttccattggaaaccaagttatcttattaattatatgtaatttaaattttttttctctctaaatttcaagtttccttgattactgttgaccaataaattgtaattttggaactgagtatattagttatttatttcccaggataattgccacaaacaaatgcagttttagaagaatgatagtgctcccagctatatgtctttcactaaaacttttaacgtcattctttgtataagaagatgagattatttatgtatcagcaataaataagtaattcttttctactagctgtgatgcatttgtacttatctacaatcacattaaatcccttgatatgacacatacatttatgaggttgctattgggtggggtagggggtgggagtataatcttcgtttctcagtcatataagctctttatgtatttctaagcatttgctgtgttctcagtcctgtacttataactatgctaagtacaaaaataacatagactgtcatgatattgtggctttcttggggactttactgggggaaaaagacacatgaaacagttatatattgttctacttggagtgcttaagtgacttagaaaaatacatccctatacaatttcaggaatagcaaagattaggccagagtaattagggaaggcatcttggagaaggtaaaatctgagactgcccctaaaggatgtataggctttagataggtagaaaggtgactgtaggtattcagggtcatgagaaatagtatgaacaaagacaagaaggcagaaatgagaatggtgtgctgaggacacagataaggacattgacctgagaggaatgtaggcattgtattgcaagtagtagatgagattacctgtatggaattggatggagtggaaaactgtgaaatccaagccaagttattaaacctgttatataaatattgaaagatttctagtaaaatgggtggtagtaatttttctaacattttattatgaaaaattttaacatacagcaaaactgagaattttacaatgaacacccataaacccaccacctagatatgtattcatctattcatatctattcatttatgtgttcatttatcattcatctatcagttcatttttttgtatgaattttgaagtacactccttaaatacttcaacttgtatgtcattaacagttcagtgtttgtttttcttttgttctaaaatgtgcatataattaaatacatttttttcttgctgccactgaagacagaagatacacacatcttaagtgtacttttgttgagttttaacaaatacatgtatctccataatccaaacgcctttcaagatatcaaatgttactacaccccagaaagttcccttatgttccttctcatcagtttttgttcccactgcccaaaggcagtgttccaatttctccctccatagattagttttacctgttttagagtcttaataaatgcattcttaaaaactcaattttgtgtcttctttcactcaacatgcttttgaatttgtatcaatggcttattttattgcgaggttgtgttttattatatgaatataccagtttattcatttttcccattgaaagatacatgggctttttctcgttttttattattatgaataaagccgctatgaactttatcttacctgtcttactgtgaatatttttcacttttcttgggtaaacaactcagagtggagtggctgggtcagaaggtatgtgtatgtttagttttgaaagaaactgccaaaacttccaaaacattctcaccaacaatgttcaagttgcttcatattctcaccagtgtttagtaatgtcagtctttgtgccttagccatactgctggatgtagtggtatttcattcatacttattttgtggagaatctgttcaaatcctctaatttttgttgagatacttgtctctttattactgagttgtaggagtaaattgggtaggactgaatgccagtcctttgtcagataaacattttgcaaatattttctttccatggcttgcctactagtttccttccttccctttccttttcccttcttcctcttccatttccctcctcttccctctccccttgtctttcctttcctttccatttgcatagttgattaaatctctctttgcaaggttataggtaatcatttttgtgatactgtaaaacaaaacagttctatttttgtcttttgaaatgaaataagagactgtagtatatgtgtagattacatagaaatttgatgataggctgggtgcagtggctcacgcctataatcccagcactttgggaggctgaggtgggcggatcacctgagatcaggagttcgagaccagcctggccaacatggtaaaacgtcgtctctactaaaagtacaaaaattagcccagcatggtggcgggcgtctataatcccagctacttgggaggctgaagtaggagagtcacttgaacctgggagttggaggttgtagtgagctgagatcgcaccattgcactccagcctgggcaacaagagcaaaattccatctcaaaaaaaagaaagaaatttgatgatagcacttgcatttagaaccagatacagtacatcttagttggttttccattttaagtgaaaaagtaccaaaatttaaatcttaaaaatgctttttatgaacttaaaatagcttttgtaatatagagcataagttttctacatatgaataaagggtacttttccttaacataaatgggaagcacagaaaccactatttttatgcttataaatattttaaaagtatacattttattaataaataatacaccgtttggagacctactctcctcttgtcattgaagcatttaaagtattaattaaatacagattagagagtctttgagtattatgttgacccttgtatgtaaagctattatcgtggcattagagaaggaagaagtgtaattgaacacttacgtttcactaaaatgtgtttctttccattttatcaggatcttaaatgtatttcggcattgggttgaacatcatttttatgactttgaaagagacttggaattgcttgaaagactagaatccttcatttcaagtgtaagaggtatattatataaaggtttgattgaatcttatattgaacatgagtttatgttcaaatttgtgtgactttaagaaactaaaacatttctctctctttttttttttgaaacagagctttgctttgttgtccaggctggagtgcagtggtgccatctcagctcactgcaacctccgcctcccaggttcaagtgattcttctgcctcagcctcccaagtagctgggactacaggcacatgacatcacgcctggctaatttttgtatttttagtagagatggtatttcaccacattcaccacaagaccagcctggtgtcttgaactcctgacctcagatgatccacctgcctcagcttcccaaagtgctgggattacaggcatgagccaccatgcctggccagcatttttcatttttaaaaagctgaaataacatttggaatgttttttatagacagcaagaaactcacatatgtttagaccaatcatctgaggtctcagaactttgccttttcaagtttttgaggagaatatttcttttaaagaagtcgaaagttctttttaataaatttaagctatttaattttatctcattgcaaggttgccatttcttcaactgaataaaaatatgtgtaattttatgttttctttctttaatcttattcttttaatgattaacagctttcttataatatttacatcttctggaaatgtttttggtatatttctgaaatctgaaagagaggagttttctactttaagtttcagaatcatagcccaagaaatgaaaccctaggccatgaacatttaaacaaatgtgtcatcaaatgtatattattgaatcaagaacatttatgttttatctgacattatagggcattacaaatactataacaagtgtaacttatttcgtgttctacttgttctttaaggggaatattatttaaagttaagaatgttattcctttgtttctactttgagatgtttatgatacatttttatgtgtgccttgaaattgtcataatactacattttcaagttgtattctaggccactgcaatggctcacacctagaatatcccagcactttgggaggcagaggcgggctgattgcttgagcccagaagtttgagaccagtctgggcaaaatggcaaaacccagtctctacaaaaaatatgaaaattagccaagcatggtggcatgtgcctgtagtcccagctactcgggaggctgaggtgaagcgatcacttttaagcccagagctcgaggctgcagtgacccgaaattgcaacactgcacacaagcctgggcagagtgagaccctgtctcaaaataaacaaaaaacaaaaatttatattctaaatgagaatactggattagacacaatctaagaagcttctaaaatacacacacacattagaataaattaagtaaatggttatgttaatgtccaaagttcttttctatactagttatacttcagaataaccaaatagttcatgaggaaaagtttatttttgtggaagtatttcaactagtaagtgaagaaggaatggtagaatatcacatttctcaggtcctagtaaaataataaacctagggaattatcatgactggatgggtactatcacaaaaagttaactagacattatatgcctcctgttagaagtattcttggcaagtatttgtgtcataaaattaatcctgaatcagaccaagtcactatatctctgctttacagaaaatatagaggacagaaaaacatggcaaatgacaatttcttccacaaagtgcaagcaaaaatatgcaataaagcagtaacctgtagattaaaggagacttgagacacattgactcagtgcaatatgtgcaatcttgttcagatcccttttcaaactaaatataagaaaatatggccaggcacagtggctcatgcctgtaatcccaacactttgggaggccaaggcaggcagatcacttgagcccaggagttcaagaccagcttgggcaacatggataaaccctatttctactaaaaatacaaaaattaggccaggcgcggtggctcacgtctgtaatcccagcactttgagaggccaaggcaggcagatcacgaggtcaggagttcgagaccagcctggccaacatggtgaaaccctgtctgtactaaaaatacaacaaaattagccaagcatggtagtgtgcacctataatcctagctactcaggaggctgaggcaggagaatcgcttgaacccgggaggtggaggttgcagtgagccgagatcacgccattattctccagcctgggtgacaaagtgggactccatttcaaaaaaaatacaaaaattagccaggcgtggtgatatgtgcagtcccagctacttgggaggctgaggtgggaggatcacttgagcccgcaacatggaagttgcaataagttgagattgcgccactgcactccaacctgggccacagagcaagaccctgtctcaaaaaaaaaaaaaaaggaaaataatcagagagagaaatgtgaacagtgacaaaatacttcaagataacaatgtattaagaagttgtcagttttatgtgtgataatggtgttgtggttattactttaaagagtgttttaaaggtgcttaaatatgaatgaaatacgatgtctcggatttgtttcagaataacctaggaagtgacgggatggcatgagtagggttagagaaaataaaaattggccatgagttggtaactgttgaggctgggtgaaagttaaggattaaatgaagatttgcagtcatgtctgtcaagtaaaagacatttttctttatgtgttctttttccagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggtagacaattaatgttaatgtcttgctttatttttaagaatcttgaacattacctattttcaaaacattttgcacattattcatgagtgcttaaaaatacctcatctactctcatgggcttagaggaaaggtcatagcacagtttttaactagtctgccctgcaagtaaaagtcttatgtctagactggggactagcaatccattacaagaggaatggcaggaagattttcaagtccaccacccctcttcaactcctaataccttctcaccttggtttagtttgaggtcagtcagtcaagtcagttagtatggatgctaggcccttagcagctaagtgaatagaatattgtgtgagatgggttttcttttctcatttacagctcaggctgttgcgaagggtacaggccttgcatgtaacagctctctgtcgaaaaatgtcactatcattatcattccatcaaaaactttttctacaccaacctctctgttttcccctcctcccagtccttcccagccactaatacctgcagttctactctctacttccatgagttcattttttttttagttttcatatatgagtgggaacatgttatatttttctttctgtgtctgatttattttgcttaacataaggtcctccgggctcatccatgttgccttgaacgacaggctttcattctttttttatggccgaatagtgttccactgtgtatatataccacattttctttattcattaatctgttgattccatatcatagctattgtgagtagtatagaagcctcaatttaaaatataaatgtgcttggctgggtatgatggctcatgcctgtaatcccagcacttaggaggccaaggtgggcagatcgcttgagaccaggagttcaagaccagcctgagcaacatggcaaactccgtcatacaaaaactacaaaaaatagccaggcatggtggctcgtgcctgtagtgcccctgtagtcccagttgcccaggaggctgaggtgggaaggtcacttaaggtcgaggctgcagtgagccaagattgtgccaccgcactccagcttgagtgacagagtgagaccctatctctaaaataaaaatattttcatggagttatcctgattagcagccaatttttaaataaagattacacagggaaaagcaagaatatataaaatttagtgctaataggtaatatagtaaggtacctttactacattatgtttactttatgttctttagaatttgcctagtttgcactggccatgccattcagaaccagacttttagcacacccaccagaagttgtcaacatctgactcaaaatgttatgttatattttaagtaatttagaatccaggtagctttgtttatgttgtgggatttgtgatacgtagaaatgaagggacttgttacttgaggtaaaaaaagcaaatagtactgcatcatgttttttctcacaatgtaattgttttacatgaatggacatcagaaaaaaagcacttcacttcatgtggacctactttcaggacatagaaaaatacctaatactgacttcatttgtaaactaaattttttttttttttttttgagatggtgtcttgctctgtcacccaggctggagtgcagttgtgcaatctcggctcactgcaacctgtgcctcccaagttcaagtgattctcatgcctcaacctcccgagtagctgggattacaggtgtgtgccaccatgcccggcttttttatatttttagtagagatggggtttcaccatgttggccacagtggtcacgaactccttacctccagtgatccacccacctcagcctcccaaagtgctgggattacaggcatgagccactgcacccagctttgtaaactaaatttctggtgaaataatagagccactttaagaaaacatttcagaaactgttagcaagtacttatttatacacaaatctactgattaaaaaatatttttttaatgaataaccaagtctgtaggccattgatggcaatgccaccagtcaattaaaaagaaaaaaaagagatagggtctcactgtgttgcccaggctggccttgaactcctggcctcaggcagtcctcctgccttggcctcccaggtgctgggattacaggtgtgagccactgtacttggccaatttttaaattgtgtattctgactcactgtatacaatgttttaatctgctcttctgtctgaattttaattaaatactcaggcattcaaaaaatataggaaataatataatgaatattcatgaacaacaaaaacattttagataaaattgaaatcctttgtgtaattctcccaaatcttattgctctctttcccctaagaaatcactaccaccctgaatttgatgtttactatttctctttatatttttaaaatttataaacatacacggagattcataaacaacgtatagcattgttgtacacttttttttttttttttttttttagaaacagggtctcactctgttgcccaggctggagtgcagtggcacaatcatagctcactgtagccttgaactcctgggctcaagcaatcctcctgcctcagcctctcgagtagctagaactacaggcacgcaccaccatacctggctaatttttttaaaaaaatttcatagagatgaggtcttgctatgttgcccaggatggtcttgatcttggcctcaagttgtcctcccacctcaacctcccaaaacgccaggattacaggtgtgagctacagtgcccaactggttttttgttgttgttgttgtttgtttgtttaagatggggtctcactctgtcacccaggctgggatgcagtggcatgatcatagctcattgcagccccagactctaggctcaagcagtcttcccacctcagtctctcagtagcaggaactgcagggaggaaccactgtgcctgttttttttttttgttttatttttttgagataagatctcattatgattgcccaggatagtctcaaaccctttgcctcaatcaatccttccacttcatcctcccaagtagctgggattataggtgcgcaccactgcacctcagcttgttttgcactttttttaaactgcatatacttatgtatcattctgcaacatgctttttacttaaatcatttttggcatttgttcaagtcaatgaatacagttctagttagcttattttagatgctgtgtagtgttccgttatatttatactccacaatttatccagtctctggatgatgagcctctattcactcttgtaaataatgcttcactgaatattcttgtaaacgttttcttataactttgttttttgtttgtttgttttgagacagagtctcactctgttgcccaggctggagtgcagtggcatgatctcagctcactgcaaccctctgcttcctgggttcaagcgattctcctgcctcagcctcccaagtagctgggactacaggcacgcactactacgcccggctaatttctttgtatttttagtagagatggggtttcgccttgttggccaggctgttcttaaactcctgacctcaagtgatctgcccgcctcagcctcccaaagtgctgggattacaggcatgagctgctgcacctggctcttataaatttgtgtaagagtttatctagggtatatgcatacttaagagtcaaattgctgagtcatccgatatgtatctcttcagtactatgagatcttgccaaattgttttacaaaatggttgtatcaatttttacttccctattggtgttcctgttttattatatttttatccatttggaattatcagacttttttttcgtttctttttttctttttttttttttggagacagagctttgctcttgttgcccaggctggagtgcagtggtgcgatctcggctcaccacaacctccatctcccgggttcaagcgattctcctgcctcagcctcccaagtagctgggattacaggcaggtgccaccatgcccggctaattttgtattttagtagagacggtgtttttccatgatggtcaggctggtctcgaactcctgacctcaggtgatccatctgcctcggcctcccaaagcgctgggattacaggcatgagccaccacgcctggccttgagttatcagacttttgttcatctaatgagtaaaatgggatttcattgtagttttatgttattttccctgagtaagggataaagtgtgttttcgtgtttgtagctatttggatctattcctctctgaattacttgttcatatatgtgttcatctgtcttttgggttagttgtctttttcttattaagttttagaagatctttaagtaatacaaatcctttataggttaagttgcactgattttcaattccataggaaagttcaaccgtctgaacttgtagggagtgtgtggaccaaagaagataaagaaataaattctccaaatttattaaaaatgattcgccataccacaaatctcaccctctggtttgaaaagtaagttttaatttactcttactacctcctaatagccataatattaagtcatatttaagctaaaattctggctactcataattatcttgttttctaagtgaggtgaagaaacttttctaagccatgaatttttgttgttgttagatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggtaagttttaggcttaactttttcatttttctcggggatgataaaattagcataaaagaaatttcatctatcatctgtctttttaattaaattctttgtaaattcatccttgcttcataaatatgatataaatatattagaaaatatgttgatatattagttaatatatgaatatgatatataatatgtgaatcctaggcttatattagaaaatatatcaatattcaataaacaatatgagacttgcactgccgtgtaatgtacttaacctaaatgtaatgaagttccaagtggatttattcaataacacattgattgatagtctcaaatgacaaaggattttaaatataaaaatacaagtaatgtcttaattacctttaggtagtcaacaatagtataacacgggaagaactatttcaaaaacttaaatttggccaggcgtggtggctcacgcctgtaatcccagcactttaggagg

SEQ ID NO: 1341 - DNA, 4002 bp, Homo sapiens
atgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctga

SEQ ID NO: 1342 - DNA, 4002 bp, Homo sapiens; identical to SEQ ID NO: 1341

SEQ ID NO: 1343 - DNA, 46456 bp, Mus musculus
  misc_feature (1)..(2876): "n" at positions 1 thru 2876  can be any base
  misc_feature (23821)..(24010): "n" at positions 23821 thru 24010  can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgcaatctccattaaaaagcttggatctgatttgtgttagctagctattcctgatcatgaggccaggcctggagtatggatgatgtagccagtgtcactccatgaaaacaatttggtgtgcccctctctcaccagctgtcaatttcagatagctttttggctaggggagggactttgtgcctacttctcctctgtgctgggattttgtctggtctgaacttgtatagaacgagtgcgtgctgacacagggtctgtgagttcatatatgcacccaccccattgtgtctggaaaactcagtttatttgaaattgttgaccacctgtggctcataatcctcttctggaatgttcctcagccttgagggaggtttgtgatagagatcccagttagggatgaggattccaaagtcattcattgtattagtcaggattcgctaagtaactgaactgatagtatgatgttgtgtgtctcacacacacacacacacacacacacacacacacacacacacacaaaccatatgggatttatttgagtggtttacatgtggtgcaagaggtccagcaatgtctgtctcctggtggaaagaccaatgattctggaattgtttagtccacaagacagtatgtttcaacaatcctagtctggtactggagtcgtagggaaatcctataaggctgacagttttctaacaccaatgaacaaatggctcagtgaagcgagggcaagcagacagaaaacaggagcttcctcatcccttgtgctttcatatgggcttcgaccagatgacaggggcccagaattagggtggcccttctgacctcaaatgaaccagatttagggtgagtctcccaccttaaatgatctaaccaagaaaaatctctctcagcgcacacagctgtttgggttttagttacttccaaatgtggtcaagttgatagttaagattagtcacctacccttcacacgaagtctgtgtgtcaaataccatcgatagcaagaagcaacttctttggtaagtgttgagtggtgtgtagatctaaagatatgacagtataccgtcagcagttgttttattgctacgttcttttagcaagataatagtagtaagttgtcccctagaatccatgacctatctatcagggctctggggaaccattttttaaaaaagattttcacatttatattatgtgcatgtttcctttatatgtatggatgtatactactagtgggcagtgtgtatgccttgggtcctcagaggccagaaaaggatgtcaaatctcatggatttgtagctacagatggccgtgagacactatatagatgctgggaactgaactaaggtcctctggaagagcagcaggctctcttaaccactgagccacaccttcagctcataagaagtaaaactacagttttcacaccaacttgaacatgggaactgtattttacttattttagcaatcccagtatccagcacaaatttcaacaccgcttgcattgttccaaccaaggatattcagaaatgtcctgaaagatgcatctcaaagttggacattgattgtgtagagttggaagaaggtactgttggcaatatggcaaaaatattaagtaaataaagttcattattcagtagagagtggtaaaagactatgctaaaacagtgtctttttggactgaaaggaccacatagtggacagaatagcctggaccctttctatttggcaaaggcaccccaggaacaaaaaagtgcatcaaagagaagagcctccaggctgtgttgactatctccatgattatttacggcgtacctataccatggataacaatcaaaatcacatggcccttgattttctcatctgaaaattggaacatgaacacttaccagatgtccctgtcaatggaaaattgtcattgtggctagaggccatctgtctggtgcagaggccattcaagaacagccataaagagagttgggcactctccagcttggcacagaggccagacactggtgcacaataaagcccttgcttctgaacactggagccagtccagaccatgttgttgattcaatcaccatttggttaggggtaggtgatttctttttcatagtgcctggttgtaatgtccaattatttgaggtgtgactatacaggaaatctcagccactaaatccatttttagataaggacccgccatgcagctgtcagccatatttgtagatgatggttgagaaattggagagatgagatatggtctggatctagcttctgttttgataagcacagcaggacttattttccccccacaccctccttgggaaagtagaaattagcaaagcttgaagggctccctgctctgcatgaatttggggaataaaaatgtaaaagaaaatccattgaaatagtctcttgattggaatgtgatgatacaatttttgtggatggaagattctacactaggctatggcactcattcgttatggttactttgtttccatttggaagaagaaaccacaactaagagagtttaaacaagtcaccctgctctcaaatcttttcaggggtagccagatggcaagccaggctctctacctctacagtagtatttcaccatactctgcagcctgccctattgggaaattacatggcaggatgaaatagcactcacttggtggagaagtgggtttagatagctctctcagtgtggaagggaatggaggggattcctcagagacagcggttaagtttagtattttatttgtggatttacccattttgtcttggagtccattaccctagcttggacttaggtaatgtcacatattttaaaatgtgatattattctatttctcttaaataagcagcagttattatctgtggagtctcagaaactctattgtgtatctcccaagaaaacatatagcagttagcattttctatgagaaattcatggactctctttaaaattatcctggtctacctacctctgtacccacctccaaggtcaacaaatctctttctttaaatctgattttgacaaatttccggccacatacataatctttagtctgctaatatttacattggtgacaaatcttgtattaaaaagtcatttgaattttctgtctatccagcaagaatttcctggttatatgatattgataatttctattttgcttatcattatatttctaaggtgtgactatgtggtatagtttatatagttcttgtgctcaatatttgtttcagaaaattatagataaaaagtttgggaatgaatctcatacaatagaacaaattgttattggaaagaatttgtatttctccattatatataacattattccatctcttattaagttaaggaagtttgcctctagtttaatttcctaagaattatttttaaaattgtaagactacattagaccttataaattttactttatgcattaagataattttataatttttcttttatgattcatcagtgtggtgagttactgtggtaagccatctaagaggaaactgttcttgcatccctgaggtaaagcctacacattgtgatatatgaccctcattctatcgtgatttattattatttctaaatacactatagaatcatgcaaaataatacttaggatttttgaatctatgcttagaagttaaatgtcctatagtcttcttaaactgataacatctagtttcagaatccagtttataataatttttatttgaaaacttcccgtcagtcttctttgctcatgactatggtgttatattgttagatcttagaaatattcaaattaatctagaattttttttctaattagtgaacttagtattttcacattcattacagcttctgtactattagcatgtaccatttctattttctatactttaaaaatattattttcttattctccatagagatgtccaaatttatctggcttagagataaaatatctatttctgttttcatattaagaatgaaggtggtgctctgctttaaggttgaactgaggtttcttttctgcaccgggttattacatttatctatcgtcttttttgagttgactattcctcatatcaaaatccccaatctgaaatgtccacagatcacaaaatttttaaatgttgatgataccgcaagtgggaggtgtcattcctgagctcatgtgacagacttaggaccagtacagatacactaaaaatattgcctaaaattgccttcagggtctgtgtaagatgtagaacgtgcataagggaacctggatttcattatcaagatagtttgttatatatgccagtgttctaagatctgaaaagaatctgagatttacagtgcttttggtcccacacatctgagagaagattgcctggacctctgtgttcctctttttacaatagtagcaacagtgcaattaagtgccctctggagttcccctaggaccacacaaaacgttattacatacaaagtgtgattaatataaattatattttttgaacttgtgcaagtgtgccgatagtttgttctggaggaattttcttttcccaggtttaagaaaatccccgtaataaacttgatccccgtgtgtgacagacatcctctagtgtttcctgtgacatcctcccaggagcactttccgttcaaatacttcctccaagagcaatgctcatgtggggctttgtaggccctgtgatatttttgttatactacaatatttgaatgacagttgggcttgctttaaagcgacaggttcagggtgcaggagacgtcagttcctaccaatgctctgctgctcactggctgtgttcccttaatacatgacaggttcatgttaatattttacaaatatttcctccctgtctgaatctataatttcactgtgaggcagaacactgccacagcaagtcgctattttgattgctttgtggagctcattatgctgggtctgtggagagacaaataaaaaaaaaatcttaattcatggtgttagaataagacaaccaaaatgtgagcaatgctataggaagggccttctgtttctcctgaggactctgcgacatctggagaaccagttcatttcataaactcagaaaccgagatgagaatagttgcatggaatatttgagggaacacagccagtgatcgggagagcactggtgggaactcacaccccctgcaggcaagccagtcccggtgggaggacacttcccagtaaagcccgaggctctgtgacactgccacctgctctgctagtccaggttgtggtatgtcgtccctgcagcaggtcagcaagtcccttccttcatcatggtgatctaggatggtttggagtgagggctgataatctatctaggagtgaggcttctctattggattattgtgttgtgtgaccagtgtttctcctcaagacctctcctcaagcagaccatccattagaggtgtaatttataacttgattaggtgaagttttactgggggtttagcatactctctgtcttacataggcacaaagataaagcctccatgaggtgcctacagcgtcatgtggcagttacacatgatgtaaacaacgggcataatgccctaggaacagagagaaggggactgatcatttctaggccaggaagttcagggggtgagtcacaaaattgttttgcctgccatggcgttattggtaggaccttgatgaaagaaatggggttgggtttctcttcagatggggaagacagggagagagtaccagcaggtgaggccaataagttaaaaaaaaagtccgggcgtggtggcacacgcctttaatcccagcactcgggaggcagaggcaggtggatttctgagttcaaggccagcctagtctacagagtgagttccaggacagccagggctacacagagaaaccctgtttcggaaccaaaaaaaaaaaaaaaagagcttgcaactggctcactgtgaaaggttttagtgtctcagctctgtggctaaagggtggtactggagtgtgaacctcaggcttacccattccagtcaagtgctaccttactgagcgatagtcctttagggcaaggcttttaacactggagaatgaaggatcagacccagaatgcattagatcactctgaggcaccatggaaggcaaaccagcaaggactctggactaccccgggggtataaccatatgatcttgacctgaaagtaactgggtcactggaatggagcctatgagtctgtttcagacacacagtggcagaatgtagccccatactgtatgtactgcggatggggaatccattactctttctttgagaggctttccattagccgtgttggggtcctaggattatgataagctggtactcctaaatccattaagtcacctttgggaaatcagcttcagttaagaagcctgagtgtctctgtttcttctttgagtgagtcggttccccctttctgtgtacataaccaaccgtctgaaacagggacccctatatttaaacaatattacatgccgccattttgccagggactggggccaggggaggagccgttacattttaaagtggaataaacagaaaagcaacaccgagaacgaggaggctggttagtgaggcttgaagagagggcaggtgtttcctcccatggtgagaatagtgacccctgggaatcgcatttcccgtcgagctgggaccaatggtaaggtcagtcctgtaaatggcctgatagtgtggaactgtatgtgagtgccagagaaagctcggtgctgtctgtattatcctttggacccctcatcgctcaaggagcgctgatccttgacctcatggtccacccttttgcgttcagactctcatgctcctcctatgtggcataacaccgtggctgtgtgcaaatggccgtggcctcctgtgctgtatggtggttagtcccaattggctggccctgtgtctcaagcactctccagccagtgggggccttgggggtgcacacagtgggttgacaggcggtgttgctgaagaaaaaaaagtacagctctgcctgaggtaggaggatgtgatgacgtggcccctctcagcgggaactcgggcctttaaaaagctgaagaaacagcctcagagtaaacggtggttccacgggaggaaagcacgcccagtcacattaaagaagccaaactgtctgcttcaaagagaaaaggcaacatcctgtcacaagccatgctctggcaaaaatgtaagtgctttgcttgtggctgtcagagccaagtaagcagaggcagggtccaggaatagagagctactgttggtgatgggagcacccagtctcgtcagggcctcgggggcatggagggctgaggtgggtgagatggagcctgttggagatgatgctcattttccaacctgggggaatgaaccagtgtcccaaggtggggacagctcattgcatctccgattctgtgcatgaatcactgaggtgacagaagggcagattatgattcatgagacggaaaccacatatgatatgggttaggagccgttcttcacgtgaggacctttcctttcatggaccccagttctgcaggttgttattgagttttgttggcccacttctagctgaattctgccagagttggttccctcctgtagatgtgtaggatggggtagaaactcagtcttatgaaacatctctctctctctctctctctctctctctctctcctcttttcaatttcttccttgttctgtggcaatggttggttttgtgttccactgcaaaaaaaaaactgtttatctttgaccttgatttttaatccctggacttgaatggaacaaaccatgaactgtattttccattctgtggattgaaaagaatcttgtgttatcgataacggaggctatatagacattctttacaacattcctttcacgaggcaaacaaagtcaactcaagagtcttgcaaaaggggaaccttattaaggctcaggactgtacttcctcaagcaaagagctataatttccctatctttctttgtaagatgtttaattccataaaacatcttttattggtttaggcatagcattcctcaatcaaatttatgtgataatccagattagaagaaaaagaaatcgtggttttacttataaaaagtaatctgacaatagtgttccattgattagagtgtgacatagtccccttatcacccacctattcccaaattctttgaaattgactcttttcatctgtgactcagagaagcaatcccaacgtgcctcagtttactaaccccattgttgatatgggcaagacttttttgtttaaataaaaataaatgaactttgatttggacttgagatttctgaccacagattctagtttgggtagcttaggactcatccaaaaaggtgaccagagcaaaaccttatctttctggaagcggagtggcagccaacaccattgtaaatactatgagattgtaggaacatggattttaatgtccttcaaagtgccaatatgccctcttgcttcaagtgaaatcaattgagttttgtgtgagctgcttttagtttttaaactcttagagtttgcatatttagaatggagtgaaaagtaatcccaccatgtataactgctcttaataagttgacggggcggccagaatgctgccgggtgctctgccctggtgttagccctgaggtatgggctgtttgcctgtatgaaaaagcccccatagcatctcattgttacgtaatccattttctctcctccagtgcctcttaagggatgaacagattttctttttgagagttgttagaggtcttgcttcttgctcataaactctcttaaactgtcttttgggggcttgaaggaaaacaagagcaggccttgtgcaacagacctatccctttaccctggtcatatggctgactaagacttgtgggaagtgagtgaagtctaggcagtgccagcgcaggcggggagggcagggtttgaaatcagacactgggagtgctgaaaaggcactttctttttttcagaaaacgcccttcaggcttgagctaaaatgactgtacccagggcgttggagagagttaagaaaacaatcatattgcccctgttgcctcctgcctgcttggcctctgactcctgttagtggactcatgggggaacacaggctttggttaagatgggagaacagtgtgacaaagctcagaactgttcacattgagatgtggaaacctggaggtcccagccctggctatgaggtcctctccactgtcagccagataaagatgttggtccatcttcagactttctccttaggttctgcatttgtagtgccaaggaagtgtttgatcccccttcatctcctatcccaagataggagcccatctgatgcaactcacagcagagtctttattcgagctagcttaatcaacccaactccctgtacaccatcatcatggggcaaggctttatagtaagcatcgaattggaaagctattgtgaccttcaacataattggctggtgctgggagtcatatcataaacttaacttctgctttccgctgcattggtggtcgttaggcagaaggcaggcttgttatctgggggtgcaggtttgttgcgggggaataacctggagatgctggtcttcttggggattagcctggagactggagctaggctctggttttgctggggggcaacttggaaacgaatgctaggtaccggcctgttagtttacctgagttcaaactttagatctctagaatggagtctgaatttaaaagatttggcctcttacatgagagacgtctctgtctcatgtagatgagaactagtgtgcacagggttgcatgtgacaattggctctgcagctgagtaatgtcatctcttcttcactcttaatgtggagatttgaacgtgtgcctatcaaagtgtctgtgacaatctaagtaaggaatgtaactgcctctggccagtattgtctgacgtactgggatgccagcttgggttttatgttaaccgttggttatagtccactatattctgtatgcaagcagtctccaaaaagtttgctctttctctgctaattagaaagataggctcatatacaaagtcacgtgttggggcgtggtggcacactcctttaatcccagcacttgggaggcagaggcaggcagatttctgagttcaaggccagcctggtctacaaagtgagttccaggacagccagggctacacagagaaaccctgtcttgaaaaacaaaaaaacaaaaaaccaaccaaccaaccaaacaaaaaaaccaaagtcatgtgtttcatcatggcatcttcctacatatgtgtcatcatgcttcttggtcttcctctgtccccacccacgtgccccttcctttgctaaactgatgtagacacaattcttaccatggtttccattaaaattttaagatagagagaacactgcaacaattaaatttcacatgagttaacatgccagctgtctgacaactttttagagctgtaggtttgcttaaagcgacaaaaaacaaacaaaaacaaaacaaaacaaagaagccccaaacaagaaaatgatgtaaaatcacactgtgccatcccagcacacacttagtctttgttctagagtctgagtccagcaaagcactaacttgcttacatgtgaaacactaacttctaaattcgaatcatacatcctcaaatggaattgaccaatattacttgtgtgaaaaacatgtatttttttcagttcaaggtcatattttaaactcttattaaggtttcaaaaatggagattattttatctagatgtaattttttttgaaaggttgaacttaggaaaaaaaaatgaatgtagctgaagtgaaactcaagtccccaataagcaagtcagagtgatcagtcagtgtcccattaggctatgccaacgtccttcctgcacattgtttcctatactttaaacacttccagtccaaaaattcttgggtgatagaatctaacaacattttcaaaggtctacaacataggcgtgcttatatggcctatgagccaaatcaggcttattgtctatttttgcaatttaagttttattggaacacagctatgtttattgacttgcatattttacagggccgtttttgctatagcagcagagctctgcatctgtaatgttacttgtatggtcctatcttgccctttatagaagtttgttcacttctagacttagatgcctggttgatacttgagacattcatttctctgggtttctttggacttgtatagtgttagcatcaatgttagataaagcacgcagatagttaattcaacgttttgttaatgacatgaatctaattaaaaatctttcttagaaacgatggaataatgtaaaataaattcaatatctcttgttgggaagtgttgtgaacatgaagatgagattttaatcattgcttcttgtattaggggaagatctgtgtgatagtgagaggtgaggttaactaatttttctttgcattgactgtctcatgtcccctggagttggccatgttatgttttaactgtattaagttaggggccctttaagaacaggaactagttattaccaaaccattatgcccatgtgcctttgtcagacaactggagcatatcaaagggttaacagataaattgggaactcacaattctcacaaatagtgaagtctgcctttaggatttaacctaaggtttcactagctaggaaatataattttaagggtagttaaaaagactcagggctatacatgtaacttttgaaaccttgaaatctcatgcataaactcagttatatttataacaggaagtaatttaaactattgtggaaacctctaacttttctattctatgatacagcctttgctcaattagcttagtaaagaccttccttacggagtttatgaggagtcattggtttgtaatgctaacagtaagtggagtccaaaggagagctgtagagagtcacaggttcctcgtgcaggtgaaatgggggtagcctggggaagatacgtgtctctcaggctctggcagtctctttacctgggaagacaagaacaaatgtctagcaagccaatgaaagaaccagatacacagttctacacaaggttgcaggtattatgagttcatttgattcattgaaaggagcatgggtcacccccaaatctctatcactaacaacttctaccctagcaagagtaatgacctccctaaatctgagcagtggaggcccctttagttaatcctttacttcttataagctccgccaagcacctcctgcgatgaattctcattgggaaagaattacatacagctggaggggaggggtcaggagttaggtgaggatgtaatggcctttcctgtcctctccttctatgatagaatgtgaacaggctcagtcttgtaggggtcacatggacaatcacagatgctctgattaaaatgggatcagctgtgtgattgcccagagtggtccccccccttttttttttttttttttgtctgtttgtttttgttttttgtttttcgagacagggtttctctgtgtagccctggctgtcctggaactcactctgtagatcaggctggccttgaactcagaaatctgcctgcctctgcctcccaagtgctgggattaaaggcgtgcaccaccactgctgggcggtgttattgcccagagaacactgttccacaacacaaaagtgaagtttaattggtaaaagagcaaatggtattcatggtggacattttccttgtcttcctatatttactagagatgtcaaatatgtattcctaattctcaatatttaccaattcaaaagtgttgaaaatggtccttcggttcagatctgcaactctgttcttttatgaagaataaagaattaaagttgtcgacacttgttcactaaatgtctggatgttgtatttattaagaagttcttaaatgtttgctttttagctttcccagtacaaagtaggtgtatcaggtcccctccccctggcttcccgacagtagcttagtttccaatgaaatgaaggtgctggataatttttcttgctctccaaaccaaggtgggtaattgattataaaagttattagtataactttcccgctagagcatccttagtaactcccctagttttctcagttttaggaagaacctcttggtcagagtgggactgccttgaatgaaagcaccttctccccagtaccttggttgtgtgaggctgtgtgaggctgtgaacagacacattatccctgcatttgtgattatacttcccagtctacagctaaacaggcttgggactttccagccactaccaaaccactatgggactagtcttttcctagctaagattagatagattgaactcaatcgctacttgctgagttttcatatatatatctatatctatctatctatctatatatatacacacatatatatgtatacacacacacacacacacacacacacacatatatatatatatatatatatatatatatatatatatatatataacatatatatatctttgtttatatatataaacaaggatttgtaagttaatagaaaggagtcttgtatctatccagagtgttcttttcaacattggctaaatactgagatgtctgggacgagatttaaggaatatcaataacttgatcccacctcagagcttctaattaagttgcccaggaacaggaattaagtatacatcgagatgtagtttttctttgtgggttatggtacttgttaactactgtgctcagcaggaggtaacagccaattttcaatgcaacttgaattagaaaaggatatgagaataaagattatttaagctttctaggcctgggaaatgttgagatagaaaagagaggcaagagaggtagaaataggagcaggtttcaatcatcttttcattatgccttgcttgcatatacttgtttactctgtatttcccatccaatagggtgacttctagaaattaaagaactatgagcgaacctcttcctcatcttcttcttcctgggtgatttactagtgctgatagctgaatcttgactcttttttttttttttttttttttttagtcttaactctttattagtaggataatgactccccaagcaacttacagagtggaggtagggtctagaacttaattatgaaaatattgactctttgtactagtattaacagaaagtgctccgttcttctgatagttttaaatggcagttgtggggtatgtacacttggtgccactcagaacatgaaatcattttggggggctactttgggcgatatttggttgctaatatagagatgtgacataacgtaagtttaagtaagattgtggactgtacgttttactacatagaagtccgtagtagccttcccagaatcctatggtctctgtactgccaacaatatttgggttcatttttgtctttcattcttatgtctttgtcatatgatatttgttctcaaaatttcctgattgtcactgtaacttgacccactgcatcaatgatcatcaaatcttgaaataagaacaaggaaaaagatctatctatctatctatctatctatctatctatctatctaataactgtaccttctcctaacagacaacctcttctgacatattaaggccactccagctacaaaggagaagatgtgacaacagccagtctttgctgtactttgtactatttaatctacttctcataatctctacattaaccatgatctgggtcctgttacaagaacctcctcattgatgagaaaactgtagcttaaatgttatattagtaacttacctataagataaaattcatctaaagcagacccaaaataccaacttgccaagctgcccggtctcctgccagatgtacatggtgaaaggcaaggctttccatgttagataaaggccaactgtgagatgaaatataacagaccctcagaatgcgtttgtgatgtgtttacttactggagagaaatttataatgagtagggtttttatttagagccacaaagggatattgctgctcttagtttgctttgaggagtttgaaggccagtgccagtgccagggtcaagcagatatgaatttgagacctagacctatctatattttactgtttgtgatgctggtaagtccctgctctttctgcatacaccaaggatgtggttcttccttcatgggttgtggtgggtgtttatgaccatgcttgacagtaagtaaacacccaataagttcttgttactattattgtattctctcattgaggacagaggctatgcaggttaattatagattacaatttgtgagtcattcatagtgaagtggtagggtgcatatacatggccatgtaattaagaatgagacctgggatcagggttaatgctgatggctaaggtgatctgtttgagactcacttgttcatgacttcctgactaccttcatcaggtagtatgaggcttgtgactggcaaacttgtgtttgtttttaattcacaaatttggaccaaggtatttataaattgggtgtgaggagaacaatacttaaaatagtcaagaaatagcactaatgatactgaaaaccgaaacaccaatgtgttgcctcaggttcttagtaatggtttcattagtactactttctgggaaaagctggcagctaaagaattataagccagaatcattttcagactaggtgctagtgcccaaaaggagtctcccacccttcaggaaagctcaattaccttttaatctattagaatcaagctttaactgggaggggaaataataatatagacatgataataaatataaataataaagtaatgacaaatgttgaggagctgaaaagaaaagaatgagaaaaagagtagaaaattgcaagttgatgaaagctttgtcagctcaggagagaagagtgtagaaagacagtcaacccatcttttcattatgctgtgcttgtgtgtactcatacaggcgtccagtctagtgttggaactcctatagtaatgaagcaatggaataaaatgtcttcagcaaaggggaagataggaccagtgatgatggcatggaacatttgtaggatatgaaggacacatgatgataatcaagttcattgcttagattctgggaaatatactggcatctgagcatttgaatagaaatccaaggatgtctaggctgatgcacataaatgttgtaattccttctataccttcctaatgctataacccttaaatacaattcctcatgttgtggtgattccaagccataaaattatttcattgctctacttcagaattgttattttgatactgttatgaattgtaatgtaaatatctgatatgtaggatagctgatatgtgactataaaggggttgaaacccactggttaagatccaccactctcttcaaatcaattctcttgcaggagtccaacatcaatcaagatgaaggatctctgggataaggatgcttagagcttggtttgtttgttaatgtcccgattttcttgcctctgtaggcacttgctggcatcataattgtgtctagggttctaaccagcccttcacttctttggctaagagccctggtagctagtcacaggttcttggcttacagagtgagtctctgtgaagcactgtctcgattttcatgaagtgttgcagctgtgaaagttatgtcttcagtcatgtgagtttcttgtgaattagggagtaggcaatttcctaaaatatgacttagcgacatatttatcagacttgatattctaataaccactcttctaatgtccctcatgaggtagtctcccatatcctgagagccactggttagtaaacccgagaattgtcccaaaagctcatcttgtctacaagttatgtttttcttcatgagtcagtcatcaggactaactttacatgtggaccaaaaccttatgctagtcataagccttgaggcttgggtagttggatccgacccttaaatacaacccctgctgcttctaaaaatccttgaagagagtagtcctaatccaagaatctcaggaaaaaatatttcttttgtaagactgtctttagccttgaaagtctaaacaatgagttgcttaagtctagaaactgagtatccttctgcatcttcaagctgcctaacaacagtttcttcctgacctatatcagatagagccaatagttctagattcgggtctttgtttagtaaagaaagatgtattccattcctatgctccatccctccttgtggagttgctttcctggagaagttaggtttgcaatggatggttaagtgtaatgtgggacagatgctcatagttctcaaggccgtttaacccccaccttgaggctgctgctctctgtgaagctgaggtttccagtgtgtgagccaggagtctaccttgctctaacaggtgacacaacacctacagcccccaaacactacattctagaattgtattccattgtgtatatagccacatatttacttcatcccgactcattgatatctacaacccagcctcagctgtggctatgtccatgtctttttagagacacctacagattccttaagggctggttaacagtagagatcaggacaaagataagccgttgtactctgtctcctacctaactgctagcattcaaaagttttcaaggtatttactcttaggtgcaacttttaaaaattccttaaatataccataaacccccatttatctggtgggttctgaagatagaactatgctctgctcatacaagttttacaaaagccaaggctttggtttcctgttcagggttgctgtctttaagtgaggtctttggtcaatccctggtcatggctgactaaaacctatttaggttttccttggggactttaggcccatggacttgaaggtgactttcaggatcataataaagacaaagggagacagactttgtaggtcgcagagtcctggatatgtccagatatttagtctcagtatgtaacaagatgtgctgagctatagtgacttttacttggtacctattgtatgccacatgtgttaggtaatacacaatctttataatagctccttgagacagacaatattattctcattttacaagtagagaaactgaggcttccactagtaagttacttgttgagggtaacacaggtgttaagcaatgtagcaagctttccaaactaggtctgcctgatcctaaccctgcaccacaccacaccacacctatatatcagtgcgaagggatcttgaagggtactggattttcattccactttcaattgaaataggtccaccctagatggaggtgggctatgagttcatcaaggctaactctacactgactcaaacatcactgcaaatttgagtatcagaaggagatactgaatggatagagctccgtcggtaaagcgcttgccgtgctaggatgagtactgagtttggcatggtatcgtgtgcatataatcctagtcctaggaaggttgaaacaagacagatccctggagatcctctggctcgtcagcctagctgaatcagtacgttctaggccagtgagacaccctacctcaagaagaaaacaaaacaactaaggtagacagcatgtaggttgacatgtacacacacacacacacacacacacacacacacacacacttactccctgtgtccttcacagacatgcacatacaagaaaagaattaaaagacattaatacttgagatgattagagattctgaatctagacgatgttcatcttataatgactccttggggctgttcttctgataagctgatcagccaagggcagagagcagttggtgaaacttcctgaggagtcacagagggtctgtcactttgtgtatcttggcagagactgatactttcatactcatggtatggcctgagccactgaccccaggtcattctctacattggagagagaccatctgccttgcttctaacctctctcctctttatatatctctagagacagcttgctgctttttcaagcattaatgagtcaggtagaggcggaagtcaaaactcttcaggtctgaagcagctacagcttcattacaattcatttgcttgtgtgatgatttcattaaagtctgcatatgacacctgagtggactgaaagtcgccaatggcagagatctagtctgatctgttcaacaagtatttgctagataaatggtctactagatgtttcttggtcttgaccctgaattggagatgtggtgtatttgagatgggaaccttttctgctctggtgaccttagtttctataaaaggcaagcagatgcagctggcttctcaggtggactcatctgctctcatttcaatagaaaaatacccaaaataaaaccttgccaggaatcgagtctctcggttcttgtcactcctcatgtgagtagacttttggcaaattttttgtggaagactctctgacctcaaaaccaccattttcttttttggagaattggccatcaagaggatcacatagtccaagccagtactccaactgaaggaaggatggttaggattggcccaaggaccttcaaggccacatagagaaaaaatgagacatatagaggcaagaagaaggtatgtggtgaagcaaaaatgggctgtgttggagtcagaggtcctaaatttggtcaatgacatcactactgttccttggaaagttcactaaatatcttttaagcatcaccttcttcatcactaaaagaagggatggagagtagactagattctttgtctgtttcagaggttatagtgcagcccccccccctcaatatcctttatgtcagaggctctgagaaccacaaccacagaacttaatgaaaatgtaggtgaggatttctgagtttctgggagttacaattatgttttggaaacacatgggctgttaccactcaataattcaacattaaattggtgtgcatacagaagaggtatctgcagcaacttcctgtacctgctagtcctcagtagattggaaagagagtggacaagtggcatgcctagtacagttgggaaaggaatcttgggcagtggggtttgtgtgttaaggaacattgccacacagaaagttcccacaccaccagcccgtggctaactttgcttgaggccctggtgaaggacagctataattcaaggcttccacaaagaaacaccataggcagaagttgggtaagtcaggatgagccatgtataaatgagctttcttgagaggcataggcatgaccctggctgttgattctctgatctccatggttttcatgagacagcatcatgctcaaataactttgatctgaggcttgggattctaaaactgcagtcacccccagtcagcatcaaaactggctcatgctactcaccactgcccgtcttgtttctaggggccctcttaccatgtccaagtttgaggactttctttgtgactctagccctccttgagattttcccagtggcctcacctgtggctgattttgaacactgaaggactgttgagggagcaacatgcttttttggaagtcttggggagaggaaagaaaattgccagtggtttccttttgtctgactaagccagcttcaaccaccattttgggacctcttaatagagacctctcaggtcagtcactaggaccctcgctgttttctctctgccactctagcagccttacatacggtatcatcctataatccaagtgcagtccattttctctcagatcttcggagcagcttttgggaaggctgtgctcccttcccttgcccctttcacatctctgcttcttctctgccttgagtgttatctagcttgctagaatgtatagatggcacgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaggaggaggaggaggagaagaagaagaagaagaagaagaagaagaagaagaagaagaagaagaagaagaagaagaagaagaagaagaagaagaagaagaagaagaagaaactgagtgggaaagtctttctgtagtatcaagtccttctggccaaagaataaagtcttcctgtttgaaaaaaaatcagccattgtccataaatgaataaatgtgaaaactctgactgagagcttcaccctaagaagaacacctgcagtagcgttttcataaagaatgtgaacaagcctgtggcctccctaaactcatgtttcccagaagatctcagccatctcaggtcagcaacacaaacacgattcttcacattaaagtgtcagcaacttttcagactttgttttcagtagagctaggacaagtttgttagccccaggcttgggacgtcctattgtttgactatttgttttggttttgctacaagtaaagagagtattagtggtcttcctccttaatgagttctattttctttttgataatattgaacaccagcagtgaaaggaaatatcccacagcggtaatctggagtgattcagagggtgtcttacatggtagcatgtcatgtgaccttcacatctaggtgattacttttcaaagtagcccatgtggctaagctgtgaggctctactagttgtgaatggaagcttgagccatctgttgagttgggatggaagggctcctatagatgtgagttctcttgttctttcattccctggtgatgcaaatccatgcttaactatatattacgaagggttttattttattttattttattttattttattttattttatttttggcagagctcttaattgttgtcctgtctgttgattggcccgatgacctatgggaaatctcaagagaacaatggctgaggcaagggtcttctctcagaaaacacctattggacataggctcatttaaagctaaactgaaagacaagttacagatgcttggggctggctactggctctgtagctgagtagcatgtgtgctgtggtttacatggggttgctaaataaacaggtattgtggttctgcataactccttcgtgagattttattgtactttattgaggaacccagagtaccatgcttatttcactcagtagatgcctgtatctctcaggttggtggacagtaagcatagatgccaatgtgcatacaggggctgtggaatgtgtgacctattggcttcaacctgttgcactgtgtgccttcaggtgggtggcagcctctggcctctttttcctgtgatgtacagcatatctgggtgtgtggtgggcgaactgaaatgccctctgctgactgttttaactctagaccattcattgctcatttggaaaaggggtagctctctctgtgaccaaatgtatgggttttgctatcaactaggcttcttaaaagctttttgtccttgaataccactggcaactgatgtccaaaagtaaagaaaagcagcaaggtgaacacctgtccaaagattcccagaggttcatgttcaggtagactgattttccattgtgatggattcttcaagcctacagaagctacaagggtcctcagactaacaaaaggaatgtcagaaagtttccagcctttgccaggatgccgtccagacctgcagtttgactagggagttattaaattctctagttagactttcttctttgccagtagagtattatttcaactttctattttatttccttcatataccatttaaaattgctatcttaaattattttgatatcttgttttaaaagttgcataatgctttagtgcagtcattggaaacttagatcagttcaaggattcagcagcccaaagccaaggtaatcgtggctttggactagttttcttcttccaaatttccatagtgttggtgcaggtcacagttgaggtcatggtgtttgctgactcttgctttccatagattagtgtgaaagatcccaacaacaagttgtcaacttgcaaatactcttttctattgagcttctgagggagatgtctcggggctttggattcagatattttgtcagcactttgaagagacatggtcaaaagcatcctcactcttgcctgctcaggtagagtcagttacaaggctccctgtcagatggcaatggatacagagctgtgggagtttcgcagctgtactagaatcaagtggagacagagatgatcttactgtctctcatgccagtctatacacattgggtctgtgggcagcgccagatatcattcttgcacacatagacaagtcatgcaaacagctcttgtgcagggttgacacgttcagaaggatgattaggggctagaaacatgccactgagaaatttaaacctgcctctgtttcaagataaggaaaacgaagtctagagtcagtatataaatctgggaattttctactaataggtgataggtcatttttgaaagtgggtatttctggctcttatgtctgttgttattgatgctttgagcaaagatgaagatggtctcagggcacagttactatgctggctttttcttatatacactcttatgccagtccaaacctctcatttgttgtattcatctcattggtggggattttattgcttatgttctctggaatacttacaatccatgtgagtagggatcacatccacgtgtccagaaacattctggaagaatgagtatgggagagagattcccttttatgacagtgactactaacatgaggaccatctcctgctggaatgctatagagtggttctagtgttaggttggggatgaagtatcagagctctaaccccagtcatcttcagaaacactgcaagtacttttatacagacagactccttggcttaagtggctcctccaaattatactccatgagaacaagaccccgggtatctgtattttgtatcggtttctagttggttctgttccacggtcagggaagagaccatagcatctatggaaccctaggctgaggtgcttggtcttgactctcactgtctgcctctggggttcattctccctccacttgctggccatgcaaggcttctttgccttccagctttcaagaccagaccatgctggtgctgagagcccagggatcctgcaagaggtcttgtgcagactggggcactgttgttatcagtatcagctgggtgtttactgaacaaagttcagtcaaggcaggcctgtggatccgggttgaacagataccctggcttcctggcctttgatacaaagcgtgcgtccttgggctcttatcagtggaggataatgggctccttgtgtgagtcccagagaccattgcttcttgatcttggatgaccttgatcttagcctacctgccatgggcctttccatctgagagggtaggttgtctctgatctcccaggcaatgacaagccctatgtcctgacttggatttaattgatgatttcttggatttttttgaaaaaagggaaaggaaacattgtcccagtctccacaaggtggatactccagttctaggacgcatgagtcagaggtggatgtttgtctcatgtactgaagataaccaaggacctggaagccaagtttttccccccttagttcattaaccctaaagatccaggagaagtgagaaaagacaaaaggaaggacatttgaaagcactattcacttgatcagttaatgaactgccatgactaagcttacagagagactagacacggtctgccactccagggggcagaaacaacaccatatcttgagaggtttataatctagaaatcattttaaattcacctcaccaaggataactaatcattacctagcaggctatagatttattgaatttgtggggcagagggtgtagctcagttgtagaaacttgtctagcatgtctgacgctctgggctttatccatagcaccaacaaaacaaggagacaagaaaacaaattgcatcaatacccatctgataagaaactagagattgtgaggctcagagtaatttgaggacttcacaggatgccatagctagattgtgactgagaggggattggaatacagttatacctggcttgagagttcttgggctgattagcatcccttactgccacttatgtgaaagctagtcagatctaggtgtgttggagaggtagatgtaggaattccattgcttacagtggtcagagaagttgcccccagatcagaattatgactataaggaatagcaagaaaggtagagaggtgattcacgcaagggtatgcataggagtgtaacgaggccttcttgctagatccagtttatatagcttcagaaaaatgagtttctggtacctttgggaagccctgtcacttttagacataggagagagggcttaattatttgaatttagtagggccacggaatggttggggacagaaggagtcttgggagaaatactctaggaggtctcacagagattcaagttcaagtacaacttagacagtagaggaagtgggcattttgtggttgggggtatctgagaagggccacaagttcaagtgacattccccttcatagccacagctccagagcaagctcctgccccaccaaggccataccagggtgttcgagtcaaggagccagtgaaggagctactgagaagaaagcgtggccataccagcgttggggcagctgggccaccgaccgcggtgaggagctactgtgggctgtgtgactgcagtgtgtgtgtgtgtgcaggtggacttggcagggtggtcagagggataaggcaagagtgtccttctctgactcatgcaccgtctgtggggcatgaaggcggaggattacatggagaaggtggaattggatccaataagctggtggtttgttgggtggtcaggggaatagaggagcttcttgcttttatccataaggaaaaaatctattggtgaggcttcagggagccaattgtacacatcctagtgtgagttgggagttcataaagtttctccaacgtacagccttcttgctaaactgaaatacaaatccctcaaaaatgcaggtggcgatgactggggtgtgggatggcaggttcttccctcatgattctcctatcctgggacccagagagtccctgagagggcttgctgcagatagataaacacccatcctggtcttcttgtccccattctaggtggtactgccccaccagcccctggccacctacagcactgtgggtaagagctctcctacatagtttggtgtctttggggaccccccttctgggggagcctgcacttctgttatttcctttttcccacaggtccttcctgccttgacatggaggtttctgcttccacagtgacagaggagggaacattatgtgctggctggctctcccaacctgccccggccactcttcagccattggctccatggacaccctacacggagtatgtgtcccatgaagctgtcagctgcccctactccactgacatgtacgtgcagcctgtgtgccccagctacacagtggtgggaccctcctcggtgttgacctatgcttctccaccactcatcactaatgtcacggtatgtcacacaaaagtagagatctatccaccaatgctgatacaccctctgagaagatttggttttcttgtctattgatttccatggttactgggtcaattaagttcactgcatcctccagggtgacttgttcctattcctattaactgaaactatttattctccacaaagacactgtatgcttgagttgtcacatcctttacttctgtgggttgggaagatctgttgcttctagcccaaaccttcccagctactctggaagcagtgggtctcagtgagtgaagtttttagtagatgaagtattaggtgaaatctgtgtagggtctgggtttttgtcagttcagataacctagggagtagttgtacacttagcaatgggaactactataatacttccaggctgagcaaaagttaatactagtcatcaagggaactactttggggtctttttttttcatttcttgctgtaacatcaagttacctgtatttatcactctttctctctttcttaatagccctgtgcttagtactttgacctctctgaacccagagtcctcatctataagatgagagagactaacaagatgtttgctattgggatcagatgagctaatacatataggactgtgtttagcacagagacagcactccttaaatgttagttattagcctcatggccatagtctgccaccagtgtcaacaaatgactaccttcacgtgtcaggtaggctgggaggccctctcatccttgatgagtagaggaaaggagttatagttttatatgctgggtggctatgtctccaaaagaatgggaatccctgaaatgcttgtgaggagaggcctaggaagcagtgatgaccagtgccactctggagctctgggcagtacagctggaacctccctagttgtctcagaacccttgcctgagatccccatgtcccctctgtttaccgtcaaggtccagtgtcactctagttctctgcttcaaagcactttcctggcaaagcctcccctgtcatacccacctggatacccaacaaggtgacttggggggtgggtcttgatgccagtgagtaggaaggagttaattgaacagcttccctaggcaactcatttccatagtgggggacctggggtggaggatgtggtggttcacagccttctcactattgaagattctgttcattatttatccccttctatcatctgcaccttccactcagacaggttctgggtatcaaacaaactgtatttattaagaaatgatttgttttgtccttttgtaaattaactcaccaaagctactggctcagcacttctgagcagcagagataagacctgcaattctatcccttggcaaggaaccagccattgccgttgacctgtataggtagaagagtcaaaagtcaaacgtggattttaaaaataatgatagtaaggttctaccaggtcctgtctgctttcaggaatccaggctggggagcaggggctcaccccgaaagagaagaaaccatttatgctgttacactagcctgcatgttgggagcccccagctccattgttcaaatagagaaacttcaggaagccttgcttctcaaactgtaatccccatatcagccaggttagcatcctcagagatctgactggacttgcagaatcccaggccctactccaaacctctaggatcgggattcatattgtgacaaactctcctggaggctgatgaaaattctaatgactaatcgctaaatgactctagcggcttattcttaagatgcagtggcagctgaggagatgacaggggaggatggggatggaaagtggggtttggaaatgtctttcttctgcccatgcagagaacttccttatccattagcttgctgtggaaagataagaacataggccctgcctcgctggcttgaggtttgttcgagtagctgatagttgaatgtgatgtatggtttgtagagtacttgagagaagagccccctgccacagggagcagcagctcagagaaaaggggagagcagggtcaggtaccagacaatagctggatgaggccacaattgcagataaaacagtgctcccatgctacaggaatgctaggcttcctggattggtcagtactagaaaggcaagagctgagtgagttatattaacccatggggacctaaggacgtcaaagctgcttgggaattgttttaattagtgtctcgttgccgtgaatagacaccatgagcatggcaactcttataaaagaaaacatttaattggggctggtttcagaggttttgttcattatcgtcatggtatgaagtatgtcagtatgcaggtaaatatgatactgaaggagccaagagtttctacattttgattcataggtagcagaaggagactgtgaaccatactggctataacttgagcataggagacctcaaagcccacccccacagtgacacagtttctccaacaaggtcatacttactccagcaaggccacgcctcctactagtgcataccctgtgtgccaagcattcaaacatatgagtctatgggtgtcatacctatttaaatctccatattccactctttagcccccataggtttttagctataatacaaaatgcacttagtataactaaaattccccataatctatcatagcctcaacaatttctaaaagttcagtttgaaatgtcttctgagattcatgcaatctcttaactataatcccttttataactaaaagatgactaaaaaaacccagatcacatacttccaacatataacgacacagaatatatactaatattgcaaaagggagcatagtaaagaaatactggaccaaacaaagtaagaccaaaaaataactgggaaaactccaaactctgcatctccgtgtctgacatcaaagcactcttcagatctccaattcctttcagctttgttgagtgcaacacatgtctttatcttgggatggttgcatttcctgttagcagttttcctcagcaggtttcccacagctcttgtgtctctaatatcttggggtctccaaggcagaacaggcttcaccttaatagcttcacacatggtctttctaggcttccatgcagggacacccctgccacacacctggccttagcaacttttcttagtctcagatggagattccataacctcttttatctattcttaactctaaagccagaactacagatgccaagttctgctacttgctggggttggaacctgagacccttgttcaattacatctttgtcagttttctgtttccagtaatgatttcctttactgcctaaacttggctgtcatggaacttgtgctgtagaactcagagatgtgcacatctctgtctcgtgagttccaggattaaaggcatgagccatcatcacacctggacctaaactgttctttaatttcttttcacaagatggacgcttagctatgtgggatcctgccctgaggtcagcactccctcagttccatttaacatcttgaatctgtttatttctatcaacagaggatttagctccattccacttcctggtgccccctttctccttgacccatacattttgtattttttctcgcttagcttgctcctttccatcaaagcactcttcataagagtgaaccacacagagtctatactatactgttttgagatttccttttccagtgcaattaatctaacaagcttcactttagcctcaggcagactcttcagacaaggacaatgagcagccacgttcctcgccaaaatatcacaagaagaattctaggcaaaatattaaaattcttctcctcagctccactgttcttcatgttcttactagtatggcccattaagtccccattaaagcatttaactgcttttctaatctaaagtccaagaatccacaatcttccaaacaaaaacatggccaggtctagcagagcaatacctcagtccgtggtaacaacttctgtcttagttaggatttcactgctgtgaagagataccacgagcatggcaaactcttataaaggaaaacatttaattgtggatggcatacaggttcagaggctcagtccattatcatcttggtgggaagcatggtggcatgtaggcagatgtctagagaaggagctgaaaagttctacagaaggggactgtgtatcccactgggtatagtttgagcataaggagacctcaaagtctacccccatagttgcacacttcctccaataaaaccatatatactacaacaaggacacatttcccaatactgccataccctatgggcctaacattcaaacacatgagtctgcgggaccatacctattcaaaccaccacaggggtctgtgtcacctttctgtctgggcttgatagtagtcatcttcaagaaacagctacaaggctatgagacaggctcattatatatcaagaatatattttgcataatttaagggttttttctttcattttttttgtttttttgcaattagaatatattttatattcagtgaaacctataaggcctttagtttttcaggggtatgacatcattattttctgtaccctctttcatgaaaaagtgaagcttccaagttgggaagtagcagaagcataccgttagaagaggggggaacacagctgaaacgtgtcaagctttctcttctaggagactgagcaggaggaggtggagccccattaagtgtaacaccagtaagggaaggtggggtataatagatcatgatgggggcaaggaggcaggtgggcaccccagttctgctaaccattgctcctatgtttttcatcacagccaagaagcactgctacacccgcggtggggccccagctggagggtcccgagcaccaggcgcccctcacttatttcccgtggcctcagcccctttccacactgcccacctccagcctgcagtatcaacctcctgccccaaccctgtctgggccccagtttgtccagctccccatctctatcccagagccagtccttcaggacatggatgaccccagaagggccatcagctccctgaccattgacaagctgcttctggaggaagaggaaagcaacacgtacgagctcaaccacaccctctccgtggagggcttttagggctggcttgcatctaacagatgtttcacccatagctgagattttaaaagtgttcaatagagcccagacttctgtttgaagtagctatttcacaggcttcctttcttcctaaagctaaattgtatcccttcttttctcccttcttccttccctcgcttccttccttcccccactgccatcttgcttatttcttatttctccttccagttttcttcctctggagcggcaaatgatagtgatattatgaacaacgctttatacggaatgtcaccaagtctgcagctcagggttttcctttggtggcacatcattggggaagcaaccttctttcaggtgccccctgtttcctggtagcagtagctttatagatctactctatgatacgttctgcgccccagttttgttttgtgtgctgttctcagccttggccagatatactatctaagtggatgtttctggtctggttacagggggatgggacaggaccatcagggtgggtagggacagtgagtgagtgatgggagacggggctgaggagcagcaggacacacatgtgtgtctgtggttagagagggagtgaggaggggcaggggaaggagtgatctaacagctctgaaaaaaaataccactttaatgtggtttagctgttcttgtcagcgattaggaggaaagctggatatggtatggaggataaatgacgagtctgcttatttctgcctctctgcaggcccgctaacatgatgccagcacttaaaatacttctgtcagcatattgccatagcaacaggaaaagaaacaggtgaagccgatcattgaggaggcttgcacttagtccttccacgtgggcttttaattcctgttgtgactcacccagggccatcctgacgcgttgctatggattcttgcgcccactcaccggctgtctctggggtcctgaagtcctggtcagcaggcccactggccttcattttcagttttatcagttttattgcagtttttgctggagaagcataacacttgctgttgagtgttttgctgtctcctagtgctttgctcctgaagtggatgtgtctttgggaactggcccattgtttactaatgataccatcattacacatacacaagttttagtctgtagaatccatgtagaaccaatagatcttctagaaatgacagtttctttgatatcccaccctctttctttctgcttccaatgaaaacttagagctacctgttttttttttttcttcttctttctttctctgctttgtgtttattttgattcagacatctcattatctacctgaagtcctggtatacttagcttgaatttgttattcctctttaatatttagattaaatgctagatctgaatggtaggtttacacttctgttggtggttaccatgaacaagaaagggagagggaagcctcagcctatttaattaagaccttgttgcacttaaaaacactatttaagatttcccagctacttgggagtttgaggcaatcacagaggagttaacactgggaaaacaaacaaaacagcaaagaaagtagtgtgagcggttgctgggattgaattggcatctttttcgcttcttatcttgagacctcacgtcttggctgcaggcatccaaacagatttcctccagagcctcatttgcaacattttcaataaagattggttagatgactttcctgtgccgaagtgttttatttctcgtctattaattcctctcacctctcagtagagcgtctttagaggaagaagctttcagtagggctgagcttgcaaactgatctgttgctctaggaggggaaagctgtccccactgtgtctgttgggcaattttcacagtggaatatgtattggttggcgggtttactctccagggcagtgggggcttagagggtgggaggaaatcttgctggcctactgctcttcctgttatctatgctacatgagcgacttctctcgatgcttggtgtctgggcttctaccacaggccttggtgaagctgtcagtcaggaccctggacatgtgacacaaagagagacctgagaaggcagtcatgtcccccacccagactccatccttgcagcaagtaattctttctgaggggtgaccacccagactccatccttgcagcaagtaattctttctgaggggtgattttggaaaaaaaaaagtgcaattatatttattcatttaattattttctgagtttactgccttcattgtccatctttatggagtcatttttgtaaatcatccacgttattctgctgtataattatttccacataccagaatcacttggacaatcagcatcattatttctacacatttacgcacaatttaagagggggaaaggcatagaacagaagggatttgatgggaagagagaagtactggtattttacaggattctcatctgaagctatgcaccttagtgtaaaaggaaccaggagcagacaagggtgttgtcagacaaagtggaccatggagaaagaatcaaagtcacagcagagccatcctaattcttctgaatatcaggctgcactggcctttaagtgggattttgaagttaagttctctctctctctctctctctctctctctctctctctctctctctctctccatccctccctccctccctcccttcctcccttcctcccttcatgtgtaggtatgctcaggtgcctgtgaaggccaaaggtcaatgccaactgtcttcctcagtgtcttccttaatttcttgccactttattattatgtgacagtttctcagggaagctggacttcacaggttcagccagagttgctggccagaaagtctcagccttcctcttttctctgcctcttcagtgctaggattatagctgcatgaggcttagcttggcttttctgagggggctggggttctcagccttgcacaggaagtgctggctgacagagtcatctcctcaacctctgttaccaaacatgagatttttgacaccagaaaacatggctaactttaaaaaataaaacaaaaacaaaacaaaaggaaacaaaacaaaacattgtttacttaatctgaggatctcagcgaatccctgttgagctggggttaatttgggaggttctccgtcagctgttcctaaacactgatgtggatgcttgtaaatagattgctctggcatctttctcagtgaaacacagacacatgatactgcccactgttccaaatgttttctctgcatgtttggagagaagcattcattagcccgtgtcctttaacctgtttgtcagttcttcaactctgggtactgtgggaagaagttttattctttcattcaaccccttaaaaatttatcataatttaaccatttatcattatatgtattgatggtatacacagtgttgttatgaaatagggttcagcttcatttgattttggtactttgaatggatgctataactgtaaatgctgccacaggatggtatttatatccaaataaaaacagtggatcattggctatgctaggtaattaaggaaaacaacattaaaaaatcctttccctcagttccatgaaaatgctttattttgaaattggcgggtaagtttctatttttgctagtgtccactagtcttgaagacttgaagactttacatccaaacatctttttttccagtctgtgtacacatgtgtgcagtgtatacatgtctgtaactgggggtggcataagtcttctgaaacctcaaagctcagccccagtgccaaaccccctccaccatggccacacctcctaattcccaaacaatcccagcaggtgaggaccaagtactccgatttatgagcctataggaggtggtagggaaattcccattcaaaacaccacaacttccctttttattccctggaaagttaaaaatagattttttctgcttgcctgtggtgacacatgcctttgatctgcactcaggaggcaaaggcaggcagatctctgagtttgagaccagcctggtctatagagtgagttgcaggacagccaagactacaaaaaggaaactctgtcttgtaaaaacagtacacacacacacacacacacacacacacacacacacacacacatgcacgcatgcacatgcacacaaacatttgacagtttcttttaagttatccaatgtgttggcatacccttttctagatgagctatcagcaattaatggctgcagaaatagggagaaccagtctaacacacagtcatcagccctcaagagcaacactaaatggtcttggtgtctcagaagggcgggtatgtatgtgtggtgtgtgtgtgtgtgtgtgtgtgtgtgtaataataataattaaagatgaggccatgaattcagagaaggagttggcagaaggacagaaaggggtaaatgataaaaatccagtattcatttaaaattctctaaaaaatcgagatgagaagaatgggggcattgtaactcaaatataatgccatttggcgggacaggactgaagctgggagggggattaaagagtgtcttttgtggagttattaggaactaatttttatgatctggctctttggggtgttttcattaagtggggttttatgggcagtgtcattctaacgccagggtgggctcccttggagtggccagggatgaggtgggagccctgcactatgccacagggagactcagcacagaaaccagctgtatacacacagcattggagtctctggtgaagcttccaagaagaaggacaatgaaccatagagaattagcatcagtaatttgggggctacacacctcacccctctttcttccacatcttcatttgatcctcttgtttctgcaccccaaccatacataattaaatattttatttccacccttcccaggcagattcatcccttcctactcttctctcactttatccctagcctctatcattagatacagtttagcttgcttattgaagatttagcatccacatataagcacattacacaccatatttgtctttctgggtctgggttacttcactcaggatgagttttccttgctctgtccatttacctgtgaattctgagatttcactttttaacagacgagtaatactctattgtgtacatgtaccacatattctttatctactcatccattgatgggcatttagtctgtttctaatttctggctacttaagaatagagcagcaatgaccatggttgaacaagtgtctctgtagtaggatgaagcatcttttgagtatgctcaagagtggtatagctggaccttgaggtagatctgttcccagtgtcctgaggaactgctacactgatttccatagaggctgtacaagttggcacccctaccagcagtggacgaatgctttctttcctctgcatcctctccagcatgaactgtcatttgttttattgatcttggctatttagaccagtgtcagataaaatctcaaagtagttctgatttgcatttccctgatgactaaggatgttgaacatttctttaagcattcctcagccatttgtgtttcctctttgagaattctctattaagatccatatactattctttaattatgttgtttgttctctttatgtcaaggttcttgaattctttatatacattagatattagccctctataattgctaagaatatttccccattttacagcttactattttgtctgaatgatggtttcctttgctttcagtttcacaaggtttgatttattaattgttgttcttagtgcctgtgttgttggtcttctgttcagaaagtgtgaataaattcaagactgtttcctactttctattctattagattcagtgcatcttgtcttatgttgaggcctttgatataagtggagctgagttttgtgcacagtgtaagtatggatctgtttggattcttctacaggtagccatctagtttgaacaataccatttgctgaagatgctgtctttttttcccccagtttatgtttctgactactttattaaaaatcaggtgtacataggtgtgtggacttatgactgggacttcaattcaattccattgaccaacatgttggtttgggaccaatatcatggtacttctattactatggtactactattattgctgctgctgctgctgctgctactactactactactactaaatagtagtagtgtaatatagtttgagattggggtggtggtgcctccagaattttcttttactatttagaaatatttgagctatcctggatttttgtatgcttccacattaattaagctgaaaattgttctttcagtttctgtgaagaattatgttgggattttgctgggggttgcattaaatctgtaggctgcttttggtaggtgtattagtcagggttccctggaatcacagaaccaatgaaatgtctccctctattaaggggatttattgtaatgacttacagtctggaatctgactaacccaataatgggcagctgtgaatgggaagtctgagaatcttgtagtggctcagtcccatgagactagttgtttcagctggccttctgtataaactggaatcttgaagaagtaggttccaacagatgtgctgacaagtaattacaagcaagggaagaagagtgagcctttcttcttccaatgtcctcatgtaggcctccagcagaaggtgtgacccagattaaaggtgtgtactacagcgcctggatctggagtttgcttcgtcccagtctgtccttgaactcagagatctgcttgccttagtttcctgggattaaaggcatgtactacttttcatagccactattcctcaatatctccatgtcaagatctgggtcaaaagtcttatttaatttcattcttcaaagacttaaagttttgttatacaagtccttgatttgattgactagagttaccccaagatattctattttatttgatttgaggctattgtgaaaggtgctgttcccctgatgtctttcccattctgacatttatcatataggaaggtggctgatttttatgaattagcaattgaatttttatttgtctaaatctcatgtcttgctcttaagtgttcagtgcccaccagaaaggggatttagctaggaactgaatagtagttcttgtttattttctgttttcttgtttagatgctgagttttatgatgcctagactcgaacttgcgattttattaaatattcctatttttgttacctcattttcttcctaacaaaactgtatggtgcctttggttgtcactgagctcaaccttctaatctttacttcaactacttggtgttctttaaaataacttcccacccctgtgtctttgacatggccttgctccatggtcattcatctccaatgtccagatcaaaggccaccttcccaaaaacttctcaagcatttggtcaatcagagtaaataaatgaattcctaaggcccttagaagaggtcactccctttctcaagagccctaagaatgaactatatgaaattcaccaaccccttcagaacatagggtagacattagcttctaaacccttcagggcagggacaaccagcgaatccctcaattccccctaagtggtcactttcttctcactggctttcaggctgtaggaaatctctatcaaccgaaatatcaacgtttgttttgtagatggataaaaaaagttaaatagttcagcaatttccaacttgcctggcttggtagtttctgaagaatctggaaacaaataatttgcatactgtagacctacctcctggaaggtacagttcctgaaatccaaatggaaatcaactctagctttattaacagctgaggtatgtcccaggtgtcttttaggagaatacctttttctttcttccccaaagacctttcagttcttctatctaccatgaatctcatcttggagatgactcttattttttcctagcagacagtattagggatacagtcaggagttgagtgacctataaaagtctaaggtactcttcagtctcacttcattttattgcttctttcgaggttcctgacagcataaatatacaaggtcatctcccatgatctcagaaagcatcttattatttaacaaacacttgtatagtggttactatgggtgaggctctgctgtaaacattcaacagatatgagctatttcaccctgatgcatgctcaaaaccctatctctggcctaaactggccatgaccatgagctacacggtcatagagatagcaagtcacaccttgttttataccatttggtggacttgatattttgtctcttttatctactgtaaaagccataccttggagtggtcatctcagtagatcctgtaacactccctgttcacttaatctggagacaaaaaccatgcataacatctgtatgctgaactctctccatctgtaaaatgcatcctgaagggattaccttaaaaatagattagattttacatgcaaatcatggagtctggggaccaatgtctttcacaattagtggctataatgacaatgatgaaaacagaacaacaccaacaacaataacaacaacccccaaacccaaaaccatgttgcccaagtgaattatctgtggacttgtgggatcagcgaatgagcagaagactgtctacaatggtcttggtatatgtgattccatgacctcagatctgctagctattgaagtgtggaggggaatgctgttgaaccagaggtcctacgagaagagtcttagagactgtccagacagaaggcttagccggggtgcatttgtgtctctggttgtttttcttctctacagagaccttttgttttctaacagtcctattagataatcaggcaatgagtctattagacaatagccatatggtggttttgaatgagtgagtttattaagtagacagataaataggtacgtagattaagtgatgctctaaatatccagcagaaattgacagaggaagtcgtagacagacagtcagctagatttcttgatagagagaaggatccttggcaaagcagttttcccctgagaattccaaccaaaagaatagctaacagcagaaagctaaccaaagacatggagggttacaaatgcacagcagaaactaactgggggaacactgtgaagatagccaggtagagttcccagctacgagagtctcgaacagagcaggtgtacccgtggatgaggcttccaaatacagcagaaatagcagcagaaagaacttacatcatcaaatggggtgctcacagtatgaaacagaaactgacatgggaagttgaaaaagtcatctggggtttctgattaagctttttctcctaatggatgacttctccatggctgaacttctgacctctctttccctccacaggcattgttatagcgggggataaatagtggtaccctctgttggaagtggtgtttaccttctagctgttctcaagggcacagtgtctttactcttgtggtaatttgttgttctcttccctggcagagttagcagtaggcagcccatcccaagacaagggttcttagggaacacagtgacacgagcatacttaggtctgaaatggggaaggaaccaacctcacttctaaatccagcttctcggtgaactcaatcaataacatgaaaacttatcactcttggtagtttggatgaaaatgggccctataggtccaggaagtggcactattaggagatgtggtcttgttggaggatcctctcccagactcctcaaccaatatttcatcagtaaattgttggaccctacaattctttcactggtccatgactgattattgacaggaactgtcttctgaaggcccagtatccgtggcactgtaagctcatgattacagtgcctatgctgttctcagaggctgacatgtctcagcccctctacttgtcttccagcttttatattcgtctccttctcttctttgcaatgttccctgaatctcagagggtgtggtagagatgccttgtttagggctgaaccctcatctgccgttcatcttggcatcttgggcaactatgtatctctccattcattgcaaatagagacttctctgaggctgggagtctcttctttttatgggtagaagaggacattaagatggcaattcaattctttttcagtttagctaaacagcagtaagaagttccatgttgggcctttgacctgtccagacaggggttattaactggtttacagtacaggcatggattctaccttgtggaacagttcttagtacaaacaaagagcatttggttgtccctataacagctatacaagtgttgctcaggggggcacatcttgcctagcccattggcttcatagtttataaggttcacagctagataagaccactgatgcttcttgaccccctagaaatgtgcatagctcctcccagcactttaaagaattggagtaaaactctacaggccagttccaaattgttttctcagagatgtgtgatgtcttcagccatagagtcatattcttttgtttgggtgtgtattcaggaagactgattagtctgtattgtttgagggaccttcctgaccacaattcctacagaaggcatctcatatctggcattctggcactgggagttttgtttagtgacccattacttctaagagtagcattatttagtcatgtaggctatgccacttcaatctctctcttatatacgttaactgggtcataagccagtggatttccatatgacttttcacacacccttcattttggttaatgcacatccctttgtctcttcagtccccttgcctcccatttaatctttttatgcccaatatcatccctctctggctacctaggacagtagccatcccttcctcatctgcagggggaagaaaacatttcaaacctgtttctttgttggaaatgaagatggactggaatcttgattaagggcctattgtgtttcctggaaaaagacatgaagaggctggagtccacgatgacacagacaagcctgaaaggcatgcagtctttggtgttggcatgtcactttagactcattctttctctgaggtctgggactcttggttgtccttgcacttgtgcaggcttcctgacctctggtccagaaggcatgaaattgttgggggattcagacaccaaggagccttcccaagccttctccctaacctacaagttaacaacctgagtaatgcattaagttccacaggtgatattatcttttcaccatatacctcagttgtaagctgattttgttgaggagtgtggatttagatcttataggtctcagagaagtatatgctaaggtttcctgtgacagcatcgatggttgtgatatggggataaattttactcgtgtagttcttgggggaactgggttttcattgactctagatgatgcttggagagctattgccaatatttaataaggatacataggattcaggtctcaaagccacacttaggacttgagtttgcaggctcttgttgggagccaaggaaagtccctggcataagctttaagggcaagattctgtatctgctttctcagagtcagtgatggggatttggatgcatgtactgggctgtacagtactctgggtccctgtgtctttaatagcatgttggaaatttgtatct

SEQ ID NO: 1344 - DNA, 2578 bp, Mus musculus
taaacggtggttccacgggaggaaagcacgcccagtcacattaaagaagccaaactgtctgcttcaaagagaaaaggcaacatcctgtcacaagccatgctctggcaaaaatccacagctccagagcaagctcctgccccaccaaggccataccagggtgttcgagtcaaggagccagtgaaggagctactgagaagaaagcgtggccataccagcgttggggcagctgggccaccgaccgcggtggtactgccccaccagcccctggccacctacagcactgtgggtccttcctgccttgacatggaggtttctgcttccacagtgacagaggagggaacattatgtgctggctggctctcccaacctgccccggccactcttcagccattggctccatggacaccctacacggagtatgtgtcccatgaagctgtcagctgcccctactccactgacatgtacgtgcagcctgtgtgccccagctacacagtggtgggaccctcctcggtgttgacctatgcttctccaccactcatcactaatgtcacgccaagaagcactgctacacccgcggtggggccccagctggagggtcccgagcaccaggcgcccctcacttatttcccgtggcctcagcccctttccacactgcccacctccagcctgcagtatcaacctcctgccccaaccctgtctgggccccagtttgtccagctccccatctctatcccagagccagtccttcaggacatggatgaccccagaagggccatcagctccctgaccattgacaagctgcttctggaggaagaggaaagcaacacgtacgagctcaaccacaccctctccgtggagggcttttagggctggcttgcatctaacagatgtttcacccatagctgagattttaaaagtgttcaatagagcccagacttctgtttgaagtagctatttcacaggcttcctttcttcctaaagctaaattgtatcccttctttctcccttcttccttccctcgcttccttccttcccccactgccatcttgcttatttcttatttctccttccagttttcttcctctggagcggcaaatgatagtgatattatgaacaacgctttatacggaatgtcaccaagtctgcagctcagggttttcctttggtggcacatcattggggaagcaaccttctttcaggtgccccctgtttcctggtagcagtagctttatagatctactctatgatacgttctgcgccccagttttgttttgtgtgctgttctcagccttggccagatatactatctaagtggatgtttctggtctggttacagggggatgggacaggaccatcagggtgggtagggacagtgagtgagtgatgggagacggggctgaggagcagcaggacacacatgtgtgtctgtggttagagagggagtgaggaggggcaggggaaggagtgatctaacagctctgaaaaaaaataccactttaatgtggtttagctgttcttgtcagcgattaggaggaaagctggatatggtatggaggataaatgacgagtctgcttatttctgcctctctgcaggcccgctaacatgatgccagcacttaaaatacttctgtcagcatattgccatagcaacaggaaaagaaacaggtgaagccgatcattgaggaggcttgcacttagtccttccacgtgggcttttaattcctgttgtgactcacccagggccatcctgacgcgttgctatggattcttgcgcccactcaccggctgtctctggggtcctgaagtcctggtcagcaggcccactggcttcattttcagttttatcagttttattgcagtttttgctggagaagcataacacttgctgttgagtgttttgctgtctcctagtgctttgctcctgaagtggatgtgtctttgggaactggcccattgtttactaatgataccatcattacacatacacaagttttagtctgtagaatccatgtagaaccaatagatcttctagaaatgacagtttctttgatatcccaccctctttctttctgcttccaatgaaaacttagagctacctgttttttttttcttcttcttcttctttctttctctgctttctctttattttgattcagacatctcattatctacctgaagtcctggtatacttagcttgaatttgttattcctctttaatatttagattaaatgctagactgaatggtaggtttacgacttctgttggtggttaccatgaacaagaaagggagagggagcctcagcctatttaattaagaccttgttgcactaaaacactatttaagatttcccagctacttggagtttgaggcaatcacagaggagttaacactgggaaaacaaacaaaacagcaaagaaagtagtgtgagcggttgctgggattgaattggcatctttttcgcttcttatcttgagacctcacgtcttggctgcaggcatccaaacagatttcctccagagcctcatttgcaacattttcaataaagattggttagatgaaaaaaaaaaaaaaaaaaa

SEQ ID NO: 1345 - DNA, 771 bp, Mus musculus
atgctctggcaaaaatccacagctccagagcaagctcctgccccaccaaggccataccagggtgttcgagtcaaggagccagtgaaggagctactgagaagaaagcgtggccataccagcgttggggcagctgggccaccgaccgcggtggtactgccccaccagcccctggccacctacagcactgtgggtccttcctgccttgacatggaggtttctgcttccacagtgacagaggagggaacattatgtgctggctggctctcccaacctgccccggccactcttcagccattggctccatggacaccctacacggagtatgtgtcccatgaagctgtcagctgcccctactccactgacatgtacgtgcagcctgtgtgccccagctacacagtggtgggaccctcctcggtgttgacctatgcttctccaccactcatcactaatgtcacgccaagaagcactgctacacccgcggtggggccccagctggagggtcccgagcaccaggcgcccctcacttatttcccgtggcctcagcccctttccacactgcccacctccagcctgcagtatcaacctcctgccccaaccctgtctgggccccagtttgtccagctccccatctctatcccagagccagtccttcaggacatggatgaccccagaagggccatcagctccctgaccattgacaagctgcttctggaggaagaggaaagcaacacgtacgagctcaaccacaccctctccgtggagggcttttag

SEQ ID NO: 1346 - DNA, 47443 bp, Homo sapiens
cacagatagtgatagcaacactgggttcaagtcaaaatctgtcacattcattattaatgaaaaagtagtaataacagaactagctaccatttatagagtcttttctatattctgggcattgtgcactttggtggaccacggatcatggatacccaggtattgactgaatgtcagactttgtctctgggttcactgaggccaggcttagcttactttattcattagtctcactctagtgttactatggccaacaaatgcctcaggtagagttaatccttaattgaattgactgctctatctttggaagcagatttctttttttcttttggaccttcaaggtgtctaaaattttgagttgtcattatctctttctcactctttcctcttttttcttcctacactgacatttctatttatatctcgttttcattttctctgtctcttcattcattcatttattcaagttactttcccaccaaattacagaagtggtagttgaaaaacagcagtgcagctgccagccctatagctccacccatgaccgaaagttgcccaggagcatggcatgcatgcaaatagacttgccttcgcatgttggatccttttcctttttataggaaactacacctttgattcataaggaaatggactttggctttattgtaattcctattttcatggtgttttggcacaaatcatgaaatacacctggtgaaactcctgagtcactggagggcttaaagtttcaggaagaggaagaggaggaggttcctgtgtggcatcttcagaaagaaggatgattggcaagtattacctccatcactggacaaactcctttcactttactcctttgagcctttagctcaaggggaacagggcattggtcagtaattgatcaaaccaccagcatccccgatatatgaattctggggggctctggccccttgtgggcttttaaatgctgcacagagaagaagtgaggctgagagctttgagtcctggacaggcagagtgtgtgccaggtcatagggtcactggatcactattccttgggagaaccacaggaatgcgattgtttctgggtgtggggcgtgcgtgaagccaagatccctcctgtttgtgggaaatgatggttatgtgtttagctagacaaaggatgttccatgctacacttaagctggaggcttttgtttttcttggtaatcagggcattctaggggcattccaatgaagaaaacttgaaaggggatagatagaaaaggagatcatgagaaaaaaggaaggactagtgtttggttgtctagggttgtgcttccaaaatcccaaagcaatgtcacatgaaattaaaaaaaaaaaaacacacacctccaaaccaaccaaccaaccaaccaaccaaccaaccaaccaactgagtcatggccactccagatctactgagtcaggttctctacaagtggggcccaaagaatatctctttatagtaagtatcccatgtaatttagatggaaattctctaggaattcttgtgggactttcagttataagaaaaatatatcaggtttttcataccagcaataacttgcttgagcatagggactttcttaccttgttatccctaacattatttccagcacaaagtttgtgctcaataagtatttttagaagtatcatggaaaatatttcttaaaggtggccactgactgtgtgggaagtggggaaaaataatgttggtaatatggaggcaaaactgtcaaataaagcccattgttcagtgtgtggtgctcagtaatggcaaagaagaaaaaaaaaaggtctctgtgccttggacagaccacatggtgagtagaatagcccagaaacatattctttttgcaaagactatttttcccccaagctccatgacataatagcaccaaaagtaataactatcaggctttcttgattatcttccaagatcatttatggcagtctcaggccatagataataattaaagctacctggtccttggttttctcatctgcaaaatggggcatggacacttgccagctgcctgtattaatgcaagtttgtcagagtggctagaggccatctgtctagtaccagaaggagttcagaaatggtcataaagagagttgggcaccttccagcctgctgtggaggccaggctgtcacacacagtaaagccctggcttctgaacactggcactcgtccaggcgccacttgggttgatgcaatctctatttgatcacatgaatatgatttccttttcattgtgcctagtcacaatgtctaattattgaaggcacaataaaactaaaattccaatgattaggcctcttcctagataagaacctgccatccagctgtcaaccatatttgcagatgatgtctgggaacttgagaagatgagaggtggtttgaatcttactgcttcttcagataagggtagcagggcatgatcttttcttggaaaactagaaattggtaaagtttgaagggctcactagtgtgcatgaattttgagagcaaagatatgaaagagaattcagtgatatattctcttgatctgaatggtacaataaaattagcgtatgtagaaaactctatactagcctatcaatgcaacagttactattattatttcaacttggaagaggaggaaattaaagctaggagagtttaaacaatgtgaccaaggccacactgctagcactgcagccagattccaaaccaggctctctgactctaaattacataatctcttcactatatcctgctgcctaacccagagggaaattatgcataagaatgaaatgatatacatgtgccagagaaatgagaaatgggcttagctggctcactatgtaaagaatatgtgggaaattgcctgaaggcaacaatgggcttcggtattttacctgtggattaccctttttacctcggagcccattactgtcctaactggacctaaagcaacttatcttttatatatttaaaatttgatatcatagtatttctctataataaacagtggttcttaaccttgagactctcatgaacgctatgaactgtcttccaaggaaaatatgtatatacacacaggattcatggccctcctttaaaatcaccctggtcctctcttctgctcccatctgtagggtcaagaaatcctctataggtctgactttacaaactgccctgaatttctggaccatagaaaatcttcatagtttagaggttgttgagcctctaggccatcaatttttctatgcactagtccatgtctgagttgatgacaaatcatttattgaaaggtcgtatgaattttctttctatctaacaccgggtgtctagctatatgatactaaacatttctgtttttttcattgttatagccctaaagcctggaatagaacttggcacaattacatgatgtaagttatatgttttattttttgtgtcctatatacaaaaaattatgtgtaaaattgtgtgtaaaaaatgtttggaaattaattatgaaaatgcaataggacaacttgttctttgttgctcaggctggaatgcagtggcacgattacagctcaccttgacctcctgggctccagcaatcctccaacctccaccttcaagtagctgggactacaggcacatgccaccatgcctggctaatttttaaatttttttgtggaaatggggtctcactatgttgtctaggctggtcttgaacttttgggctcaagcgatcctcccaccttggcctcccaaagtgctgggattgcaggtgtaagccaatacactgggccagcaactcgttcttaaagggaatttgtttacaatttccctattatgtataacatcactctagatttttggcatataaactttatcaagttaaggaagtttccttctagtcctaagtttctaagagttatttttcttaaattacaaatagatgttggactttatcaaatgtttagatatttgattgagatactttaataatttttctcctaaagtttatcaatgtggtgaattatattgataggttttctaagaataaaccatccttgcattcctgggataaatcttacatattataatatattattattatatcatgatgtattagtccttaatatactattgaattcagcaagcaaatattttgttcaggatttttgaatcgatgttcacaaattagatggcctataattttcttttcttatattgaccttatttagttttagaatcaagtttacatgattggctctttaaagtaatttaaattaaatgcagaaatctgtcttttaattggtgagtttaatcttcttaaattcattatcattactgagctagttgaacctatcctgccaacttattcctgttttccattcattgtaatttttaaatacatccttcctgtttttcacagaaagattcagtttctctcagaatgctcaaaagttaaatgtttaaaatttaaaagctaaactttgaaacattaaaagttaaacagaatgtttaacacatcatttatgaaaaagttaaacagaatgtttaaaagtttaacttttgttttattttttgttataaaaaaatttttttttgtaataagaacaaaagtggcagttgcctcctacttcagatccacttttatgtttatttgtccttcagatccacttttatgtttatttgtccctattgatttcttaaatttattgatagctatattttctccttagaaaacgaaagcattagtgcattttgatttctctttgatctccttaagggccacattttggaaaattaaatataatataaatggtgttctctggacttgtgtaatcatgttattttaaagatattttgttttgtgttgttatggatgaattttctccttttcccagctttaagaaaattcctataataaactttacccagtatttgattaccttttgctctcatagttcttgcaacatcctcctgagtcactcttttcatttgaatgctttctctaagagcaattttaatgggagtcttgtaggtctgaagacatcttcattagctacaatatttgaatgacaatttggctagatttaaaattataggttcagtgttcattttcttaaatactttaaaaatatttcttcattatccgcttgcatctagttttgctgtggaaaagtatactgtcattttgattcttgttccttagctataaatatattctttttcttagtaagcttttagaatgtcctgtttgtattagttgttttaaagtttcattataacgtatccaagtgtttgttttaccttatctctattgttgtccatgaggcctttcaaagatttttcatcttttttttttaattttaggaatttgtcatttctgtaagacaaggacagggcaagaataaccactattagcattattacttgtcatagtactggccaacaccataggaaaggaaaaaaacaagagatggaagaatcggaagggaaaaaataaaactgccgttactttcagaagagattgtcttctacctagaaagactatgataaccaacaaactattagaataaataaaacagttcagcaaggtttctagaaataagataaactctcaaatattagaatttttctatagcatcactaaccaactagaaaattatataaaaaacaagatgccattcacaatatcaacagaaactataacataattgagaattagcttatttaagaatatactgtacttctgcggagaaaatttaaaaactgtaataataaaaaacatggaatatgatctgaagagatggagagctgtcccatgctcagctggaccaaattaattttataatgatattactcttgcttgaagtaatctacaaattcaatgaaaaccaataaaaatttcagtgtttttttttgggggggtgctggggagtctctctctgtcacccaggctggagtgcagtggtgcgatctcggctcactgcaacctccatctcctgagttcaagctattctcccacctcagccttctatgtagctgggattacaggtgcccaccatcatgcccagctgatttttgtatttttagtggagacagggtttcgccatgttggccaggctggtctcaaactcctgacctcaggtgatccatctgcctcggcctcccaaagtgctagaattacaggcatgagccaccatgctggctggaattttttgaggaacttgatagacttatctgaaaaatttaagctgtactataataaataacaataaaaactaaggtacaagaacaacgagaccagtaaaataaaataggtccatgtacctaaagtatgtatttctattcaaaaaaagcacactatgaataaagttagcagatgacaagagtgaagaaatttgtgttgagtaaaactgaaaatatctagaattgtacatctagaacacagatgtgcaaagaatttctgctgatcaacaagaaaaagggcaatcctggtacagaaattggcaaaggaatgaacagacattttaaactggcaagaacaaatactacacttgatcttagccaaaaggccaagaggtgattgaagaggtattttggagaagagaaactccatagggttaacatgcatatgaagacatgcttccatttattagtattataatgtaaaataaaccactacactatcactacactattacactaaaacacacacacacacacacacacacacactacactgttgctatcactacatgtaccacactggcaacatttagaccttggataatgtcaggtttggtggtaaagtggaaatatgagaagctggtggaaaaatgaactgctggtggaagtcttggacagattagtattcagtcagattaaatatacacctattctttggcccagtaattccacctctgggcatataacctcaatgaaattttcacatgcctctgaaaaaagatgcatataagaatgttcatcaatgctttgtttgtggaagaggaagttggagacaatctgcttaagtgaaatgcagcgctcacacaccatagaatactttgcaggtgttaaaagtggtgcacagaatgtctacatcaatgtggatagatcttacaacactgtgctgaattaaaaaataagaaacagcgtgaaatgtgtaatataacatcacctacataaattaaaaatctatacatgccaaacaatacagatcttataagaacaggcacaaatgtctacaaataaaagcttcagcatcaaccactgaaaagagttgccctgattggaatggtgggtgggtgatgggggtatgaggggacaggaaaaagaatagacatggaaaatgagggggaaagtagatgaatgaataaataaattactgagcaaaataagataggggcttttcataaatcaaaaatgatgagaatgaagatgattaaaggctaaatgaaaagaaaagattaagacttggcagaggtaatgacatgtaataagcactctgtaaatatttattaaatgatggaagaaatgaagtcgatggtgaatctttttgcaaagctaaaatttatttcacaatatgaatcagtgcgctttaataaattattttagaagttttgatgtttgtatatcagattctttaaaaatgtgagcacacctgtatttggagtcatctggaccatgttcacagattttttcttcttttcttccacttcttgagacattgcataaacatagtcgcctcttttgaactatgccatgcagtttgacttttgattctaagtcacagaaaatgttttcctggaaaatatttgctgtttcgatcaagtcttgattccaaagcatctgcctgtatgtggtcactgatatgcagggtatttgctggaagaaatgagctggaatctgcctcatgagctgtgaggccataagaggtgatgggtttatcgctggccatgatggtgggcttgcccactgacattttgtttttctgccactgtacaagatctgatttgtcagagtagctctgggtctcaccttttccttccctctttccagaggacagaaatttattccgggggatatagcttctgttgatctgcttcaggttttaataataatgatcctatattactactaacaaacatggctgacacttggcatttactgctttcaacttaataaatatcttttattttaatgatttagagctctggctctagtcagatgaacttgggtctggcaccagcctataacctgatagcttggtgacattggacagatgaaattccctaagcatttgtttgtttctctgaacaatacaggtagacgtttccttgcagcgttgttgtggtgactagattaggtaatgtatttaaggcttaacatggagcctcttgcacagtaagtggttatattattactttgtggaaatcatcatgctaggcctgtggggagaaactgagatgaataagaaaaagttctgaatttcacggacttggagagaataagacatgaccaaaagagacaaaagacagacccgtgggagagaggaccagcgaggccacatatcctcctacgaacctgtgagacactcacagaactggttcttcattttatagatgaggaaactgaggctagaagagttatgtgacttgttgaaggggacacagtgagtgagtgtcagagccttcatgggaacccacgtctcctgtgactgaggcaggcctgagggatgtgcctctgtttctcatggaaactccttggcgcagcccaaggccttgagatgctgccccctgccaggccagggtgtgggctgccagccaccacagcatgggggcctccactgtcctgaacttcagaggctttgcggggagggcttataggcagccaggagacagccttctctggcttttaagtgaatcattgataaaatgttgacagcatttctcctcaagacctgccctcaaatcagcaaccgattagagacagtaattcataactttatcagatgaatttttattgggggtcactatgctccaggtcttgtgtggggcactggagaggcaaagatgaaacctccttgagaaactgtcagagtcatgtgacaattcaccatcacataatgaacaaagtgctctaagatctgagaagacgaacaagtattctctgggctgggggtttgtccttccggcaagagaggacggcaaggtcaaaggcagggaattgcatgggtgtttggtggtgcttagagggcactgggaccagtggtaggagggcagttggtggtgaggctggaaaggaaggcaacggctcgattgtgggaggccttctaggcctccagctctgtggctgaagggagaaggtgaatgctttgtaggctaggggatagcatgatcaggtctaggtggtgcaagatggctctgaggcagtatggacggcagagcagcaaggccccacacctgctctagggggtgtgccaaggggtcttgaccccaaactgactgagtccctggagcctgagcatgtggacctcagatatgcagtggcagaaggcttccaaactgtgaaggaaccggtagccaacaccatctacacttccagatggtgagcccatgacttacttaaagaagcttcctgttatcagtgggtgggcactcgcaaagaggctctgttcatcttgtgcctacaagcccagatccagtcaaagagcacgggcatgttctccttccttccttgagggttggcctctttctccgtgggcatagccgacatcagagccagcgcccccatatttcagcatgattaagccttgccattttgggggtggctgggggcgaggggaggggctactgtgtttcaaaatggaataaacagaaaagcaatattaaaagaatgaggaggttgtttactgaggcttgaagagatgacaggtgtttcctcccagttgagaaccagtgacccctgggaatcgcatttcccgctgagcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggccgtggctgcccgcgctgcgctgttgctctgtcccagctggctagctccgagtgtggagcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacgtaagtggtttggctgtggctgtcagacccaagcgagtgccagcggggcagggcgatcacagcttggcctggaattggggagctggtggtggaggtgatggcgccacggggggagggggtctgggttccaagccccggagcagggagcggggaggtgggcgggatggagcctggtggagaaaccagcctgtcagaggtgatgctgattttccaggctggaggggaacgaactagtgttccaaggtgggacggctcagggtacctccgcttctgtgtatgaatcactgtggtgaagaaagggcagtttatgattcacacaacaaaagccagatgtgggatgggtttggggttgggagggaaaagccatgcagttctttacaggaggggctttatttccataagcagtggctcttcagccttctgttgaataccctgggcctgtttctagctgagtgacttagctttctgccagggtgtgacttgttcctgtggataccctgggaggagtggagatctggcttggtgaagcgtgtcctcacttgctccactgtcttgcctttcgtcattctttttccccttctgtgacaaggcttgtccatcccactgcaaaggatgcagtgggtttatctttggccttgatttttatccccggagttggatggaacaattgtgaactttattttcctttatgtggaccaaacagcgacttaccttactaataactgaaataatacagattatttacaacattcttttcacgaggtaaacagcgtcaactcatcagcttctgagagttgaaccttattggggctagttctatacttcctcaagcaagaagaatgaccaaaaattgctctgtctttctcttaaagattcttggttccttaaaattccttttaattaatttaagtatgctgtgcctcaagcaagcttaatataagagaatctagatttacagaagaagatatattagggaatgtttttattttatggaaagatacttgattggatccactaaagttcggaaaatataacttcattgattaaaatgtgacactgtcatcaccaatttattgtttgctttatgtcttatgtaaatttctctggaattaagctgattaaccagtaacacagaagagtgatttcaaaatttctcaggttgtgaagacccaccattgtttgatatcaaaaggtcaattttttaaaaaaataaagagaaatgagctttaatttgggtttgagagttacggactccttccaagataactaggaatattcaagaattgttggcacgccactcttcccaacaggcgatggagcagcggcagcctatcctttctgggacaatggcagctgaccctgttgtgagtgctctgtggatgagagcaggtgggcattcatctttttactgggggcccctaagcatctgtgtgccctttcactcagggctgaatcatttgatttttgtgtgagcccctggaaggagttttgcctcagctcctaccttctatgagcaagccactttcctttttctcaatccttaggttttttgtatgttaagtgggggtaaaaatcatatccacactgaggatctatccttagtaagtgaggtgccaccgaagtcatgttcattgctctgtctgcatcagcctctgagatatgagttgcttccctgcattcaccatctgccatattctcccctcttggttctgtagtacattttttcatttctaattccttctaagagatgaacagactttttttgtttgtttgtttgttttttgagacagagtgttgctctgttgcccaggctggagtgcagtggcgcgatctcggctcactgcaacctctgcctcctgggttcaagtgattctctcgcctcaccctccctagtagctgggactacaggtgcccgccaccacacccagctgttttttttttttgtatttttagtagagatggtgttttactatgttgttcagcctggtctcgaactcctggactcaagtgatccacccgctttgacctcccaaacaggtgtgagtcactgcacctgtcccccaaattttttaaaggggatgctggagggcatgcttcctgctcacaccctggagaccagtcagatagatcaaaactccattgtaagggagaccacattgtaagctcatcaatggaataactggggtgaatgtttccacatgttcagatgaacacaaatcaaaattatcttgaattgtcctttaagccttaaaggaaaagtaggagagaccctgggctctggacccacccccttagcctgaacccaagtatgtggtatagagggcacctgggtgactaaaccgtgtgggaaaatcagtaaaaacagggcagcatgtcagcccacttagagtcacccgatggaagggcagggtttgaaatcagacaccaagagtgctgaaagggcactttcttttttcagaaaacaccctcgaggcatgagctgaaatgactgtactatggggttctggaaagggttaagaaaacattcactttgtgaatgttacctcctccctacctagcccatgaccctagtttgtggactaaatgtgaaccctggcttttggttaagattagagcataaagtgacaaagcccagaactgctggcacagagaagtagaaatcttcaagccccaaccaatggatttgagatttgcttgatgggccaattggatgaagaagtcactccatctgtagattctctccctgggttctggacttggacctgctggtcaggtgcacatgtgaagaattaccatccctccccagctagtaacagtgtagtggaaatagcaggaaccttggagggagacaggtctgaaagttgcctgtgcaacttagttctttctttgtgagaaggaaatttccattcatttccttatctgggaagtggggattctaatgtctgcctcccaaggtttttgtgagaattaaagtagagaatgtaggtaaaatgatagcaagtttcctgataagtagtggtaggggtgagttagtaccttccgtcctggaaacctcctgtgggcccatcttgaatgatcagtgttatgttaaattcatatattcttttccacactttgattagaatagttaaaaagccacagtctaaatattcttgggtgataggatattgcaaaattttccaagggtctaaaatagtggtctgcaaactatggcctctgtgccaaatcaggcctgccactccatttgtaaataaagttttattggaacacagctatgtctatcatttgaatattgtctagggctgcttttgcagagttgagtagttgtgacagagactgtgcagcatacaaagcctaaaatattttctctctggcttataatagaaaaacattgccaacctctggtctgagatgatttgcttggttcttcaggcattcatttccttaagatactcagtatcaggccgggtgcggtggcgggcgcctgtaatcccagcactttgggaggccaaggcgggcagatcacgaggtcaggagatcgagaccatcctggctaacatggtgaaaccccgtctctactaaaaatacaaaaaaattagctggggttgtggtggcaggcccctgtagtcccagctactcgggaggctgaggcaggagaatggcatgaacctgggaggcggagcttacagtgagccgagatcgtgccactgcactccagcctggggtacagagcgagactccgcctcaaaaaaaaaaaaaaaaaaaaaaaaaaagatactcagtatcctggggttgtacattgccaacaccaatgggaaataaaacttgcagccaattcattaaataatttgtacaatgccccaaactgatttgattgaatttcttccttaaaagtgatagaactgtgtataataaactgaactccatttgttagaaagtgaacaaattggacagttgctttttattgttgttgtttgtattagggaacaatctacatgctaatgaaaggcaggcttgactgattttctttggactggctgattgtcttggtgtcctgtggacttggccttggaacaggaaataattcgtatcagattattatgtcatggatatgcctttgctttcagacaacttgaacagagcagagatttagcaaacagaaaaattaaggacttaaaattctcatcaacatagaactctgctcttcagatgtactctagggttccactaaagagccaatattgtttgggaggcagttaaagataagtaaaatgtgtactatgcatataatttttggaagcctatctcctacataaatttaagcacaacttacaatgagaggtaatttaggtttctggacaacctctaatatttctattctatgttacaacctttgcttatttaataagcctagtgagcacctttacttcttaccaagttgattccattgattcagcagttctttttttgagatagagtcttgctctgtcacccaggctgcaatgtagtggtgcaagatcagctcactgcaacctctgcctccaacttcaagtgattctcctgcctcagcctcctgtgtagctgagattataggcacatgccacaatgcccagctaattttgcattttcattggagatggagtttcactatgttggccaggctggtctcgaactcctgacctcgagtgatccacctgccttgacctcccaaagtgctgggattacaggtgtgaaccaccacgcctggccaattaagcagttcttgctgttaagggcaagtagaatccaaaagagagacacaaattcacgtgcaccgtctggaggtgaaataaaggacaaacatcaaccaaatacacagatttaattggtaaaagagcagatgatgttcttgatggatattttacttcctgccccttatatttatttactaaagaaaatgccagatttgtccccaaagttactgactcagaagttttgaaagctctctcccaattcacacttgggattctgttctttcatgaggaaccaaaaaaaaaaaaaaaaaaaaaaaatcaagttttcctacagctgttcattaaatatgtggacatttaattcataaagaagtcttataaatatttgcttttaactttcccactacaaagtgttttttccccctttgacatctttctaaagtagtttatcttcccacttaatgaagatgtccacctatttcttattctgagccaaccaaaccaaagttggctaattgattatgaatattaacataattctcacctttatgaaatgcttaataacactctagttttctcatttttgtagaactgcttgacaactaagtgagcctacctgggatggggaggccttctctgaaaccctcttgtcccgcttgtgtgatactggggacaaagcacttgtaggcaggagccaggggttttactttccattctacagataattagatgagagaccttaagcaagccacctaaccactttgggtctcaaatgttctagtgctggaatggaacttgccttttcctggctaattttcctggagattgaacttgattgaggttctttgccagctctaattgctgagttttcctgagtgtttatacaaaaaataaattaaagtttaaaatcagaagtccttaatttaatagatgggattcttctatctgcttagggcagtgtttttataccttggctacacactggaatgctctgaggagatttaagaaacacagatgcctggatctcaacctagagcttctgattaaattgtcttgggcattgaaggagagctgcaaatggctcccaggtgagaaggctgagaactgctgacctggaggttgaaatggatggcttctaataaacctttgggcattgctaagagcagaagaatgctcaatccttttaacagtgataaacaaacatctctggggaatggagaacttatttggtgctatgcagtatacaaaatgttctgttggatcagtttggattacatttgattgctggtgaagagacctgaaataacgtagatttaagtaagacagtggtgtcctttctctcacataaaagaagtccacagtagggtgttcaggatcttatggagtctcacagtgccaacatcatcccaggctcctttttcctttctaatctgccatccttggcatgtggctcttgtcctcaagatttttttcatagttgccattgtaactccagccattacatctgtgagcatcacatcttcggacaagcaagaagaagaaaaaggaatagcaaaagatcatgcctcctgatcgctgccccttctccctcccaacacacaacttctgctgacatctgatgccatttctatctacaagggagaatagcataattgtttagctgggcacattgccaccctccataatgcaggggctgttagaaaggaagggaaggtggatgttgagtgtaacaactgccagtcttcactatgctttgagtgcattatctcatttaatcctcataaaaactccatgaagcagattctgttgtaaggttcattttatagatgaggaaactgaatcatgaagattaagttagtaactctcctacaaagcaaaattcatgtgaacagacctcaagtgttggcctgctaagctgtcctgtctccctgccacagtgcctgtctctctcacattgcttaggaagtattcttggtaaaagcacaggccttccatgtcagataagggaccaatggcaaaaaaagccctgcagatggtagttcataccatgagaaccccttttgtttaacatttacttcagcttacctgttgaagaaaacaaggtctctgcttgctgctgggcctcttctgcgggacagtttgaagatattttagctataataaaaggctcagagaaggatctagagtttgcccccaaataacccagccctactcttttctgggcagttttagtagagagcccgatgtagcaggcagcctttgctgggagccaaggcttctgcctccgtggcacttccttgattctgaactttctagactttggaaaagtcaggctgctccttcctctctctctctctctctctctctctctctctctctctctctgtgtgtgtgtgtgtgtgtgtatttgtgtgtgtttaggtggggtgtggagagtaagatgtagagagtagggtttaactttgagttagagagtgacacttctgttctttctttgcctttagtagttaaagcttagcttctggggcaggcagatctgagtttgagtcctaggtttatgccttactggttgtgtgacactggtaagtcctttttcctccttctgccaccatttctttataggcatgcaccagaggtgtgactcttaccttatgggattgtggtaggggttttctgctgtgcttggcattaagtaaacactcaataaatattagttgctattattattttcccattctgtcacaatctacctctgaagacaaaggttatgccggctaattttagattacaatttgtatgtcctctgagttctgaatttcttgtgaaatggcagggcacacatctccagtcttgtaacttgtggtgggttagtgatcatggttacttctgatgattaatctgaccattctgtgatcaaacttggaactcgcgtcacaattttcctaccgaccttgtaaggtagggtggcggcaagacttgtactgactggcaaactcgtgtttgtttttttaattcacaagattggactgagtgtttgtaatctagttgtgagcagaatgacacttgaaatatgcaagaaatagataccgaaaactgaaacaacaatgtgtggcctccttttcttagtaacagtttcattagtaccactttctgggaagagctggtcaccaaaagattataaaccagaatcattctcagaccaggtgctgggacaaaaaaggatttgaccagtcttaaactgaattactttttaatgcactagaaagagccatacatttcattggaagacagcaagcatacaggacattgttaaaactttccaggactaggaaatgctgaggtgacagaaaggaaagaaaagaagagaggcaagagagttgacaatagaagcaagtcttaatgttggatgaaaggtacaccaattcaggaaggaaaggtatagaaggaaaatcaaccatctattcatcatcccatgcaggtatgcatccctctaagcatccatccaataatggaattatttccagctagagaaaccaaccaatgaaataaattatcttcagcagaaggtggggatgatggaatcagggaaggtgtcatggaacatatagcattgggtttggatcctgaagaatagatggtaatcagacttcttgcttagatcctggggtgtgcagatgcatcttaggacataaaatattagcactgggaagaaaatccaaggattttaggctgatgtctataacatttttgctacaaactcccttattcaaaccaaatctactgtagaacttcagtataagaataaaaatcgtgcggttttggggggctatctggagctctgattgctcatgttcccccacatttccctgccattctcactctgttggcacctgcaggcaccataactatattccagggttcttcaggtcacagctggatccccctgacctggccaatctacccctctttttagcaagatccctgctagctggtcacagagagtggcagtgagtggctgtgaaacatattgcattggtcttcatcaagctctgaagctgtgaagactatgtgttcggtctttgtgggtctcttgtgaataaagagggggtaaattcctaaaaaactgaccaagtgacttctttctcaggcttgatactaacaaccactccccttctccaatgtctttcataaaggaatcccttgcatcatgagggccattggttagcaaagctgaacattatccagaaagctcctcttgaccagctgtgatgtttctcatgaatccattgttagggctactctcacttgcgaaggctacaccccaggccaccatgagccttggaacttgggcagttgggtctgaccccaaatacaaaactaatgctgggatctgaagagtccattctccaagaaagtggtccttacatgatggtctcaggaaaagttaagttttttcaataaagctctttagtcttgaaaagccaaaattagatattgcttgaatcaaggaacaaaaaatcggatatccatctgcctcctccagctgcctaactacaggttattcccatcctagctcagatgggcaattctagattcaagccttgatctaataaggaaagagacagccctttcctctgctccatccctcactatggtactgccttgctatagaattggggtggccactggggtaggtggactctcctcattcaccttctggtctgggacggtaggtctggagctctgtttaggccctttctctttcctgatgccccactctcagcaaatttgaggcaatgccaaatatgtaatccaggaatctgctttgctctacaaggtgataaaactcccatctatgggcactgaagagccctcccttgcccattgccacatttctattccatatgcgatatgtgctcctaggtttctagcccccttgagggagtatctacaacatagcctcagccatggctgtgtccctggcctttaggagatacatataggttccttaaggggctgcatctgaggtcaggacaagggaatgccatcatactctgtctgcaacctaatcgctgccattcaaaaatatccaaggtttttcatttctgaagtcatactttaaaaactcacatctgctgcaaacctaatcctctggtgacttctaaagaaagaagtcttctgctcagctcatcgtatctttataaaaggccatttccagggtttggcgtctcctgtctaggattgctgtacgaaagcgaagtcttttaccagcccctctgcagcatcattggcttccctgtctcctaagtaggggtatcttgctgcctggggattccaggtacctgagggattaattccaggagcataatgaaggcaggtagagacaggcctggcaggcaacagaaggccctgggtatgctgaagacagagacattcagtatcaggatgtagctgaatggaggcaagttagggtcactgtaccaaggctacttctccgatgacagatgggccatggattgttggctgagatcaaggagaaagggctatttgttgggagctcattatgcaccaggtgtttcattgtgttaatctcatacagttctcatgattaccctttgagatggatattattactttcattttgcagatggggaaactgaggcacacaatggttaagtgatttgccaagagtcacacaggtgataagcaacataacaggctttctaaactaggtctagtcccaaactgtaccacactgcttctcaatgacaaggattttagtgttgcactgggtgcttcttcctctcccaattgaagagggccctcgcttagatggaggcaggttatgacttcatcaagggtagctctagcctggcacaaaagcctctgcagatttggatcttagcaagtcacgctcgagactcagtatggaagctctgaaacctactgatttccatcttagaatctgagttccctggactcctcttctcttggtgggccgatcagccaagataggataggaccagctagtgacacacccttaggattcactcaggacctgccacttagagtgtctgggacaagggtctgctcatggtgaggcctgagtctctggccccagaccagcccctctgcactggagatccaacagtcatatctcttgcactcacctctatacagtctctacagacttggggccccagtttgctgcttgttcaagccttactaaaccaggtgtaggtggaaaccaaccaaacaaaccagaaccacttcagttctgaggcagatgcagctctgtcacagtttgtaattctaaatttgtttgtgcaattatttgattaaagtctgtgtaccccactagactagactgtaagctccaagagggcaagaacctcatctgttctgctcagcaagtacttgttcagtgaatgctctgccaggggtctcttggtcttgtcccctaccctgggacacagtgtatctgcgaaccctttctgctccggtgaccccagtttctgtaaaaggcaggcagatgcagctgctttctcaggtggacctgtccgctgtcatttcagtcgaaaaataccaaaaataaaaccttgcggggaattgtttgggtctctcagttctcgtcactcctcatgtgagaaggctgctgacaaggttctcgtggacagatctctcctctcttggctgggcaacaccatttcttggggaaactggcaattgagggagactggatcagggtagtccaagcccagactttaactggagcaaggagggttaggatggggccaggaatcatttgatgattaactgcagtgtcgctcagagaaaaaaatgggacttgcccgggcagagacaaggcaggcagtgaggcagaagtggagtgtccttggaatcacaggtcctgggcttggttgaggacactgttacttacaagtatagtcgtttggcaagtcactgaatatctctgagcatcaatttccttctcggtaaaggaagggagcggaagaggaatacgttgtactgagcctctatctgcaatcattagtgtcaaaatctctatggaacatcatgcaaataggagtgtggtgatttcagagctcccaagagttaagaatgtgaccaggaaacacatggacctttaccacccattcattcaacagacctgagtccctgggagcagagaatgggtacaaacagccttctgtgcttgacctgatctgcaggaggctcagaggaagggaggtgtggtgtggaaggtgcggagagcgccggggaaaggatccctgggagtcttgcctgtgagggaagggttagagggccactgccacgtggaaacctctcgcactcaaggcctttggctgcccctacctgcggttgtggggcgggacacccagaagtttagggacaatccaagtaatcctgaggccttagggtgtaaatgctcaggtctgagcttggtggagaagggtggtcttctgtgggtcagtgggatcttgacttcagcctaatacaacctagagggatccctgtgactgccctgggggtccatttcctgttggctatgacctctgttaagtaggaatcacttggcccctagaccacttttgtctggggctctgtggctctaagactgaaaaaccctctgctgtcacctccaacatactttaagagtgtcccctgggtctcgttgtcagggctcttctttctaggtcctggtggcttgcctaggtctggggaaattctcagtgaccgtggaccctggttcagcctttcccaggggacctgcctatggttgatgagtgagatcttcagggctgatgggaaggaatagtcttttagaatgaggacacagggagggcacatgtcactgtccctttatcttctccacccagaccagagaacgtgaggtcagccaccatctttgtgatctgatacagacatcccagcctaccaagcaagatattacaacttattcttcagctgtccagcagccttgcaggcaacatcaaattgtacatcaatcatggttcccctttctctcatgtcttccaaccacctttaacgtcagttttctccccctgctgtctttttctcctctgtcctgggtatcatccagattgcaggatatatgagtgatgtgtttataattcctggctgcagggtcctctcagttcaaatgttagtgaatggaaagtctgcgtttacatgcatatgggatttctttgttggcctacattaaacaccaacaacaaaggtcaactaaaatatagtgtaaatgagcgggaaagcctttctgtagtgtgtcaagtccaacctttggccaaaacccaacttctttcttcctgtttggaaaaaaaatcagccattgtccatgaatggaaagaacaaatttgaaaactttgactcagaccgtaactgtaagaaaagcacccacattagtgttccagttaaagatgtgaataatcctttagccaactggagttaatgttctctagaagtccttgggccacaagtacaaacaaaattctttgcatgaaaatgtaaacaaattttttttttttttttttgagatggagtttcgctcctgtcgcccaggctggagtgcaatggtgcgatcttggctcactgcaacctctgcctcctgggttcaggtgattctcctgcctcagcctcctgagtagctgagattacaggctcctgccaccgcacccagctaattcttctatgaaaatgtaaagaattctttatacgaaagtgaaaggtgacaacgactattgtgacttcattttcagttagaagccagggcaagtttgttggccatagtcttgaattcctattgtttgattagttttgctacaaataaagagaaaatcgtatttcttctcagtggggttttttttccttgaagattcaacagcagaagatatttccattgattacttagagtgatcaacagtgtgtcactattaacggtgtgtcacatgtccttctgggctaggggcttttatcttgcaaaatggccttgtacggctacaaggtttacctgttgtttaggtaagttcctaaaaaattgaccaagtgacttctttctcaggcttgatactaacaaccactccctttctccaatgtccttcataaaggaatcccttgcatcatgagggccatttgttagcaaagctgagcattatccagaaagctcctcttgaccggccgtgatgtctctcatgaatccattgttagggctaccctcactcacataggctgcaccccaggccaccatgagccttggaacttgggcagttgggtctgaccccaaatacaaaactaatgctggggtctgaagagtccatcctccaagaaagtggtccttacatgatggtctcaggaaaagttatgtttttcataaggctgtctttggtcttgaaaagccaaaattagatattgcttaaatcaaggaacaaacaactggatatccatttgcctcctccagctgcctaactacagatcattcccatgttattcctatgctagatcagatgggcaattccagattcaagccttgatcaaataaggaaaggtacattcctctcctctgctccatccctcactgtggtgctgccttgctgatttgaggttcaaccagtcagttgtgaatggagagtactctcagtaggtgagatggtgggacggaaatgcatgcttatcctgcagcccacctcgccattagagcaactctcttaactgttatccaccctggtgcctggccctggcagctcatgggacgtcacaagaggacaatggctgggagaaggaccttctctcaagggtgccttggaggctgttttagggaatgaatggcttctgacatgggctttcttaaagttgccccagaagagaagttaccattgaccaggccctaggtgtttgcttagctcagagccatcaggagggtcttagctccttagatgagcagctcctgcactgtggtgtgaacgtggtttgcaaggtgccattaaataaacaagtgctgacaattttgcatgtttcctgggtgatattttattatactttcatcaaggaactggagcaccatatttatttaaatcagtacactccatatgttcctagcttggtgcaaagcaggcacaaatgtccacatgcagccagggtgctgactgaggtgaccagtttgcttgagttttcatactctgcactctccagtggaacagcagctgcaggactcttatttttgtgatgtggagcatgtctgggtgtgtggcagggggaactgaaatagtctctgctgactttttgtacctacagattttgtttcattgctcattttggaaaagggaagcccttatggggccaaattaatggtttttctgtaaatgattttttttccccctcaaactccattggcttgacttccagtggtatagaaaggcaatatggtgaacttctcagcccgaaaaaggagatctccaatcagggccgagaggctcatgctaaggtggaaagattttcctccgtgatggactcttggatacctacgggagacttaaaaggccctcagaccacaggattaatggtgagaaagcttcaggctttgagggtgaactacttggagttacaagttaatcgggagcttattaaaatctctggagaactctactgtgggaaattgggcttctatcttctctgctgatatcttattatttcaatctcctggtttattttctttggattttttattatgattttaagaaattatttaaaaagttaaaaatatttcttttacgtattccagtttagttgttttgaagttaattcagggatccgggatccccaaggtgaggcaaccgtgattttagacaaacttttttcctctcccaaatttgtatttgtgggctcagttctcatgctggtggcagtagggagctcagtgtttactgtggaattaaaaatgtttattgttgctgcacataggttggtgtgaaaggtaccaactgcaagtttcaacttgcaaaaacacttggccgttgggctcctttggaatcgtcttgaagcttcagattctgatatttcatgagcactttgcaaagtcactatgagaagcaccctccttcttacctgctcagctggagtcagttacagaattccttggcagctggctgtggacacgtgccgggcagtcaggagacccgtgggagctgtgggagtcctgcaacgtcaataggaagaggtggggacttagagattgccccacatatggtctgttgtgccagggcacacctgttgacactgagttccaaggaagtccagacattagagggtgatactctctgtccacagcacctccaccaagcgctctttgttcatcgacttagaaacagtaggaggcgggaagccctctcttgacaagatcctggaagtggccagctggtccctttccagccaagtgtgtggtgtgtccacttcctgggagggactgggaccaggaggcctctgagcccttcctcagaagtgtacatgcaaacaagagggggctgagccatacacctgtctctgagatggtctgagatatgtgcatatgggattgagcccttcttgttcctcagctgaattaagagggtgaccacagtgctcagacccccccaagtaaccccatttcccaaatttctcttgagtacacaatgcctcagactgtactttatgcctaaggaatagctgagaacccaactgaagacaagtgtgaactgcaggatatggttgtgaacagaactgacgtgtgcaacagcatggatggaactggaggacgttatgtgaagggaataagccaggcacagaaagacacaattctcatgttctcacttgtatgtgggaactacaaattcacacaattgaattcatggagatagagagtagaatgatggctaccagaagctgggaagggcagcagggggagtgggagtggggatgacttatgggtacaaaaatatagttagatagaatgaatatgatccagtatttgacagcacaacagggtgactatagtcaacaataatttatggtacacttaaaaataactaaaagtataattggattgtttataacacaaagaggtgacaaatgcttgaggggatgggtgctttatttaccctgatgtgatgagtgtgcattgcatgcccgtatccaaatatcttgtgtaccccataaatatatacactgactatgtactcataaagattaaaaccaaaaatgctgacgtggccatggggtgaccctgagaaagagtgagttgagtgtggcagggcaggtgccctgttcgctgacacgtcagattgtacctggggcctgtggtcatcgctgggcaccacccagcagtagggaaagtggcaaatggaacttgtgcaagagtgactcacccagaaggaaggtggggagactaaaaccatgtcatttagaaatagctgaaggaatgagaagtcccttcagacctagggggacacctggtatctgtcctcagatttcggaagggaatattactactaatactcatgataatcggagctcacatgtattaaatgctctgtgccaaactctattccaagcacttcacatgcaaatcttaaattaccctacaacatacataccattatgatcttcactttatagatgagacagctgtaaatggactaagaaatgtgagtttcattagaaggtaatggagggaaatatggcatgtgttaccataagttagcctcagtaggaggaagagctgtctgacatgataatatccccccgaaaggaaggtggaaatggccagaaggaagataattaaaaccacatgtattgagcatctaccctatgccagacatggcctttgaagctccccatgtattattttggttaatcctcacaaccactgtgtgagagaagaattattattcccgttttacaaatgaggaaattgaagcccagagacattaaataaatctaagaactttccaccagtaagtgacagcccagatttgaatacaggtatgtgtggttctcaagtctactgtcattggtgttcagagcaaaggtggaggcgcacaggtggccccggggcacagaaccaggctggttcccctgctagacactcctatagcagcctgaatttcacaagttgtgacacattcatctgctggtaacttttgttgcttgtcttccccgttagactgcaagatccacgtgggcgggggctccatgggtcctgtgcagtgctgtactcctaggcactagaaatatttgaaaaaatgaatgaataccagtagagatctcttgttcagacaggggaagttaaaataaggataatgaatctcctattgggatgttatcgggagattcttatgttaaattaggaatggattatcagcagttgtaatcccagtatattttcagaaatactggacagattttttttttttttttttgagacagagtctctctctgttgccaggctggagtgcaatggtgtgatctcagctcactgcaacctccacctcccaggttcaagccattcccctgagtcagcctcccaagtaactgggattacaggtgcctgccaccacatctggctaattttttgtatttcagtaaatatgggctttcaccatgttggtcaggatggtcttaatctcctgaccttgtgatccactcacctcagcctcccaagagagatttttatacatacagattcctaggcctatatcagccccctagaatcagactctcctggagcaggacctgtacctgtatattgcatcatttcctggttgatttgctacctggccagctgagagaccttggaggatgggtctaaagtccacctgagatactgggattcctgacccccaacatctgcccctgggactcatttcccacttcctgttgcctctgcccaagcttctctctgccttctgggcttcaaggccaggccttgctcgtggctggagcctggagggaggtctggtgccgagtcaggcatgggaccttatcagctgggtatttactgagcaaagttcaaccagggcagtgctgcagatccgggtttaacagatacctaggcttccgggactttgattcagagcccaggtccctggggcccttatcggtggataataatgggctccctgtggaagtcctaaggtctagtgtttcttggctgacccaggcctgctctctgagagcccaggatccctaggccacaggctgtctaggtgggcagcttgttgcttcccagccacggctgcttttcagttgctctcccaggccaggaagggccctatgcactggctcttatttgggtcaatgctttggtttcctggctttgatggcaagaggggaaggaaaccttccctcagcagcaggtggacactgtctggccccagggtacaaggatcacccttgggtaattgtcccatgccctgaaagtcactgagaacctgggagccacttgcctcaatcctaaaggtgtaggagaggtgaagggaagacaaatggcagcatgtcttaaagaatcacccaatcgattaatcaataagtatcaactgagcttaaaacgcatgggcatgccactgggaagacatagagaaataaggtacaataactcaccttgagacgtttataatctagttgtgggtataagacacttccatcaaaaagaataactattacataatagactgaatttttttgaatgcctaccctgtacctgaatttatttgaggcatatactgttctaccaatttcccacatcaagtgacttctctcaatattcctttgataaagaaactgaagattaagaggcacagagaggtttagtaacttgcccaggatcacacaggaaggtggtggcaggggcaggatttgaggcctgtgctatctggctcagagtccctgctcttatggctgtcctctactgccacctatgatgaatactaatcagatctggaaatgtttgagaagctgtagaatgtggaaattactcaggctgcaggggtcaggcaggagggttgcatttgtcttgtgtcagcaagaatcaagaggttggaagaagtgagagggaattctgaccacggaaaacctcaaccacagatgaggaggtgagacacgcaggaacacgtagagaacacagacagaccttctggttggagacagggtttgtgtagtagggagtgtgcaaagtggtgagaaaaatgggttcggatctcattctgaagactgtccaattctaggacaaggagctgggccttcgttgtctgggtgcaggggacccacagaaggtttgggagtaggaggagtgacaatactggagaggcattctaggaagtgtcacgtggttctccgtgttcaagcacgacttaggggagcaggcagatccatgaggaaatgagcactttggggtgggggctcgtctgagaaggaccatgggctccagggacattgcttttcacagccacagctccggagcaagccccagccccggcccggccataccagggcgtccgtgtgaaggagccagtgaaggaactgctgaggaggaagcgaggccacgccagcagtggggcagcacctgcacctacggcggtgagagtttgtgtgtgtgagagtgtgagtgtgtgtgtgtgaaagagaatgtgtgtgtcagggatagtgtgagagtgtatgtgtgtgtgagtatgtgtatgcgtgtgtgtatgtgtttgtgtgtgatagagtgtgtgagagtgtgatagtgtgagagagaatgtgtatctgcgtcagtgtgtgagagtgtatgtgtgtgtgagggagtgtgagtgtgtgagtgtatgcatgtgagtgtgtatgtgtttgtgtgtgatggcgtgtgtgagtgtgtgatagtgtgagagagaatgtgtatgtgtcagtgtgtgagaatgtatgtgtgtgagagagtgtgtgtgtgtgagagtgagtgtgagagtgtgagcgtgtgtgtgagagagtatgtgtgtgagggagtgtgtgtgagagagtgtgtgagtgtgtgagagtgtgagtgtgagagtgtgagagtgtgtgagagagtacgtgtgtgagagagtgtgtgtgtttgtgtgagaatgtgtgtgcgcgcaggcagatggcttgggaggtgaccaaaaggatcaggcaggaaggagcgcaggtcccttggtggaggctgccagggatagagctagggtggagcaactgggatgagggatcagggccggctcagctggcccaccgaacacagctactgtcaaggcctgagtgagcgaatgacttgcataccctggtgtgagttgggggctccccctgagaagaagaagacaccagctccctgagcgcacagacttcctgctaaatagaaacgcaaatctctcaagtgtaggtggtgatggttgggatacggggtgggatgttttgttctaaccagagagattcctatcttctattctcctgccctgaggccctctgggcaagttctctgcacagggccggttgacgagggctaaacattgaccctggtcttctcctctcccctctaggtggtgctgccccatcagcccctggcgacctacaccacagtgggtaagagtgccccgtagccctggtggcccccaggcctctcatctgggtggcatctgaagttctgtaatttccttcttcccacaggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacggtatgtcacacaaaggcaggactgcacccgcccatgctgagtgcacccttttataaccagagctgacttctcgatcctgatcttccttgctattgattctcaagataatcaggtcatcaaagctcgccttggtctccatggaggcctgctctgattctcatttcctgagataacttccacaaagatgtctcgcagcctctctcgtcatactttctgctcctcaggactggggaggtcttctctgattccctgttctaaatctccccagcttccctgcaagcagtgagtcttggttctgagttgaagtttttagtgaatgtggcaccaggcgagatctacatggggtcttgtgttggaactagcctttcatttctattcagataacttagggagtgattgttcacttaataatggggtttaacagaagatttctaggctgaacaacaggtgatatttttgatggtgtcagacccacgtgtggggtaattttttaaagttctgtctctactgtcagattgccttgttcaaatccctgtcccttcacttactagctatgtgactctgggtttagtgacttaaaactctctgagcctcagtgtcctcatctgtaaaatgggaataccaagaaaagggtcgttgtcaggatcaaatgaaataatgagtgtggagggcttagcacagtgtctggcatacagaaaccactaatatatgttagttatcatcatatcaaaatctgctaacattaaccaagggcttgatgggaaaggaagagcctcttcccccgggaatgaaggaaggaagggaaatagatttatgttaatgattcctgttcgactaaaggactgggaattttgcaagtattcaagggcaaaaagacctgtggttacagctgtatccagctccagtccagggaaaccgtgggaagtagagctgggccttgagcagtcccagagcccaccttcgatggtggtgcttgctttggtccaccttgtctcttccgtttccctccagggtccagtgtcatcctgatgcacctgcccctgcctccaagcaccttctatgaaaggcctgcagaagcccttccctcccaggtccacctgcctacccagcaaaccaattttggagcctggatgatgatagataagaaggagttaatccaacacctctcccaggcaactcatttccatgtcagaggcctggggtgagggtggtgggtggaggactcatggctcccacccatttcattaccaaggattcctttcattatttatcccctttcatcattcccaccttctgctttgaaaggttctgtttatcaaacaaacagtattcattaagaattgatttatttgttttgccattttgtaaattaagtcatcaaagctggctagagctgtaagtccacactcctgatcagcagagataagacctgctgtgtgctgagtggaagtaattgtattcccgagcaaagaaacctatagttacaggtttatgactgggaaatgtagaatttccatctggatttttgaaaagctgggaatcatgaggctttcccggattctgtctggtttcaggacactgggatggggaccactggcttaagtcaaaggagaggaagtgattatgctgtggtggggtgtacacctcagcccggatttcgggaggctggaaggcctctgagaccatttccagctctatcattctatgcaaaaacaccctaaagccttgctactcaaactcttgtccctggactggccacattggagtccccctgagatctgattagacatgcaaaatcccaggccccactctagacttcctgtgccagaagctgcgttctaacaagatacccaggaggttgagaaaagccctgccctaaatgattctaacagtttgctgtcaagacacagtgacagtaggagggatatatgacaggggagacagggatggtagggggagattttggcctccctctcatgaatccatgcagagagcatcctcttctatctgctttcctcaagtgtgaaagaaaagtaagaatccaggtcccgcccctgttgcaggcctgatctgaggtttgtgagggcagtcgccgtgcaggtgagaggtatgactcgcagagcattcaggagaaggactctaacacttggagggtcatggggggtgcccataagtgggatggccatggagatcagctcagagacagaggacgatgaggatgtggaaggcaccaggcagcagcaggaaggaaggccaagtttgctgacaaagcagtgcttcccccatctggggatggccaggcctccccatgctggccaccactagaggggtgggaggtgatggagctgtgttggcccaaggggacctccaaagctgttgtgtggagcccggactgtctttgtgtctgggcaggacagtggccaccttccagatacagcttccaggctgtggtttaacatatattttcacagattttaagatgcatatatttttaatgttttaagatctctgaaatagaaatgaattttgtattcaacgaaacctggaaaatcctctctaattggcctaacccaatgagttcattactgtttgtattctatttcgtagatgagaaaaatgagccttctgagcaggaagtggcctgagcaaagacatatagctaggaagggtcaggattggggctgcggttgaagtcagcctggctcctcccttggggaagactttgagcaggaggaggtggagccccatgaagtgagaaaccaggaaagggcagaattgaagggggagatggagacccctctaagggcaaggatgggtggatgggtctcctggggctgctaaccctctgtcacgtgttttcctgtcacagacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctgtctcacctctaggccctctgctggtgctgtggaggccaagaccccattaagcctaaaggtgatgggtcctcgcctagtgcttagtgctaccatgtgggttttgtttctttccttccttccttccgtccttccgtccttccttccttccgtccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgactttgtgatccgcccgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaagttgtctgttttggattttctttttctgcttaagattaattttgacccagatttctctgtgcctgccttaaatcccagtacacaaatcttgaattgtttttattcagatattttttagatttaaaagttcaagacagcatttgagaagatgcatttacatctttgtcggtactgatggtaagtaggtgggcagggctctcagtcctatttgattaaaagccctggttttccataaaaaaagacactatgcaagatttttcagcgtaccatttgagagggtgcagaagcaacctccgtaaaggagttaaagttggcaaaaactagcaaagaaatatagtactttacgtgtttgctaagataaatggtctattttttctcttatcttgaggtcaaatgtcttggtagtagtccatctgggtttcttcccgagttactctgctaagatggaaacattttcataaagatttgtagagacttttctgtgccaaagtgtttcatttcttatcaagttgatccccctaagctttcagtcccatgttagacagtgtgattagaggaaggaacttaacactagtcttgttgactttgcaaattgatctgttgcagaagaagataaaaccagtccccaccgtgcctgcagtccagttctcccaagcaggacatgcgcgtggctagggggcttgttgtccaggagagtggggagctgaggagagagggaaatcttttaacttgattgctcttcctgttattcacgccatcatgagtaacttctcatgacgctgagtgttcagggataagttctaccacgggcatttccatagcaggctctgaaaatccatcaatcaggatccaggagcatgtgacatcaggcaggaaccatgacctaaggaagccatctcatagggccagacatcaccacggaatggaaattccagaagccaattagtcccctccaagatcagtcaatggagtgagttacagtttggaaggggtctccctttcctggtgattttctgagtttctaaaggcctctgagctcactgcctacattgttaatcttcgttggagtaattgttttaaaattatctacactattctgctatgagccttatttccagattttggaggagagagtacatccagttatttagccttctttagattaccagcaccattgtctttttggcttactctccctgaaaaccagaacctagaaaaatgacatggaaggaaagggtttgaggttttatcttcagctttagtgaggctcaagtgaaagggaagatctattaaaaatgcatttgccttactctcttttgaggtagaggcatgaaaaacttgatctgcaacttgaagaagagcatggccagtgtgatgtagattagtgctttacaagattctgatccatgaggctgtccaattccagcataaaacaggctagcaaggagacaagtatgtggctgagatgaagaagatagacatctggaaaagaacaaaatcacatgaccaagtggctcaaattctctgaacatcaggttgcactcatctctaagtggaaatctgaagacatgttctaaagctaaacacaaatttcttgaaatcagaaaccatagataacttattttgcattaatttacttcatttgagtgtcaaatatgagactctctcaataatttcttgttgaattgaattaaccggggggattctctgtccactgcttctaaatattgatatagatgattgcaagttgattataatgaagtctcctttattggatggacagagacatgatgcctggcagatgttttttctgaaagcttgagtagaaatattcataagctggtgatgttaatctgtttgtcagttcttctacagctgtggctgctgtggaaggtgtttcattcattcattcaacacagatttaaaaaaaaattattttattgaaagttgacaatttaaatatgtttgtggggtatgaatataatacaatatattatgggatacaatttacagattgatgttataatttatgaatacaatatgaaatacttaaatcaagctaacatatacattatctccaatacttattttttgtggagagaacatttgcagtttactctcttagaaattttgaaatgtacaatacattattattaattatattcaacatgctgtgcaatagatctcaaaaaaaaaacttattcctcctttctaactaagactttgtaccttttgaacatctctccattcccccataccccagcctctataactaccattctactctctgcttctacgtgtttgattgttttagattccacatataagggaaaacatgcagtatctgtctttctgtgtctggcttgtttcactcagcataatgttcaccattcatccatgttgttgccagtgatagaagtcccttagttttaaaggctgaatagtattccattatgtatatatgccacattttctctatccattcattgcttgaggggcacttaggttgatttcataatttgattattgtgaatagtgctgtgatgaacattggagtgcagatgtgtttttgacacactgatttaaaatcttttgggtaagtacccagaagtgagattgctggatcatatggtaattctagtttaagcttttcaaggaacatccgtacaattttccataatggctatactaatttacattcccaccaacagtgtacaagggtttccttttctctacatccttgccaacacttgctatcttttgtctttttgataatagccattctgacaggtgtgaaatgatatctcattgcggttttaatttgcatttctctaatgattagtgatgttgaacatgtttttcataaatgtgttagccatcaacacatatttattgagtgccaactctgggctaggcaggcatcttggattattatagatgtctgctttgaaatagttttctagctcagtgatttattttcagtatgagtgtccattcttatatatgtatatttagttatttataaattgtatatcccacaaacatatagctaattgtatgtattataaaacattcacaataataggaatttaaaaagatgaggtaaatataaaaataaatattttaactattttatttattgactacaaaaattcatttgacctcattaactgtaaataacatctagaaggagcatctttgtgacatactgatttgaagatctgggtttaacttcaattgatttcggtgttttgtcatagctgaaaaagataccatacaaagatgtttagatccaaataaaaatagtatatcattgattatgctaaataaattacaaaagttattttaaaatgtcttccatcagtcatgcaaaggtgttattttaaaatttggtcagcaaatttccaccttagctgatgtcaactggtcttacacacttattgaaggagttgcctttttaacccattgagttaaaaccactcaaactctttatttggaaaaattttcagcaacctaaaaaattctgcttctacatattttttaaaaaggctgaagatatggaagtttttatgggtaacacacacctatattgttgttagcaacaatatcacatgatggaaacattcctaaccatctactaaattttcacttgctaaatgttcccctcattgcatgaatttcaaaaagcattaatgttatcttgatcttgatgggctggattaagtacaaattgtgtttactacttaaaaaaatctgcaggtaacgtattttggacaaccaacttatcaaccaaaaaagatcagcaaatttagtgtgcttgtatttgtattaagtaaatagatatttaatatctaaattataattaatttaatttaatgatataactcattaatttaattatatgattaatttaattatatataattcattgctttaattatatacgattaatttaattatatatgtcattgctttaattatatatgcttaatttaattatctataattcattgatttaattatctatatgtgattcatttttaggtttcacagttcgttgggtgtctttagtcaagagataatcagtgattctttttatggcacaaaagggtctcatatcattataaagactgtacatttagagatgttgggtccataaaattaaccacactgatatcatccttaaatctcaatatgttgcaatatgatggaagtgaattcactgagggcatcactgttaccccccatttccatgcataacttcctcttgtccctcaggacactctcagaaccatgagtcacacataactaaagcgtggggagcaccagcactacggtgaccaactcatcttggtttgcctgggaatttcttggctttaacattgaaagtcctgttctaatatatccttcagtctggggcaagcctggacttttggtcacaccagtccacattaatattgtctggtccacgttaatgtggactggtgtgaccaaatgtccaggtttattatttatatgtattttcaaatacaaataaatcttaatttcctttttctttgcttattttttcttttacttctttttcttttttaaaataaattagaagtttcttttcgcattccaatggattgcctcatgtggtccctaagacacatgtgtcctactttggtctctttggagcttataaaagcaattcttgcttaatagattcctcactcaaatcccgtctggagaccacaggagagaagttggctctggcctgaggaaccctgacattatttgttctaagatgggactgggtccaggggcatcaatggttctgccagggggccatcctggtgtttgtcaggcagtagcatgagatacaccatctttatatgctctcctacaactaaaatccgcttctcattaaaagttttctttatccaaactatcctaaggtgacactcatattaatatgatagtgttaactcatctgggaaaaccttaagaggaagaaaacacacttttcataagatccagatgttgtctttccccgcccacgcccattaggtggaaatctgtaacagcagttctcaaacttggctgcacattagaatcacttgggaatttgaaaaatccctgtgtccagactgtgcctttggctgattaaaatggacttgctgggagtggatgcaggcatcaggaatttttaaagctcttccaggtgactccaatgtgcggtgaaagctgagaaccaccacacatctacctttcccctccagtggtgggtgggactgtggttgagtctgaatgctaagaaagagttctcagaggcaacttgtgtgtggcatgtagcatggatgctgtcctattcaattagaagttttttttcccccttactaaaccaggcagggttatggtaattcttactctcttcattagagagtgaaagcccagtggtcttagcagtcactataggaggtctttagagtagactgactcagcaaggaggtatcagctaaagtgattgtaaatgtcttttatctgacagcttgacgacttgcttttcatgtgtgtagacccataagcaaatacaagaatgaaacataaagaaaatagcaagatgtcggaggcatctgccccttgtctcacctgtgtacttttaaacctcagtagtggattgacatattcaaatatggggcaagctgggtcaggtgaaaagataatggagacagcaactatggtagaaccccaaatttaagactttatttgaagtctactcatcgcctccctgggcaaagggctttatgacattcaagccaaaccaaaatttaaagaacgagccatataggactgataaatctgcttttcctaattataagaactagtgttccacaactagtgtccttatttcctattttcgattctgcctatttcagtggagaaaggttttggtgtctgcagtagctggaagagctggaggacttgaggctcaggagcctaaagaagattgtcaccaacttctggtagatgagaatggagactcttgcttcctttacaatgtgctatagcattcatgtgctgcatactgtgctacctgctaaggaattcaaagaaaagtcaggtgcatccttgatcacaagaaactcagagttattggggcaaatggaaggttataacatagtaaaacaagtagagtggtagatataaacacagatgctttacatctcacatttgctaaggagatgttaccacgatctcacttaagcctctcagaaagcaaataagggatgcactactttaattcccaagtataggaagaagaaacagacttaaagaggttaagtcacttgtccaagtttacatagtcagtaaatggcagtgctggtgttcaaatccagcatgttcaatgttcgttcttttaatcctgtagccacatagctactgacattattggtggccatttggatgactactatttttattttatcaagccttagctcacatcaatacatcaagtgtttgttgagtgtctttctgtcatggcagacactatggatgaagaagactggatggttggaatgtttccagctggagtgcctcagatcatagtaactcagcggtctatataatgggagaattcactccaagaggaggagacagagagaagtggatgtgaaagtttcatgtgtgtgctttgggacatctagccagttctgaattcagagtggatatgcagagagaagggcaatattttctgccagcgtgttggttgctctgtgcccctgtgatctagaatctggatggttagtggtgcctctcttcaaaatcatatataggctctagtaacctaatggcatgctaaactttcatcttactgtgctgattgcctatgtatcaatttccaaacctcatggtttttgctaccaaatgaagtaattttgttttgaacccacagtatacacactcagtagatagaggaataaatatgaatctacataaatagacatatttaatggatacagacagattatagccagaattcttaccttctggtacttttgtggtctcttttgaactttgtccctcagttgacttataaccaatgtataggtcagcagaggcagcagcatggctgtgtgcaggggcttttttttgggtgttctgatcttgcaagttgcaattagaattctgagtttgctatgccatcttgggctcagattctttttctccatcaatcaaagagagtatcatttgcccatttcttagaatgagacattttgagattgtgtctgcaaaagtacttgatgcaagatgatgcctgggtgctttacgaaatcaaggggcccaattgtggcagctttattttcattatgctccttttttaggccttgtttggggatatattattcaccgattcaacaaatgcttagtgaggaactactacgtccagcccagagcttggacacttcacaagtcaagagagtgttgccttacttctttgtttcctgacatatttaacacaagtcagaatatttaaaagactaaaagtaaatgtattaagcattttggtcagtttcaacacaaaatatagttctgataagttatctatcaaaattttctaatctgtagatttggtttaaaatgcctttcagaagatggaaagatgtgatcaatgtgatgtttttacagagaaaattctaaataggtatttctctttattctaaaagtgattgtcttttgtttttccaaatgactcagacttacatatccatgttctcaccttgtaaactgaaatcagcaagccatcttactaaacaaaaatagtgtaatcctttgtgtatataccaacacagagtcccagggccttggggaaaagatgcaataaaaatgcctaaataacatggctgacctgatttctagagaaattctctctgccttgggaaagtaagttagaggaaagctttttcagggttgcatcatttggccctattcacctctcaggaacagtgactttctggtctgtgtacttgaagaccaagaggcaggccggagatcctagtgaggctcagggattttgaggagccctgccagatcccagcagtgactcagcgctaatacacagggaagagttcagactgctatgcatccgttcactgctgtgttccattattacatggttatatacatgaaatgtccactgatgacatatcataagcagaagattaggccttgaatcttaaacttttaaaatttaaaaacagttggccaggcgcagtggctcatgcctgtaatctcagcactttgggaggccgaggtgggtggatcacctgaggacacaagttcaagaccagcctggccaacatgatgaaaccccatctctactaaatatacaaaaaaaaaaaaaaatttgccaggcaatccaggtgtggtggcaggcacctatagtcccagctattcaggaggctgaggcaggagaatctcttgaacccgtgaggaggcggttgcagtgagccgagattgcaccactgcactccagcctggacaacagagcgagactccgtctgaaaataaataaataaataaataaataaataaataaataaataaataaaaacagctcacaggtatgatagaaacactttataaacaaaatttaaatacaaattatttttcttatagctgatattgaaatagaatctcctggctggaaaataattattttcttccatattgcagtcctttgtcaccagtttttagtctgaagtaaaagtaccttttatatacttaaattatatgattgtcagaagctttatcatactagtaactgcagttattaaaattagaatgtacacacagtcttactgaaaatcctgcatattcttctgctgggaaaatgcaatgcaatagtccaggttgatcagaagcttgggtgttggataacccattcaagacacaggtgggctggtaagcagctgggagaggtatacctactggggctcgattccttaggtttatgccctgaggttaccatagagagttttgatacttcacatcagcgttacttttttttattaatcattttattatgaaaaatttcaaacatgcagaaaagtttaaagaattgtacagtgaatgcctgtaatcacctagattctacaatgaacatttagctctagatgatcagaaatctatcaatccatctattgactctgtatttttctgttagatgcatttcaaagtaagctaagccatcagtgcactcaccctaaagactttaggatgtatatattaaactgatattaacttgaggttctttctttttttattgtgaggtcaaatttacatagagcaaaaaaaacaaatcttaaggacatcattcagtgagttttggaaaatatgtaatgctgtgtaacccaaatctctattaatatacaaaacaatactattaatccccaagtttcctcgtgctccttatcaatcagtctccacctctatctccttagaggcaaccaccaatttcttttcaccatagatgagcgttgcttgtagaataagggtgaatggaattacacagcatgcgctctttgtgtagctcttctttcacttagcataatgtttttctatattcatccatatattgttgcacgtataggcagttccttttctgctgaatagtattccattgcatgaatctaccacactctgattatttattctcctattgatcgacacctgggctgtttccagtttttggctattatgaatacagctgctaagaacattcttgaacaagtatttttttttcatatttggccagatgttttttatttcttctggataaatacttaagaatgaaatcactggcttgtatagtagatatatgtttagttttacaagataactgccagacttttttccaaagtggttgtgccattttatactctcaccaccaacaaatgagaattctggttattccacaccttcaacaacatttggggtatttcacctggtttat

SEQ ID NO: 1347 - DNA, 3314 bp, Homo sapiens
gaattccggcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccggctggctggctccgagtgtggggcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttggcctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccggcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactactctttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctctctcacctctaggccctctgctggtgctgtggaggccaagaccccattaagcctaaaggtgatgggtcctcgcctaggcttagtgctaccatgtgggttttgtttctttccttccttccttccttccttccttccttccttccttccttccttccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgaccttgtgatccgcgcgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaaaaaaaaaaaa

SEQ ID NO: 1348 - DNA, 771 bp, Homo sapiens
atgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttggcctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccggcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttag

SEQ ID NO: 1349 - DNA, 96599 bp, Mus musculus
  misc_feature (3729)..(3748): "n" at positions 3729 thru 3748  can be any base
  misc_feature (4902)..(4921): "n" at positions 4902 thru 4921  can be any base
  misc_feature (7901)..(8020): "n" at positions 7901 thru 8020  can be any base
  misc_feature (12187)..(12206): "n" at positions 12187 thru 12206  can be any base
  misc_feature (36676)..(36765): "n" at positions 36676 thru 36765  can be any base
  misc_feature (51928)..(51947): "n" at positions 51928 thru 51947  can be any base
  misc_feature (56214)..(56713): "n" at positions 56214 thru 56713  can be any base
  misc_feature (58367)..(58386): "n" at positions 58367 thru 58386  can be any base
  misc_feature (63327)..(63350): "n" at positions 63327 thru 63350  can be any base
  misc_feature (66416)..(66549): "n" at positions 66416 thru 66549  can be any base
  misc_feature (67304)..(67872): "n" at positions 67304 thru 67872  can be any base
  misc_feature (84883)..(84902): "n" at positions 84883 thru 84902  can be any base
  misc_feature (91740)..(91802): "n" at positions 91740 thru 91802  can be any base
  misc_feature (95348)..(95367): "n" at positions 95348 thru 95367  can be any base
tttttgaaaggtagataaagtctaataaattctggaagacaactgagttatcacggtttgatgagagcataatttatattgagtatattttctatttattgctactaataccaacaaaaccaaaacaaacatctacatcattcagatataatattttctattaagattctggaaagaaaagaaacactcgtaactaaagaaaacttaaaatatctgacattctgtcaagcaatgaaaatcagctaatataccaatggtaacataagtacaaatccatgtcatgtgtatgtttatctccacacacaaaggccattgctaagcagcagagagtcaaggtatgtctgagcatgatggtggcagagcaggatcaaaaaagagcgtgcttctctgaacttgcatttgatcatattgtcagaacgcaagcctcctgtaaacttactatttattttcttatgatttcatggatactgagacattgataaccagagttcagcattttctgttgtgagacaacagtaaacttagccattgtgctagtctattgctgagactacagctttcttatagagaaacgcatgacctgaagggaaatttaagggttgtggatttgaataagagcaagaagtggtacatgggatggtttggagtgggggaagtgaaggaagaaaaggtgcaattatattataatctcaaaaataaaacagataaatattttttaattaaaaaagcagagataaagtgttttgacttggaaatagaaagatttattctattatatgcattcttttctggagattccagtatctgacgcttgtctcctgtgtggtaatactgaagttgtagaaacttttaaaacatcagacctgtcatctaaaccctaagagaacacaaacgccagcccagaatactatacccagcaaaaatctcaattaccatagatggagaagccaagatattccttgacaaaacaaatttaaacaatatctttctactaatccaaccgtacagaggatacgaggaggaaaacaccaacacaaggagagtatctacaccaaaggggggggggaacaagaaaataatcatccacaacaaaaccaaaagaaaagaatcacacacacacatataataccaactccagcaacaaaaaataacaggaaatgtcaatcatctgtctttaatatctctcaacatcaatagagttagtccctcaataaaaaggcacaggctaacagattggatatgtaaacagaatccaacatttttcttcatataagaaacatacctcaatgaaaaagagagacactacctcagagtacaaggctggaaaaaacgttttgcaagaaaatggtcccaagagacaagctggagttgccattctaatatctgataaaatagactttgaaaagttatcaaacaagaagggaaaggacacttcatatttattaaaggaaaaaatccaccaaaagaaagtctcaattctgaaaatctatgcctcaaataaaagggcacccatattcataaaagaatgtttactaaaactcaaaacacacatttagcttcacatattaatagtgggatatttcaacaccccacgttcaccaatggaccagtcattgaaacagaaactaaacagacagtgaaacaaacagaccttacaaactaaatagatttaacagatatttacagaacatatcaccccaaaacaagagaatatgccttcttcttagcaccttgtggaaccttctccaaaactggccatataataagacacaaagcaagactcaacaaatacaagacgaagaagctaaaaatatacagtgaaaaaaagaaagaatcttcaataaatgtactggtctaactggtggtctgtctatagaagaatgaaaatagacccatatttatcaccttgtataaagctcaagtccaagtagatcaagaaacacagtaaactagatacaccaactctaatagaggagaaagtaaaaaaaagcctcgaacacatgggcacaggagaaaactccgaaacagaactccaatgggccagactctctgatcaacaatttataaatggaacttcatgaaactaaaaagattctgtaaggcaaaagacaccatcaataggacaaattggtaacctgcagattagaaaaaaaaatcttcactaaccctacatctgacagaggccgaatgtccaaaatgcataaagaactcaagaagttaacctccaagaagcaaattgcccaatttagaaatggagtgcaaagctaaacagagaattgacaacagaagaatctcaaatagctgagaaacacttaaaaaaaatgttcaacctccttagtcatcatggaaatgcaaaacaaaattaccccgatattccacctcataccagtcagaatggctaagatcaaaaaattcaggtgacagcagatggtggcgaagttgtggagaaagaggaacactcctcgattgttggtgggattgcaaactggtaccctagacatcaatctggtgcttccttagtacatttgaaatagttttatctgaagacccaattgtaccactcttgggcaaaagatgccccaccataccacaaggactcatgctccactatgttcatggcagctttatttgtaatagccagaaggtggaaaccacccagatgcccctcaaccaaagaacagatacagaaaaatgtgctcaatgtacacaatagaatactattcagctattttttttcaaaaatgaggacaccatgagttttgaaggcaaatgaatggaactagaaaatgtcatctcaagtgaggtactcaagaccccaaagaacatgcatggtacatattcattgatgaatggatatagccaaaacgtacagaatactgattatacaactcacagactggaagaagtgcaacaaacagaaaggcccaagtgaggatatttcaatcccacttagaatggggtagaaaataatctcaggaggcagatgaagggagggatttgtgtgggagaagggaggatgaggggaaaagaagaacatgatcaggtatagggggagaggaaatattcagcctaaggggcagagaagagtggggaccctctagatagtaccagagatccaggaagtaagagactctcgggactcaatgggtgtgacccttgcaaaaattcccaacgatggggtgaagaaattcgaagactccacccccagtagatagatggggacaggcctccagtggagagacaggtttaccaacccatagtcaaaatttctgatccagaattgttcctgtctaaaagagctgcagaggcaaaatggagaagagactgaaggaaaggtgatccaatgtctagcccaaatttcaatccatctcatgggggagtggggcaccaaggcctgatactattactgatgcttacagacaggagcctggcagggctgtcctctgagagatcctaccagcagctgactgagattaaaatacacacatattatagtgcatggtagcaagtccaacatttttaaaaaatttttattatatttatttacatttcagccattgacccttctttcctggtctgtcctcccacagttcttcatcacattcttcctccccacttgcctctgagagggtgctccccactacacgaggcgtctcccttccgtggggccttaagtctctctaggattaggcacatctctcactgaggccagaccaggcaatcctctgnnnnnnnnnnnnnnnnnnnncattataaggtacatagtcataggtattttgtcatagcaacacagaacatagacggtagtcatcatatgtattctatgtactactccttaactgctattaggatacattgtaactgtcaatgtagttctgtttgttacaaaattacaatttaaagttcactttgacatcattttaaaatacaaagcaaatgtatactctaccctctgcccccaaagttagtatcttgcaaatattcaaatcagaacttaaaactggtaccatccactaaacaaactcagccttctgcagttatacatgctcctatttgtactggtgcatgtatgtaggggtctgtgtaatttgatcacatgtataactctaagcaatagttggcctaatcaagccatgtaactgcatcattgcttcaaatttcctacctgcatctacttctaattccatcccattctcttcctttttccttgcccagaatgatcagcagtatgttctccacaaatatgcactgtattaaagaaaaacatgttagtttaatacttaataaccttaaaaaataccgtgaatttctaatgtgtttattgtaaagattaataagaagctttagattcttattaattaattattaagtaagtacccctgagggtcaaggctttcccagcccgtaagtgaaactatgtatacacgggtagactaaagaagagacataccaaccaggaataaggggtgggccttatttgagctttgttttaagtattggaaaagacaaaaactcatgagacaaaggcagatgtgaaaattagtataacatatttgagaatatgttggttctcaggtggagccaacttttttttagatatggttaatttttatagttgaaaatgtgttaatcattaaaaggctagcttgctaaattattaccaaataaaaatatgttatacttgaaatcagcttcaaaagaatttatggtggatatagaatgttaaactgagaataatgaaacaaaatatgagctgataattgattaagacaaatgacacggtttactcaagctcattacacaatatctctaattggttagtattcttgggattgtcataataaaaagaaaaaatgatattcctgtgtaaatcagtacatgacaaattggggagaccattannnnnnnnnnnnnnnnnnnnctagtacacatgtttctcaatgaaaacaattctttcaggacatttgcgacttagataagaaattttactagaatatttaagactgattcccttcaaagagaccatactttgtccacaccgagcaatgactacaaataagaataggtctttggtgaggaaactgagggcaatgacacaattataaaaacattataaatatagtcattagctgtctttttaaaaaaaaataaggcctggtttataagaagccagtagagattatgcatgctattcgaaggtatccttgtaaatattatttgttgaaattaattttccattctcgactttcttgacagttttctggtctccccttcacttccaactcatacattttagctttgggttttgacattaggatgaaagatctttggaaatagtcacaaatgttttgaggactggggaggtgatttaatggataaagcacttacccaggcagaaaggtccaaaggtcctttgtattcctttatgtgggttcaaagttcagatctccagagcctacagaaatgtcaggaggtgtggcagcctcttgtcatagaactactctggaggtggagatgggctcctgggccactgtttgtgcacatttgcctgaactgacgatttctttgggaatgatagagcttccaagagtaaaatgaaaactcaaggaagacgacggctttgagcctccatatgcatgtgcacgtgctccacacaagaaaaagtcaaatgaagggaagaaatgttttcaaagtcaaatagtttattagaaggatgatttctacctaatctatttgttttgcggtgggaaggcctctggactattgcttgaaaagtttctcttctgatcgcatcaaccccaaagaacacgacccaagtcaaaccacgtgatctctgagaggatgcctgttaagtctaagattttaaaacatgttttatgatcctacaaatatcaagcaatcgcgcggtaagttgacagattgttttaaatctatacgaatttcagatatgaaatacaagcttgcaattactttgtctataatattagcatattagaattattaataaacatttgtatatctcattttcacagaatgcctagaaggccatggagatttaaaccttgttgtgtgctttgagagcagaatcagccatggaagtaggcagggatcacctttgtatgctggtcacatatatgagattcttcgcaaggatataatgcagaaattctaaaggaaaatttctaaatgtttatcaccactgtttgaacttacattagagtatctttctgatataatagtgttcattacggtcattttaaaatctgctaccccaggcttataaagcaatattatcatgtctttccatcaacaatattaaaaacattcatctctagaaaatgctataaagaagttgcactagaatgctgatctaaagatttaagtaagtggcaaattattatgtgacagactatgaatagattttaaaaaatctttacaaatgagtattataccttctcatgaaaaaaatactaatccttgaaatttaaccagtcacctgataatattttttttaattcaactattttgtcagggtatattttccccttagtccttaattatttttgtcatggttcctggtggttggcatgcattttatatgatctgaaccaaaactgtactgtccaattttgtggctactagtcagggggacttcctaattgcaataaactcagttcaaacctcactttccctgttccataaccatatgtggctggaggttaccatattacaaggtgaagatactaactatttgcactatcacagagctttctattgattaacagtgttggctcacattagtgagaccactgctgaggaacaggaaacagcagatgtgtgttctttatctccgagtctccttgactattgagatatgagtataggaatacatatattctgacacagagttaaagttacctgcacagcctctcagtgctggtgtgctttctcttctttgcctgggactgaatcttgaacattccttcccttccagaaaaggaattatgatatcagcaagtgttcagcaggtttgttttgttcaggaccatgatctaggctaatcgttgtctgcctcactctttactcaacagtagcccaagcttattttacaactagggtttctgttttagacagcaacctcagacctcagggtttgtacttgaaaatttgtcactagcacaagtaactaacatctgtttttacaggttcagggtcttcaggtctctgcaaatttctaacttccttttgctacagcagatgtttcttaattcagaaagtaaattttgttacatataaaaagataaaaatgcataaatagtataattatatagttatatgaactaaacacccctctcaaaactaaatgaaaatagtttgaaaactcaaccataaggctaaaccaggtacatttaaaggacctcccaaaagccttgatttaaaagtagtatatctgtatttagatgagttatatagctgatctaagagacaacaaataattctataactacaaatcattttaggttttaagtattttcatgaagattatatgaacataatatatagtatgtcatactgaaagtgatttgacttttaaaacaaacagcttattttattttttgtgattattttcaatataaatataaatttcacaaagtgaaacccatacaagggaatgtttagtagaactttcattttcttttcaggtattttagaaatggctcttgctccagagtaacaacatacttattgtttgggaattaaatttccccaatagatttcacagctcctaagaaatgaattagtatagtatattatgcaccaaagtgtatgtgaagaaaaagaaaaacgtgtggaagcttgggagaaagctagaagacagaggaaggacaaagggaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaagggagaaatggaggaagggagggagggagggaagaagttaatggagagaaaaaggaaaagagggatggaggagggcagaagggcagaagagaaagaggggaaacgatagaggagaagggagggagagaaggagggaaggagggatgaaggggaagaagggggaagtagaaagggatggagaaagggaaatagagagtgaaggagggagagagaggaagaaggagggagggagggaaggattgaaggagagaagtaaaggtatactaacttcctgctatttccccaaatacaaagttgagttgtggtaatggcacttattttcaagattctttgctgcacttaaaacataagttcatttcattcaatcactcactcctcgaccaagactgaagccaactaaatagctagtaatattcaccaatgaaatagtaccataaacttttctcagttttaaaatttgagaatgtttctctacacttaggtaactgctcctgacacaaggcctttgaaaagtggcctaacaaatattggtgtgtgatgtagaagtttgaaactcagttcattaagattgtgagtagctgttttgtacataagaatgagacctgatgggagaggttgggactaaacacatagttttatgaaatatgaggaaacctaagggttttgttatgacgcacataacaatgaaagacctgtttctttttagcaagctcctaaaaagtcccacccgtataattattaaataaaaacactcacttattcagtactcagctagcttttaaactctgaataagagaagtacacagtgagagaggtgcttgcatggtttccctggatactgggtgatgccattcaggtctatgttttatctgaaagtggagccctgcagggaaatgaggcttgttgagtggctgtttagacatagtaagttaataggaaccttgtttattctacaaagcgtttttattttgacccagtttctttctctcatcacacccaagcactgtaaacagcaatagtatggtagaacaggtactttttgcaactcccgttaacttcacttaagaaatcatgactgccaaagtggagtcttacaagattttgtcctagcatactccttcttagcacgctttctagagttggactgttaaatttgtgccagatacatcaatgaataccgcctgcctatctttttcttccaactgaatttacttatctaaaaaagaaatcgtctaaaaattcacctgctaataaatgtaaatgtccttaccttaaccagtcattaaggaataccagctaaatcagggtcacacatcaagggtctccacagacgtgagtgtccattttaaatggtacagtagcattgtgggttcccaatcgtttaagtgccatgaccatccagttttgacaccgagtctcttagagttacaagctttctaatttgggagcatgattaatccctcctatgtgataagttttaaccttctaatatttctttggattgaaaaaagcaaatgagctgcggcaaagaatggcaaataactacagtgcttaacacagtttaataacctgaaatgaagcaagtgtgtgctatgtttccattaaaaagtttccagccacaattaattgaacaaaaacttgtcttgttccaagattattcttggaaatgtaattttaaagcctgtgtgaaatgaggaaacttaactttttataccatatgaaagcaatttcattttttaggaatgattttggatagacttccgattggatattttccattggaactaacagtgtagaggcttggggtggggagagagcagttctgtgttcttttgccagcactgacaaaggtctggttgtcaatgatacctttacagctaaatttactccagagtgacatgaacaggtgcaccctggcctgccagacacttgtgcagagggatcacgcatctcaccgcttgacgatcaagggggcaaagcttcggtgttcatagaaaaggagaggaggcgagcgcagcccaaactggggggtttctcttcaaagccagctggtctggctttattctacaggaatttttttacctgtcagagtttggacaacaaagccctcagcaggtgctgacgggaacaacttcctggagaagcagaaaggcactggtgagtttcaattgccaaaaaatatgtacatttttttaatctctaaaagttgatttcgttttcttagaggagacagtgctggggtacctctgttcacaaggctgatgatgagtgagctggaaatggagccaacctccccaacagtggggttgctaggtgcacaaaacaacgccaacaacatttgatgggttttgagataataaaatgagcattttgtaatatatatatatatagagagagagttaatattactttctgattactattttaaatgtgtgagaataacgagttcatcacacttattacatgagactacacaatagcattttagtttcatttttatctagttctgatcttctttgaataaaatgtgattttccaatgaatttacaaaattaaattgtgaaatggcacatgctttcctcaaaaatcccatgtgctattaggagtgtacacattataagaagatgattaaaatacaaagttaattttatctaatgtgcatttaaaacatctaagtgaacagaataattaataattaaaaggaacaacattttctcatttttaacagggatttttttaaagaataaaatctttagaatagatgatcaaggaaataataaagcatgtttttacatcatttatttccaaaattagtacgtatacataacttagtatttttttattttgtgaattcaaaagtttggtaaaaatattttttcagaacaggattttaattaatgcaaaagaaggaaaaatgagagcacatgttaggacatatttttaaaaagtgattctatttcaaggactcattcttttaactgtgcttcacagcatttctctacacattgttgtattatagcaaattgaaaacatttatttaagcaaggaagcagctcaaagctagggactatacatagcaaacatatgaaaccattttaataagtaaattccatattcacaagcaacatgggctaatgaatgtaaaagacacaacggcatacattgatcaagaatgctataaattattatgcattaaaatcaattttctgggctgtggggggtaggattggtacttaagaagagaaaagcttctacaaaaataaatgactaagactatgaagcaaatgttttactctgatggtgccataaataatttccaatctacatatttaatacatatttgtaaagtgggaaaaatataaaatctgacttttgttaatgaccatcttatctaaaatatttttgaattaagtgtggtttggacataatataaacttatggatattttcttaaagagacttaacttccctttgaaaatacgaaaaaaaaatatttttaatgaccaaaaatggtctctagcccaaaatctaacactcaaaatagtagtctcatctacatgcatttctgaaatatgtatttttaaaacactgaaactccaatttactgtttattataaaggatggcgtgtataatgatctccagattatcaaacatctttacttaaggcttcgcatagggcttcactgctcttttcacagatgcattgtcagacttattgctgattctgagatggaaatcaccagacataccaaattttaaaaaacgttcatcagtctcttaaagaataagacatgtgaagcaagatattttctggtttgttaaattctctgtttttaaagaaccagcacacttgcctttggagaagaaaattgttttttacaaatcataagctcttgggtctactttggaattacacttattaagttttcatgtgtattagtgttggctaaatttatcatactctcattactaaacactgcaacagcaataaaacaacataaaaactcctgccaaactattggttatgactttcaactttttcatgggtagtggaacctacattaagatgttaggtagagtctaattatacaaaatatctaaaaatgtatcattttcattgtgccaggaattcagactttgtctaaaaagtccacatttttnnnnnnnnnnnnnnnnnnnncttatcccctgtttcccacagtgatatgtttttctttcatactaaatcttcaataccaggtcacaaaatactcactccaactcttccgatgtatacaaactggtttctttagtaagccttagtgagaaatctcagcttaaaatgacaccgagtcagatctgccctccactttaaaagattacttgaaatatatcttcacaacataaagataattatttcaggggtgggaatttaatcattctcctgattcagagagccactcaaaagattgttttgttcatattctgtattcataagaaagctgttgatttttctattaattaacaattattaatgaactgtggttactagacatctagtcaatctaaagcaacagagtttccatgtaaaatagtttatttgtaagtatttaaagaagcaaaagctattttggcagctttatatgtacctcctcattgaccagacacctgactgacaactgtcatctgtccacaggccagatgtaatttaataaagataaaaattgcatgttgctcaccctgctgataatgcgtggtgccagtaagtttacaaatcagaataaccaaactatggacaagacaaataaaaggaaagcggtggcttctgtctagcatccatcttccctcgtggattcattttccaccccttcttacttgtttaatttcttttcaagtctatacatgtttcatatgtagacagagttaatttccttaaaggaattgtcagactcatgtacacactgatcaaaatactaagcacccaggcagtggtgtcttagataggtagctgtccttgagtctgattactcttgagttcgtgaaatccttaaaagccacatgaggcaggctttgaagctccaacttctcattttaaagtaattccatagaagaataaaactgaacctaactcaaagtctctggtgtgaggaggtagacccagatttgggttgtctctcaggcccatattcagttttctttgatttcagtaatatggacaatcaaactgacagatgaaacgtatcacgtgaaaacttacacgtgtagagctgctttcaaaaccttttcagttactaaacaatacctatacaaggatatatttgcttaccaggacatattaaatggtggataaagcattaagaataattgaagtgtgcccttttgaacttctttatcattcaaattgatttatacaatgagaaatacaaatgtattttaaataataatttttaaaaatcacaatcatatgctttggaaaatgaatatagaaagcaaaaatttagccttatctttctgaaagtttagagaacaattaaaagcactaaatataccagaacataaccatatatatacatatatatatatatatatatatatatatatatatatagtatataatgcaaaatatactaaaaagctgattcagcaattaactcacttgatgtgtgtaggctaataaacaaaacaaagtgcagcccaaaggcttcatttgtgtgtcttagcaagctcagaacccataatattcagtagcattttattaacatatgtatttgacatcaattcaaatgttattgattatatcaactactattgatatgtttgttgatgatcctgtacaataaatgggttcagtcaagattaagaatatcgatattcaaataaactctcattttctgccctctagaaaggaaattgttcagattacaatacaactttctgattttcaaggaatatatcttatccttggcctttagagccgatcttgcaggtaagaagtgaaactttattacacagacaaattaccaaaacaaaacaggagagaaacttaaaatattgatatgatatattgataaaaatggtggctactgttttctccaaaagattgttttaaagtaatcaatagttctatgactaatatcgccacttaacaactaaatttcatacctaaatttataaatgttatttgctcattatattacatttggtccaaagtaacatcagacattgttcagcagatcatttgacaatatgcaatatcagcatgtaaatcatttgcaaagcaaattaatcaacagagaagtaaatataaccatctccagctatgttcttatttgtggaaaataggggcatcaaaacaaaatacacaaaattacaggatggacaaagaaacttagtcattctcttgcatctcaaagagttttaaggaaagtgagctgtcccttatctacttctaaaggatcacaagtatttctcctgagctgatgagtacggttcaaagaccaccctggcaggagtgcaaggatgagagccctagcccctgtttctgctatatactattgtgaccaaaaagaaatcactaatctctgtgacacacctaagtgaattggggctttggggatagtaatatacaaaccacaagacaaggcgcttcacctaaccaaggcagtattctctctgcttcatgggaggtgtcccaaaaggactctggaccattgttgcatttctagctagaatggcctgtcctgtgttctccaaattgctatgagtcccccaaatgagggaaatctcaaactggtgtggagctgggaagttaaatggtgaaacaaaaccattctgcagagcatttctgagtaagcacataggagaggactttggtttcattacaggaaaggacacatctcaacattacatcactacatggaactctgaggttcagtatgtattcccatagctaaactgggtgaaaatccaatgaacatttcatattttcagttttgtgaaatggaaggaacaatttaagtaaaaaatagttgtgacacgtaattgccataagccaacatgataatgcttgttttgtcagataaaaacaaacaaacaaaaagacattgcgtcaaagatgttctattctgaaacactaaagatacctgcactaagagcagcagttagatatgaagagggcctggatagacagcagttatgtatggagagagtttgaaggcttgagcaaccaattccaggagatggtaatgttgagaaggacttttctggtttctgggcaggcaaatccaattactaaattcttaagaacatctgaaagtctccttcctgtcaggtccctctattcaagtcaatgagacaattgctagccttatctgcagtgagtttaggctcacgagaaactggcagtcacagttacaatcacatctgtgctccatctctaatgttaaatatccctccatttgatgcccactttacaggtttttctaagggttcaggactccatccaagaataaggtttttactcagatatatttttaaatgaaccacaaattaagtaatttaggtccccagatgataccaagaggtcatccctgagacatacacacaagtcacatacagactgaggagggttacatttaggaagacagtgggtgtgtgtgtgtgttcatttacatatattcatgcaactataattaaagaaaaagaggccatgaaattgagagggagggtttcatgggagagttgaagggggaaaaaaaaggaggaaaaaagaattatatttcagaaaataaaaattattcatataaattccccatcttgcttaatcaccttttattgagcagtcttcaatgaggatgttatgtgtagtgtgtctttttgtttgtgtacaatctgagcaaaactgggtcttgaaacaattcatttagcttaaactcttgtccttattatgttaaaaggagttcatacacttgttgggattgcttgaaagaaaaaaagtaacagagagaaggaggagctatagcattagaaagacttcacaggccgggagtggtggcgcatgccttcaatcccagcactctggaagaagaggcaagcggatttctgagttcgaggccagcctggtctacaaagtgagttccaggacagccagggctgcacagagaaaccctgtctcgaaaaacaaaaaacaaacaaacaaacaaacaaacgactccacagttcttataatactcttgccagaaggcaagagcatataacaaaatgtaagtgactagcttccctttctccctctctttctcccccctttcctttcttccatttttcttttctttttgagaatcttgcagtccaggctagcctcaaattcaggcaatactcatgcctcagccttccaactgcttggattataggccaatgacatcatacttgatctctaaggagccatttgaaatgaagattcctaaagcatgcatgacagttcccagctgcacactgaaggctgaggcagatctctacaagtatgacaacaatctggtctacataacaagctataggacagtcagggatatgcaatgagacagtctcaaatttgtttttgttttttgttttattgttgttgttttggttattaaatcaattttcaaatgcagctttcaaagatggtgggttcatggacaaggagtgattcagatagccagggtttaactcttattgattctgaggtctttcacctttgcttgcaattatcctctcaaatcttctgagtgcaacattagttcttataacccaaagagctagaaaacgccaagtagtgtgagcccatatcctgagagactaagagtaacatatggctacggctagaaatgttccttttgtttttaatcattgtctaatatattgaatgctacactgcttaatgtaattcattcacctttatatttgaattggcaaatgataaatatccctcaaaatgagcaaagtcttgatcttattcaagtcttatactaatttaagacactaaataatatagttttaagtagacaaaatggcttcaactaactcttcaggaaagttattttagcaaaataagacagacagtaaacactctaagaatgcttactgctgatctggagaagcagtgggcttaattttcttctgggtgaattgttttatatccataggctacatagactagactctcaaagctatgtaaggctgagttaggaacatatggatggtaaatataaatctttcacagacaatatatgaaacaaaccatttttgttcattatgaatcatcattatagtgatgaataagaaaaatatcacataagttatataacaatattttcagtataagatctttgttggggaatttaatctgtggtggtttaaaaagacttgaaaaaattattagaactatcccatagttctaaaatgaaaataattctacacagaaaaggtaattggtcattaatatgaaaggacccttgtactgacaactgagaagaaatttataactgaaaatgaaggatgaaataaaaagaatagaagggatgaagtggaggagaaaaggaaaaagaagagaaagtagaagagggaagccatacgttgactgactattgattgctaaaagggtcaagagaaaaaaaaatgttgcaaaaatttctcatgaaatttttgacacaagacaagccctcttctttccagtcccctcagaatgatgatgattactacaaaactcactggcctggtaaaaatctctccagtcactcatattatgtgaccacacaaagttggagagtattttgttttcattttcattttattccatttttatcttattttgacaaaaagttatctatttgtgatttttatagagaagacagagatagggcataacaaatgttgccctttgacctttcaacgctcctaaatagtatgccctctgttcaagaaaaagtgcttattatagagggttctttaattcccttcaagaaattactgagtaactaataattttacatctaatgacttttaataaaaaggaatatacatgcagtaagctaaatgagaacatcgaagctataacacaaaggacacacattttttatttagttggtgtgtcactcatgtatatatatatatatatatatatatatatatatatatatatatatatatatatatatcatggagagagagaagcaaacaggatgggaatttaaagaatctgaagggcaagtgcatgggttttcaaggagctggcagagagctcatcttccaacctaacattttcagaagcaataatttttttcctcaggtccttcctgtgcatttgcccttacttccttgtgtactattaagtggttgtcaatggaatggacttgaggccataaaagcccctttagaaacacagcaggaaatgtatggacgggtttttctcttaaaagtttaaaaatattcacttaaagaggtaatttgttgatagtgtattgtggataagtcagtggaagcagcagattctgataaaatataatccatgggaattctggggcttacccggctgctgaggatgaaaggaccttgtaagtcacatcagtagaaggcaaaaagaagtagagacactcacaatggagctgttattgattttaaaagtgctactggatgagatgagcgttccaaggtgaaagaagggcaagttgaacatgaatgaagggaagggcataagtgggcaagccttggtgatgttacacgactgccggacaagtctcagtgacatcacatggctattgggacacaggggagatctctgacttcataggagccaaaaatctcagagttgtagaaaatgactcatcctgtgcacttatgtgcagactcctaagtccaaatgcaatgttattcactcattaagcaacttaacaaggtttctgagataaccaaaatacacaatcatcgatccttactctaggtaagcattatcctcacttatgtgaatctgataaaacctagtatgaatataaaagaaaattatattctccagagcactgacaaggctaatattaccacccataaaatatgaattatcttagtgtaatatgtgctgatttaatcaacatactagcataaatatattttattttaaatatcaaatgaaatcatgaaatgacatagttaaagtacaaaacctgagagaaaagagtatatgttttaaatatcattaagtatctggtagtaatatgtttctaaggagcatgagagatagttgaagatgaaataaaaatgtggaatactttattggacattttctgtaggccaggcaaaaataaaatttcatatccttctttcagcaaactgttagggctaggtccatcttctctggtaaatctgggttctaatctcctgtcaggtttacctttctctgcctttggctctctcctatcctatctcctatatacctctcctatcctatctcctatatacctatcgattagtagcactgacttccagacttggccaatgctgcacatcaaacctctgtcttcaaaggctatacattccttccagaaagaagcttgaaattgttcttttctatctgtagttcaatgtctgcttattgtccaaatgtcaaacatttgatgctttatgatcaaatcctcgttttcaccttatttaaaacatgtgctttagatttacttttaacaacaacaacaacaacaacaaaagtcaacaataacaacactgattctttagcacagagatgcttctaaagaatacaaagcaaatttctaaggagacctctaagggactcaagcaaaaatacctgtgagtgactagtcagataacctgtgaatagatgtatttttcagaagtttattccagttgcgtgattatatcaatccctgctgaatttgattttccaaaagtatcatagttaagaacagagttttggaagtgaataagcctggtttcatgtcctttgacatttatggactatctgaacagacaaagtaaggcattagtttacatttttgttcttaaaatctatcagatagagataataataaaagcattttaaaaggctgtagtctggataaaagtaataacatttatagagtaattggtgcaatctaaaatgtagcaagtggtcataaaaatgagaaatattttatataaatactaaaaatattgaatttttcagtatatatctcaagtattacacctagattataaatacaattgctttgaaagactcaaatataaatagagcaaaggcgagtaaggtctattggtttgggtctttggctcaaagaagaaaccagcaagaagactgttgttagccactgatttacatttattttctttctgttgttgacattttagccttcattatcaccgtattccaaaaatatttaggaaactttcatccaaaacaatgaaaaatttcattctttctaggaagtgagaatattaagataattatgtatatacctatgtacaatctacatagaactaacacctattggaagcagatattttgcatatttctttctatcttaacaaaaaatttaagttttttaaattactctgcttaacttaaatttttaggttataaataagatattttaaaaggatatatactctcatttataaatataacaatcattcaaaattacataaaaagttagagggaacacagtttgtcatgctagccccttctttctagactccttttctcttaataaaaatgttaccatgaacacttcataaaaaattctttaatgtactgattcgggtttttctgtaatatatacttataccaatagacaaatgagtgtcccactccagacattactaacagtccaaagaggccatgtttttcatattgtatagtgtaatgcagaagtgatatctagcacacatgcagcagaacagagtactgcccttagatccttcttgaacagaatgctacattaggcattccatgagttcccccttcccaggaggcctgtgcccagtctagttgccatagatggccatcagacatttgcaatgacatcaggagactatctgagcagccactgccctaaagaatctgctagcaggagactggggatatcagtgtcttcttggccgacaactgcattccaaaggtcaactggggtgaaaaggatgggcttggagcatctggtgcgttttcagccacaaggcagctaacaagcagagagcagccgccatgagggctaaaagtagcctggagaccacacacctgtgaaaaagtcaacctgacccaggaaaacagaattttaagtctagagagatttccaattcttcaaaggtaaaatttcagacctgttcccgtcctgaatcaatcctcaagtctctgatgacccacttacttttctatgacagccactgcaggagtgagtaggggcttggaagtgtggaagtgagaattgttctcacagaattactgcagtttgttttctcagccctgttccttgtcaagcagctcattcattcctcatagcaaagcatggatgatatcacactagagtccacatgtggagtatacctgaggaaaccaagtcaccgagcaagaagcttggggtgtgagtgatcagttagcctgtgttccctcagttgatgtttggctatattcacttcagagtcccatcagccttttcacttgtaggctatggagaagctgagcagctatggagaagatgagactttcattgtctgcagagcactgaggcattttcatatagcatcttagatttcaggtagtatgccaagaatcctttcaaacatgagcaaacggtaaattgacatgagacatagatattagctcaaatatggatcagtccaatgttcaaaagaatgatcattttagcattattttccatcagtgaatatgttgatgtgaacagagatcatcttcattaagggttaattaccataaatgtaccataaatgggcagaattaatatgaacattcacatgagctaacaatgaaaattgtaaagaacagatacagcaaaatgaatcccctagcaacctattgaagtcccaaagtttatgctcagtctaaaatctgatagcactggttgtttattacccatcttatgtagtattagttgtaatttcattatttacattgttaacatttcagaccaaatccctcctttgtgaagtcagtgaatgagataattttaccaaatgtgaggaggattatagttggctagcaagtctcacctcagataacacctttttcttttacttttatattgtttaccatttattttaaaagcataatgctagttctgcataagttttaagtacaagtaaacacagtattatatctcaattgttctctttgcaaaagcattatgtggctgtctgacactatcaatcgtgcaggttaggtttgggagacagtgttagtcctcatgcagcttatcctttatgaaatgcatttttctctagggtgaatgcttagaggcattctctcttaaaaaaaaaaaaaaacaaaaacaaaaaaaaaaaaactacctaaaagctatcaaggcaccttctagtacagtcagtttccctggccaagccagccaagatgtcctggtcaacagaaaagatactgaacccatcagaagacttaagcttcgttccaattttagagatgtggatcacttaggccttctgagtttgacccaccttccttatttaaaagcaacaaaaaggtacatggactgggtatttcccagtatctttctcagcaggcaagacactaaaattcagactttaaaacttttcacgttgctgccaatgtgatgtaatatacttccttagaaatgcagactatcctagaaatctgcctgttaccaacataacataatgcagttttaagcgaatattttcccttaaaagtatggcagaatgactccatgtaataaaaggcatatttttatgcctacctcagaggtcccactacccacacaggcctatttagcagttaaaatatggacaatgtgattgaaggaataatttttttttagttttgattaacttggaaggccaagtgttagtctagcatctatcctatttgtagggaacacacatctttctttgggttagaggtgtagagccctgtggtctaaaccattgatgtatcctctctactacacttgctctctttggttcagcaccctagacaagcaaagaacctcacaagattctgcatctcctgatggttatttttgcacaatatcccaacactgtttccaagtggtaacaaaagaaagttgtgcaagaggaaagaaagtcttctcattcgggtttgctgtgaattttccttagcatcctagttctctttctactttgtgatctttaatataccatgacctgcatatactcacagaggtagcttaccttctggagttagtggttggctttaaggttttaaaaatatttctgagaacctaggggcttaattagagtttaaagctaatttggggccatgattcttttcctattagtctataagatttgttacaaatccaggatgctataggacagggagtttggacctgcccaaagaccctctttttcttcctgattgcaaagtgcttatgatgcaccaggtagccagaaacgcagacctcacagacctcatgccagcactttgtgagctgtgtgggtgatgggttccttttccagaccccgcccccccccccgatgtttatggagatttctcaaagctcatctccagttcctgggaagaaatgttcttgggatcctaaaaaacagaccctcctagaaactccaccagcgccaccaccgcgcgtttccaaagcacacccactgcctttgagccctcctccattctctggagcccatcacgctccatctttatcagcacaccaccagtctctttctcccaaaccaagactctccagccgaaagcatgccggcacaccctttcctgtcccgctgttgaagacatcatgcccaacccttgtgaacccaggcccgctctggcagttctggcctcctccgcccgtcccggggctcactcacgtggcacacgcagcgcccccccttctaccctcaacacacacacacacacacacacacacacacacacacacacacacacacacacacactagcagcctgggagctctagaaactagccggggaaagagtccccaccccctcagctccgtctgccggagaaaagtgggtgggaggaagttgcgacccacggagaagagcagataggaggggagagccatgtcggaggggaggaccagcagtaattgggtgacgttgcagccgttgtgcctctccagtccgcccagccagcgggtcagctttcaacacaaatcagacagagggattgcttctgcctgcaatcaataactcagtcgagtgagctgctgaaaccagaggcgtcccttgtctgctctttatggggccctgcggactgaatcccagcccctctgcttcacaaacaaagaagtgggtaccaaatgccagaggaaaattttaaccccaaacttccatcgcatcccctggttacgatctgttaaaatgaaaagagcacggacctagtaaggtctctagaagaaagggttaaagggagaaatctacgccttaaatttcaggtctcctgtgatatgaaatggagtagaaccagtgtttcaataagcatttaacaatgggaagagaagatgtaaagtcccattaaatttagctgtccccatagatgctttcgagtcagccgcacacttataagcaaattaccaatcaagtcttatttgcacttactgatagaagggaagaagaagaaaaaatgtatcatactttgtagaggagaatttggaaggggggtgttagataatttattacagactttatttcgtgaagagtaaggttaagaggtcctaggagatatatcgtgatcccaacttaataatatacattaaagccaagcaagaactgagagaaaaggatgtgtcagaaaacttgggtctgagtaccagaccaagttgagattaaggcatggtgggcctgagcttgaaggatataagtccttcagttcccataaccctaaaacaaatactgcccagattcttcaattctctgacactgacacaatataatcaaaaataaattataaggatggcaacccagatgaggaggttttctaaatgactcctcattatgaaaagtcctgctcagacaattgggaaaactgatattggtccctgttctgctgagccatggttggtccttgaggggtagggtgggggtactagtcctacgttaaagccaaggaaatattcatgtgtgtacaaaagccatggaaacctagtctgagacagagattagaacacaggagcgcttttctatgctctacacaactaaagactgctgcttggaaagaaaaggttctgttactaagagattccatatacattgatgaagccacagcattaatcccaaagtttgcaagacagggcttctttgtatagccctggctgtcctggaactcactctgtagaacagactggctttgaactcagaaatcgacctgcctctgcctcccaagtgctgggattaaaggcatgtgccaggactgcctgacaatcccaaagcattctaagtgggtctttaagcaatgcgtaaaatgagcctgttgctgaaaaagtttagacattattacaaatcattacttagatattattccaaatatctccctgtttgacaaattttactagtgtgattaatgatgaattttactttacttttttcttgtaatttttattcggatataaaaaaattaaaggtagaaatgtaaagataaggctaggctccctatgtaggaaatgaaccctacaatgaaatcttcccttgatataacaaatcctttgtatagtacagattctttagcaattcagtctgcgtgctgtgtggtcagcttggaataacactgtacctcatgaatctgtgaaatataaaaaagtgtgcactattacttttaaagttataggcactattacaattgatcattatttgggttttaaaataataagtgttgccactttagaagttttaaatcacatctaccggaatctaatgtcagctttaaagaagataactacttttttttaatatacttgcacacttttaaggtgccaacaaaagcattgaaaactgtgaagtaacctctggagagatgaagtgaagcgtggaaggccaatggctgtggcagtgaagaagtgcagaaggtgagtgttcacatttatcgtctgccacaaacttaccacgaaaggaaagccaccagtttctttgtcttgaagtatttatttaaaatgttggcatgtgtgacagtgatacagttaaatggccatgctcttctttatgatatgtgcagtgctgtggcatggtggttgctcagagctcctaaaaccttccaagggccacctttacaagtgcctactacaattaagctgattcctaggtggccatgtacatcatcataggacaaactacaaagaggttaaaatatcttttacattgtggaatttgaatcttaccatgtttctcggatttttatttttctaaattttcatgttcaattatatttatgatgaaagtattctggctgaagaacaaatactatacacttgaataatcttgaggggtagattaatctatatcctttcttcatctcagggtaggttgctgtggcaaccgccccagctcactttaaaataattttttaaagctcacttcaagagctacacccagcgtgggccaggcttaaaagcaggcagacccagtgcatagggctttcgtagactgctgctttaatgtagggaggcagaagaaagggagctgaagtaagatggctcaaaacagaaattggaatgttagctttgagctgaaacaatcaatcaccatgctctctgtaacttcaggtgtctaaatgcattgtgaaataaatccttggatgagataactaatgtttatttatatttaaaattaagcacttataataattaatgaaaggaatatttgtaattacacacattcagagagagaaggggagagggggagaaggagagagaggaagtgagtgagtgattgagagagagagagagagagagagagagggagggagggagagggaggtaaggagaaaggtggtttaatggcaggtcaattctagccatcacttcatcttctttattaaaggaaagtttccttttattaaatccttagcttcactccccactgatataaaagatataataattatgattattttcaagcatagaacaaaattggagagctcatgcaaaccaggaaaccgaggcctagaaaggatttatctattaggaagacacttttagtgttttcaatgtaaactatcaaaccataagtaaaaaagttagtagtgctctgccacagagtcacatctacaaccacaaatcccaaactggatagagcattctaagtctctcaacatctagaacaaaatacttcctacacaagaaaaatgaataccattaggtagcaaggatcaccagtttaggtaaataaaagtaaagagataatgtgtgtctggcattacttaaagacaaatataaaacacactctggattaacaatctcatggattactactaaattatttacttatttatttacttatatatatatttatttattttccacttcagctacaaggtttgtgaggaaaactaacactaatcttaactttgctcacacatcattaagaagctaaatatacaaagggggaaaatcttatcttttcaaaggccagctgtaatacattccagacccaaagtttcaaatcatcctcacctggactggacatacttttaaatgtttacaatattgttgataaatacgggtttgttacaatacttattactaaacaattctttgacacctggtggggaaaaataaaagtttccttttgaaggaaaataaatcaaaactgaagtgtgctgtggtaagtagaaactttgtctataattaaggagaagagcatgattgaattcatgtattggctatatcaactctgtcatgtaacataggccattatagttcattatactaatttaaagcactatgagaataagttctcttggtccttcttatagtttgctctgtgaggatctttgtaaaccttaaaaataatctaaatttttatttatatcaccatatctaggtatgccttagcatgcagcatgtctaagctcagagcttgtacctctaaacatgccgttctgtttatataaactcatggtagtcacacttgctatgtgaaagaggagcaaatacaatatagcatagataccattttcaaaagcagaacaaacaaaaaacccaccatgtcacaaagcttgtgctctgtgacagcttgtcatgctttcctgtaataaaatcgcagtactaattaatagtctcagtggtaaggagccagaggtttgaagattgttcccatgtagtttaacttgcctgtaaaaacaactttctgctttcaaatgaagccttccttcggagggtgcttaaatgttgagtccactgctctgatagaagctactaacttcaaacagcacaatgaggcaggaggcttttttgatgcacaatgcccctctgcattaaaatagtactctgcaggcctactggagagcttcccgggaaattcagccagttactgggttaaacatatactttcgaaaatatttttaattagctagatatttctatgggctactattgtctactcttgtatcttctacattatagtactctgtgaactttctcttcctctaatcatagtattaaaaattaaatgttcatattttacacaagctacagtactcctggcatgcaatctttcactattttgagaatgcatagggttgacttgtatatagttgatatatttaatctttagctttttaggtgtggtcgtgatatctagtaccttttttttttttctaagtatcaattctttgttaacctatatttttactatggaaaattattcgacagcttaaaccttaacctaagagttcttatcagtgtctgctcctgcttcctgtgcagctgaaactcttcaggataagtgaagtcacccgctatctatcggtcaggggagcctaatgcatttgggaagttgtttttggtttacttgctaatgacctggataaagtccagtaaggtgtggagggaaggagggggcattctccgaggaagctgtcctctcagtaaatttgtccagattgattcgaaagttaatggcccggggataaagtcgagatttcaaaaacttgtaattaatttattactaacattggaggatcctttcggctcactttctagcctagccctcctgactctcaaggccaaaagctttatacattctgggcgggcaggaagcgcacgctgggatcgaggcttgcagacatcctggatcgtggcttttacgcgtgagtaacggaggcgcgcgcggaccggagcaaggatgaagtggctactgagaatctaaagggggcgggggggggggagtcactagagcagctcttagggtcgcgctcctattggtcagaaggaagatctcgacttcagaaggactttcctgctagctggcttgcagcctccccgggggagcgagcgcgcaggagcctagcgtcctctgtagcggcggggagagaggcagggagccgccgctccccgtgttgtcttccctttcatgcaataaagaattgtcattaggtttgcgtatggcatgtgccattaccccaccgtaaaactaaaattagcaaaatgtcaggaatggaaagattgattcaccaagatgcaattatcatttaaaagtgcttgattgaggtactgatgttcagtgatttattctgcataccatatacataattaaagtagtgtagtggagtaatttatcaatctagttgagactggaggggtgaggagggagctgcagtatgtttgttttattaaaatgttgcgaggttctagtcccgccccccttttgcaagagtgaaactgatgatttccccagctcgggaggagaggcaacggtttgggctggttgggatagagaaacggaaaggaaaaggcagcgccaggcaaaggcaagaataaaatgaattgggggacaggggtagcaccggagcgtacgtgctgcttagaaccccagccccgtgtgctccgtcttgcttgccgcccccgcgtcccctcccagtatccttacattcccccccaccccccgctcttttacacgacctatctaaggctatgagctgctctccttttcccattcgtctccagtcacttccttcctggacacagttttctggacgagtctggttacttttaatcccaccggccacagacaaccactttctcctcctcttccacctcctccttcgcttcctccaccttcctcctcctcctctttctcctcctcctctttctcctcctcctctttctcctcctcctcttccagcggcttcggtgcgcgcgcgaatgcgcaagcccgcgcgcgcctccccccttgcccccctctcgcgcgcgcacacacgcacacttcgtctccagctctctgctcgctcgcctcgcagtcacagacacttgagcacacgcgtacacccagacatcttcgggctgctattggattgactttgaaggttctgtgtgggtcgccgtgcctacagctttgaatcaagtggagaagcacttcaaggctggacaaagtaaagattattgttattttttttctttctcttcctctcttttaagaaaggaaaatattccaaggactaatttggtcgtgtcttccttcatgtaagtacctctgacatttctccaaaagaatagaaatagcttgtgtattgtctctgaaatctgcaccaatctcttccaggcactgggtctatctatccaactcctttctggaaggcttaagttaaggcttgttgtgcattcttttctttagattctacgatttccttgtgtgtgtctgaaagtaactttttagatagtagtatccgtttgccatctgctattgaattcacatctgactcttcctgtcacatcagtttgtttaaagtttcaagaagttagttcctgtcattagcatgtttgatagggtggagaacgtggatactagtgtattttaggatttcacagactgttctgtgaccttgaagtcgctgtcttaaaatttagctcttagttcactgtggaaagatgttcctatgagttaccccaaagactggttttccctgggtttggattctgagccactagtccttgggatgactttaagctaaagcagggctgtctgccagaggccaccttttgtgcatcctcttccctcatcaaagtgcaggcttgaaagagtttaattggtggggaccagaagcagttgccctggccatggtagtctgtgcattgcacagttcatgtttgcatttcagcatgtgcactgttgtttagatcaagggaaatattaagctatttaaaaacaaacaaaactaagtcacttagcctgccttctgtttggactttggatgaaagttactaaactaagtgacaaagttggccgtaaaggaagtctatagagacggagcacattgcttattgtattattgtgtattatgcaagtgtttgagtgcaatgctaatgtgacttcctttccagagcaaggctaccaattcttaaggaaattgttatgtctgagccattttgtactgttctagatgctatggttatgaaccttttccctcacatttttgaaatggatgtgatgtgttctgtataaaacattcaggatgtaaatgctgacagtgtatgtagaatcaggctgtttgccagttctttaactggtccttggtggagaattgctttaagacaaagtgcattttactattgttaatgtgatagtaactctaagggtaactgccttatgaaatgcttcgtgactatatgtgttctctaagtgctgtaaagaaaactccagtcgcatttccatgcctttccagaagagtggcccggctccctccacaggcaccttgcaatggaattgtgttgcagagtaaaaatgtttgtgtggggcatagtaatccccctcccctagagatttgctgggacttgaaatgtgaccacctgtgagccacacttaaccttgaagccataccgattttcaatttatagataaaatttctcatttaatttaaaaaataatgtcagtttggctagtcttaaaagtagttcaatatgtataagtatggcaccaatggtatgcttgtgcagctattgagtcaattacaaaaatgcaggcaataaaccacgttattatcatctagtataagcatattaattattgaatataaaagtagccctaaagcaagtgcatggcaggtaaaatgagttgtcctcaagtcccatcacaagtgggaaaaaaattcctgaaatcaatgaggttttgtactatttaaaggataatacatttaatcctgtatcggattctgatctttactctaaaagtattcattgacgcatacttaacatataattaaaaaaaaaattggtacccaagttaaagggccagtagttggcagttatctttacttcaaattgtgctgaactttattttttaaaaaatgcttttcttattactatgattcacagtttgagaatgtgttatacagttctcacactccttattagaagcagtgttttaacttcattcattcactacgctatttacatcttagttggtgtgcatgtgaatacattgaagggtaatattaaggtgtgctattaatttaatataaatgtttttggtattggtggaaataacaaatgaccatgtcataataagcaactttccaccctttcaaagttagtcatatttttaaagtatgtaatcgtgaacattaactttcccaagcagagatactaattaaccacagcaaacttcagtaaccaagagttgttataatgttctttattttttgctttataaacaagttaattttgtagaactctactcattctaataaaaaataactatctgatgattcctgaaaattgaatcctaaaaaaaaaaaacaatatactctatagttttcaaatattttttagtttttctctggccttcaccttgctcagtgactaagttgaacggcatataattatgtctttctaataaattattcattgtatttagatttctttaatagagaactatgctgaataacactttggcaaatgtaagcattatcttttaaaactttcttctaattagtgtagtatattttgtgggttttattttccaactcttggtgcaatatattttttgagtctatgaaatctcagaaagggacaaaaaatggggaaatgtctatacagtaataattgtattatataacaaaaaatagttattaaacagagagccaaggttttcagaacatgattccaagcaacatggagaaatttagtgtgtagttaaagatcagaacctcacagcatggactgaagaaggattgctgattaatttttaactttttaaaatgacagcttttagaataatgcctcccaaatgaatatctaaactgaaaaagcatgcatattccttttacacatatatagtgatggtttggaccaaatgaaaggctttatcgacgatgcttagtgagtgtaacatatgaagaagagctgactgggatttcatgctcagcactgtgccttaattcacagactcatggttgttcctgcattcagtagagcttgactgggatttgtcacctttaagaaatcaaaccagattacagaggcaagtcacaaaaccaacgcaacagcgctctacaccttacaaaaggcagattacacagttcacatgttattctgatagagcaaagataaaggctgattgctaaggaacggcaagacactctgattcgaaatgattgctagataactatgccacgaccctgttgcttcgtcattataaagagccacttaaacagcggaaaactcagttttcaaataataggcgctcagtagtgttttttcattgcttaaatttgaagttccatcaactctctttgagcagatatcaatttgtcaatttgtgtgaagtggttaccataaagcttaaaggaattaggcattttcagaagtgttgtgtagaatgcagagtagatttgccaaaattaatatatctttatggtattgaaaaattaagcagaaaatacataattgacaatatcctgtatgttgttctgttaccaggtgtattcttcaagatgagtagttacatagttatgattcaatgcattcaaaacatatcatgataggtgttattggtaaatgagacatatatatatatatatatacatatacattaatgtttattttatgaatgttacttaaacatcatttttatgaaaatataatacgtggagactttgttagagaatagttttgttttacctgtagcatttttaaaactcaaactttctaaacacccaacaccacagtaatttcttgcttcttttaaaattgaagtccttttttaccctactgatgcctcctagtgtctcccacaataaagctctaatgagtcatccataactgtaaacattgcactttcactgcctgcatcttctgtgatacataaaattcatatttatgtgtttaattttctgtgcgttactataataagatagaatactttagtgaatgagatgtttcatctgtggatttatggtatgaaggtttacttcgaccttaacaatattctgctaagtgtaataagtttataccttcggttgaaattcatatcatccttccttatagtcactattattgcaaatgaaaaatagcagatcttccattttgtagacctggaaattagatagagttcatcattgaatggccgatgagaaatggttaaaagagcttattgtttcatttaagaagaccccctcaagagttaacaacttttgttaactgcatgtcttcacacatgcaaatctctatgtgaatattgcatttcaaaggttaaaaaaataaaaggaagggaaagataagtgttacttataaaatagcaaaagaaaaacttggttagggggaaaatgtctctatgtagtggaaagaggtttactagaacataacttctcaggacccacagggcactctcatgtggtagacactagtggacatcaattttactgcaaggtttatgtccttagtctcatagcagtgagtgacatgcttgcatatctgtgacttcttgcaactctgattctacctaagacaattgccatttgattttataatttttttctttagtatagttatgaaaggggacattctcctaatagttccaaattcaagtgcaaaagattttaacatctctgggcctcctgggttgtctcagtgcatatcgcattcttgactttcactaatacagtgttctgaggatccaagtgcatatgttagacctgagcttaattagttgttacacttacatgtgggggggaggcaaaagagggtagaaggagggagggagagacagagacagagagagagacagagagaagcagagagacagagacagaggaagagacacaaagagagagacagagggagacagacagagagagacacaacgggagagacacgtggtagggtgtgaaatagccacccctgattaaaaagtacacagaatattagcaaaatttgcctattgattattttgtcctaagttattccgtgatacagtgccattacaattctcgtcttgttggacaaatttcaaagaatgtaaggggtgtgtttctttcgtttaaggaagcaaacatctaggaaggggtgggcctttcccacaggagccgcatttcttcccctggagagctgaagcaaatctgtagtatgtgagagactggcccataagaaacagaatgatttgtagtgatctgttctagttagtgagcaaagcaaaccagaaagagtttttcctctgaaaaacagctcctgtctgccgcttaatactcagtgctgaaaacggaccataaaacaaaacagagcaaagaaacaaagaaatcacatttatagtgtttgtgctcacaactatatagtacattgagataattttgacaacttcacattgtgtatagcattaagatgtagaaatcaaacgtgttatacacatacattttccaaccccattgtgaggctatggaggtagcatatgacaaagaatgctacagtaaaatataagaataccgaaaggacaatctgacatgatgttatttcgtactttcttgctctcactgcacaaagaaaaggcatattcatgctaagaaaggagtttctattacctgttatataaacccatggtctagcctcattggcaaaacaagtgacatttgctttcactacaatgtatctgctatacatttctatccaatctctgttacttgttttatttgaaagtatagctggtataaacaaaattcagagtgcacataaaaataattttctgagggcattatataggaaatcagtgtcatgacaagaaataaaggcagtaaacttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttcagcctgcttattgaatggccgtgcaagacttcaagcaatggtttaaataaagtcccttcaacttgtgtgagtgactggaggaagcgggctttgaagcagtccctagtgggaacctgattttttttcaacttatcctgagagtctcttggttttcttcctgcaacttgtaatagataagataaatatgaagatgcgtacatacgttgtttatagatgctgtgaatttctagcctgttgaattttaaaagtgttagatatggttctttgttagaggatgtaaactgcttaaaagaaaaacaaccaaaaccagcatattttttaatatatctgtaatcttttcagcaagctataatgatagcaaaagaacacaaccattccccaaaccccaaatattggcatatttggcttaaatttgctcagtttttatgaaattagacagcagatttgtcaatataaatataaggaaatttgcctagtagggtaataaagttgactttcagttcttagatcataattaattgttgaccctgcataaggtgtataacaagccattctggaaagctgatgtttttaatggaacttgaaggcttgggatctctttatagtcattttgaagatgtggttatttagctgaaatattcactggacattttatttttataaatcatggtcacacaaggaaggctttataggacagactacctaattgcagtcaaggatctctttagtgaatgaacacacacagaagaacacatattttaagaatataatggtcttgtatttttttcaaattaccacactttttatatcagaacaaaacatatgtgtcaaggcagatgttttaagttatacctttcatgtaggtgagtctgtaaatatacaattcgacttaaatggctttgtgggaaggtagtttggggaatttaaaaaggaagctctcagttactgtggtttcaactctttcttacaaaaaaaagaagaagaagaagaagaagaagaagaagaagatggtagttacactcaggataaagaaagagaaataaactcttttaattctttttaacatgcccatagttcctgcggtagagcttatttttattcttgtgtgtatgcagggcaggtactggcagcgggctacaaaatgaaaacttgctggctgccaaccagacacagtgcagagcatcacatcataaacttccctccccttctctgagtgatttcagccctaagcaatgtccttcgccttcggcgtaggctgagcagcagagggcctccttcctgagcaggctttgggaaaggaaaggctcagtgtttcccttcttcaacttgaaagtctgcctcttaaatctctaaggcacgaactgcaaactggattcactatgttccctttttcttcctatatagtggtttaaaatgaatcaaacaataggtgtgagttattaaacgggactcactacctccccaccccctacctacagagtacatgaaggcctgatcagatatctgtggcgctttttgttgtcgcacaaagaaaaaatataatggtttcttttcactgaaacttttgcattatattgcagataggccagatcattttgtgatgcaaattaacatcaaaggtgtttttttttttctgcctatcacaggaagtagatgctccatcacaatatatggttctaccgtgattttttttattgataatcattcacatttttaataattattaggtcaaattacagagtaatttgagagaaaacatgagagtgacttgattattacttcgttaagtaagctgatttctaaacatctgcatttttgtccttgcacgtggaactgtggtctgaaaggtctacttctctttggcatgtaaagtaacaaatgtttaaaagtagcttgtaattgctagttacactttgaacctttaccaatgggctttttaattttaaatcgtattaaaaataatttctggctgccagggcagtgggcacttatttgtgagaggtggggtctgattattgccagcacacctttctaaaactagccttcacctttggaaatatattaaatgggaccttcaggaaacagtgtttctacataataaatatttgttccacctttatttttaaactaaattattgctttcacaatgtccttatagaatgtaagtcttagtaacaaactaaaccaattattaatcacctaaataccatttactaaacacccccaaaagtaaatataactttatgttcctttaaaatcgataaaatggattatttttaattttatttaaatgtcaagggcaactatctatctgtcaataccagtacatacatttttataacaaaaatattaaagcagtaatataacatatctctttagaaaatgtaaaaggaatgtcatgagaatgtctgtgggccagagccatctagcaagagagaaaaaatattgaactttgatgtatatgttgtaaatatagacaggagaataatttagacattccattaaatattatgtgaacctttgatttttgctttaattttaaaacttagaatgagatttgttttcttggaatagtgcaaaatgataagagtctaaatcacacctccaataaacattgttccacccactgtcaagtttcaagtgtgggaattttaaatagaaaatacactatcttgatatttaaatattatacaaactattcttcagtttaaagcctgaatctcttggagttgcacctaataggtagtttgccccatcaagcattttagacattttaaactttattaactaacaacttcgtcaaggtgtctgacttccatctgagagacgacttaggaaaggtttctgtgctcaaggatgtagcccttttctccctgctttgttaactgttaataagtcaaaatatgtaaaaaccagtactaattccatctgaattacttttcctaagtgaaagcagcaaaattagcagtttaaaaaagcgagtgtgcatgacttcaattataggatttattgaaagctacttaaagttggtatagtttagtggttaaagaaatattgttgcctacattttccttgcacatttgcacttttctctctttacacaaactaaaagcaatctccacagtgacttgaatagagttccaatggctcgcttgagtttctcagtccccagcactaacttcttatggcttattggtccagactggcaatgctgctcaatctgtatggaaggaatgtgagagagagagaccactatgtgagctgtctccctctcttctttcatttaataactcaaatgaaacagtcttaaggattcttgacttcatctttctcccttttaaatatatttatattggacttccacctgacctttcttcttatagataggtagatagatagatagatagatagatagatagatagatagatagacagatacaaattgattgatgtattgatgcatatacatatagatgatttgatattgtaaaagcatgcacttctaattttctttgtctacacttgggtgactgtagaattgttttgtgttatttgcttacacttgagagatctgtgtggttcaacatgggatactatcatgtcacaaaagagctcctagcattgatcttgaaagtgtaaggactacagattgtgtctttgtaaggagctgctgtgacttttaagtcagtggatagatagcacagccacatcaacaagaacagcctcgtgagctctcggaagatgatacatttatgcaataacctaaacaatattacggattctgtctgactctatgaagtgtgcgcatgcatgtgtgaatgaatgtgtgtgtgtgtgtgtgtgtgtgtgtgtgtgtgtgtgtgtgtgtgtgtttacacatgagcatacatgtgtttatggagtggtgagtggagatgaaaatagcagaatacatgagagacacaaagcatgagagggtgagaatgaaatctgaaagaattagaaaatcatttcagcgaacacaaagagtataaagaacctattgccacattcatttgctgtgtcttgatcgtccatgcttatgttattatatatattgtaaacctataaaatgtggagcatgatcatggggggaaacaggtccaactgagttcaaaatctaaccgtcagtttattgacctgtggtcgaagacaggttatttaacctccagaaaacctcagaccagcatctgtaaaataggttgtgatactagccacctcttcaagtttttctgaaggttaagtataaagaaaagcattatgccggcatctaatgaatgcctagtaattattaaattgctgtaattccactcaattttaacaattttatttctgactaatgatgatcacttagtaatacttggataaataatttttctttaatatatttagaccattacaattgggtcactatcaggtcaaatctcatgtcatgatgctgttaggtcaattttaatgattactaaatactgtgtatctttctctaagcaaagcaaaacctttatagatcagatgttactttcaaaattagaaataggactacagaaataagaataatttcatccttgacttttaaaagtaatttactgtaagttttgactttaggtggattactgtttaacaataatagtttcattggggtttcagctcaggaaaagagacagatgcacagaattggaagccctttgtgacaacaggctctaagaatttttgaaatctttcatttgtttaaatttgaactgccctttgaggggtctattagttcatcttgttcattttttatttcacaatttgtttgtatgtggtgatagaattacctgtgaagaatgagtgatattgtagacatcttatgttggtgcgcaagcatgcttacctataacaaccattgtatggaacctgctgagtaagagcttgagatgtataatcataaagataaaatgtactttcctttgaagagttaataaaataagtaaatacatttttactgcccttagttgtgtgagtaattattaactctgactatagtttacctaccttgggcagtgaacaaatagactcaatttaggtattttcattcatatgagaagaataaagcatagaaaaatgcagaattttgctcatgactttagcatttgacctatataagacacattcagaaataaatttgataatacttggactgtttctggtacaagaaactagtttccttcttttggttgtttttgtattcacttaatttctcaaaaaaaatcatattttgatagtaggtaatgttgacaaagctttccagggtatacaacctggggagttatgtctgcttgaaatagttcccctgcttttgaataatgagcctctggtgtgcaccttgcatttcagctttcttttctaaccttgttttaatgcctggataaaagagtgctcagcgcaaggaatacttgccgagtggacttccctgtggtaaaacagcatggacagctcccaacactgcaatcaaggacgcttctaaaagctttaatttaaaaataataataataataataagtctgcatgaagatgatggagccctctaaggcatatgggcttagagaattattcccatctgcaaccccctccccctgcttagtagccctttccagggttatgattactggaaaatggctgttaatcaccaggatttttttttgactgcagctgcttcagtcagactcctaatctattaaacaactttgtctccagtttaaaatttgcattgtatactgtatagaataaattttcattgtaatcagagcatccaagagaacttccatatatgatttatagcaacacatttgtttgtatgtatagacctccattctgctattgagccaactgtttgaacaatactgtgggtgatcaacataaaatgaaatattacagcattattgaacacaagcgccacttacaatagtcacattaacagagtttgaattgacgcatccttggcacttggcagaataatacacaatttgaaaacttaactcagatagttaaattttcacttgaacctgaaagaattttttttttgaagtttagtgagcttgtacgaaaccactcggtgtctttgtcaacacttgtgcttattacatttgagataattttaataaatattccactgccagagtcaacattcagtgctaagagaggacacaacagcgctgacttacaaaggactcttttaaaatgcattcttacatgtaaaattgacaggctacaagaagtggttggacgatgttcatcatgctggaaagaatgtttcaattaaagttgagcagtttctcttccagctcttttttttctccattttttatttgctgtgccaaggtatccatgtgcgtttttccactgtcatctggctcgttcccagcagatgcacacaatctgttccgctgtcactaacagggtttggtttatgaaaagaatgtgtcagaacatgccagtgcagtcacttttgcaggttttaaagagtaactgagaatatatgcattgccctactttcttcgtccccatccctaagatttccaagaaacttttatactagactaaaagcttgctttcagatattcttgaccaaatatttactttttattaaaaataaaatatcagaagttcaaaactgtctttagtggttaaatttaagagcagatttttatgagagtgtttcaaataaacccaagatggttttgataaaattatcaaatttccaattatgattatttcctgcaaaattaaatacaaacttaatatcaagctagacttgagcctactattccactaagtcatagctttgtttaaattgttctctgatataataataaagagatggtcataaatagcaactgtttagtctaatagacaccattgttatgttaatcccaaagtagttaaactatcaaatacaatcccatgctttatagagacaatcacctttcaaagaacattgggatattctgttttccatatattcacattttaaattcaacaagtaattttttctgagtgaaattcttgttcaataatgtttctttattctcattaaatatcaatacaaattttaggtttatgttatcttcattggaaataatatttttgccttcatatgaattcttaatggacagtgaatacatccctaagttaataaacttaattatataacagtactttaagttttatgtataatactgcatgcatattcatatgcaaatagttactggacaatatttgtattttgatgagattttagtggtattaaatatctttcagaattaaagtatcacacattgcttgaatgctaattttaagttattgaaacaattttctgacttgggtagcaacttaaatctcaggggaactcaaactttcttagtgaaagtttaaatcagatgacctaaaaatatagattcaaaacttacaaagaaatgataatataaatgatttttgataaaatacatatttagaaaagctagctttggatttctccgacagaaaactttatgaagtacacttcaagtgtcagaagtacttatattaaaaagttgataccattccatagaaaactcttgcaggccgggcgtggtggtgcatgcctttaatcccagcactcgggaggcagaggcaggcggatttctgagttcgaggccaacctggtctacagagtgagttccaggacagccagggctacacggagaaaccctgtctcgaaaaaccaaaaactaaaaaataaaaaaaaaaaaacccttgcagtataaattatgttttaaaacagttctgaacatattaagaagaaaatatcttacagttggaactcattggcactgctattacagcatacaaattaattgctaaattatctctatagaattaaaccagacaactgttacgttttcttaattcctaaagtaaaaggaatcctacaattctatacttaaatgttgatttatgcatgcctatcataaatggattttataatgtttttgatgagcatagcacacatatttaagctgagtcataaaacctgggcaaagtaacacatgtatgctattcagaggtgaggaaaaaggatcaagttcaaggtcagtgtgggctacatagcaagccgactgatgagaggagagggaaggcgatggggggggtgaaaggggagggaaaaggagaataaagaacaattaattctaggttttattctttttatttccaacattttaatttattcataattttatatgtcatatgatctcacatcctaatttgtgggtacctgtatttcttggggtatggtggctttgatatgtgcattggcacaaagagctgagaatcatggatgaactaataagaggcatttggctgagtcctgtggaatgccctgcccctttcctttctcttttcctgctgaaagtcaggtggagaactgttgtcagtttgaggaccaaatgagactaaccactgctggtgttaaggagggggacatgtgaacacagggtaattacagtctttaatcttgtatgaaaaacaagatttcaagacaaaactccatgtgtgaatttgggcatcctgaattgttaatcctaaaatcttctatatatcacttaccgcatagaaacaatcttaaatgtcattaggaagagtttcctccttttagcttgattcacataagttgaatatccacaaataggttttgcccagtgaaacactagattcccccaaaaaagataagcctttcttttaaaaattaatgccttccttctaaagaagtaatccgattttcaatctaacttgatttgttaaaactaaagcaagtatactttccaatgtaaattactttcttgttactgagatgagctttggaaacatttcattttaaaaacagagtcctgttagttgcttcaaattccaacaaagatgggcactcagctattaaacaagagtaggaagatggtccttccaacagataggacacctttctttgtggttaagatgtgatgtgatacttcatttgcatttgcttagtcatgggtcttttttgagcaaagatagatcattttgtaaaactgtccctgtcatatgtattattcatagagtaagaaagtcttcagtctctctcactgcacaagcacaccaaagcctcttgctgcaggtaaaaggctggacagcagtgaccagaaagctttgcactaagctctctttagagaatttcaagacagttgcattctttttccatctgcactggcatatgctgcccagttggttttcagtacttgttggtttatataaaggaggactcatctataaatgtaattgatactttcaactatgacttaggaattctgattctccttttctccactcactagccaacgtatctctgatagctcctgtaacgtttagactgtgtcaaccatttacattgttctttacaggaactatgtactacagttgttgttggtagtaaatataatggccaacagttttggagaacttactcttaaggactgttctaagatcttaaaactgcaagttcattgctttatttattcttcaaaacaatatgttcttccatatttctgcccttaacatattacaggtgaagaaactggtccatgaccttttaaagtagtttacgaaggttatctagtaagggcagcatatgaatctccaatcatggagtctccagagcccattatcgtacatactgagttaagcaagatcctacatacatcatacctgctaggaaagaaagaggatctcatcggttacatctgaattttttatggctggttaggggaaactagttagtcgttccacaaaagcagaagacatatgtctgtgagctttctaagcagaagagaaacaaatatttgtctgacatacagttttatattgataaactgaatgaagagcatttttactgacagacctctttgtgcaagcaatctctggttactgtgtgtgaaatgtactttccggttacagtatgagcctcattgatgtgtgaacatgtagatgttcatcatagtctactgatttctgttttgcttttcatctcttaaactggtccctttctaaacttcacttgcaacaattattgtaatttaatactttttatttatttaaggatttgagatattagacaaagtctatgctggatattaaatgaatttcagaaattatttagctaattgaattagtatggtgcctattctgggtaattcaaattcaaacacacgttctaagtgtatctttgtagtttaaaaagaaaaaaaatcctaaaaccaatggtagatttgaaacaaatagtggcagcttaggatttcttatatataaaaattaatatatattgtttattcaccaaatgtggactttaagttttacatgaagtattgctgggttgagtaaaggagcttttaaagtggaaaaggaacattttttttggtaattttttactgttagcaaacagtatgaactttcttttctctaaggaacagtttttcacaaaaatattgccatagttagaatggaagtgaggacagagtctgatggaggtcagtggaactcagatatttctgaattacccaatgtacatgcttaggacttcagaattaatagctacaatattttttaatgtcatgggctgccttctaggtcttcacagctcacgttaataaatacatttgcttctgctttgtttctgttttgaagagaaagaagtgattgatagtcttaccaagaaaacaggggaaaaaaaccctatgttctctgtatttaaaaatgctattgttgttaatgtcttttgaagatatgggtgttgcgtattatttgggactaatattctacagaaataagtagctccctccatcactctggtgccagttgtcaggggggatttggtcttctctgtgttagtcactattaatggtcagcgctcactcattacaacaaaacaactaaggcaagtagctgcctctgtttcctaacacaactcagacacaatgctttgacttcctctcttagagccttccaattacaacacatactcttaagatgccatggatcattgactttatttttagaatttatttgattactaaatatatcgtaaaggctttaaattactgaaagcttgaggaggcagtcatagttgcaggataattctgaaaaagatagttacactaaagttattagtaatagttccagagcaagactgttatgggttaacacattttaagagcgttttcaaaaaagttaatcatcgaaggactaaaaccaacacacaatttgttataaacagactcattcaaaatttgtgtgatagagttgatcttgggtgtatggtaagaaagtagagagaacatgaagttgtctttttataattagtttagatagtaaggtctcaatcctgactagatgagaagcttttcaaaaccatgatacccagatcccacctccagatttggattaagttgcactgccatctgggcattgtggtttttaagctgcttgggtggtttttatgtaaagactggcttaagaattcctagttaaatgataaatatggattttaaaacttgggcatgcaacttaaaatggagacattctgaaagttatagaaacaaataagcatagtagtttgggctctgttcctacattgtattctccagcacttgctcatggacaccgactcttaacgtttaatgagtcagtacagtgagaagatggtggagctgttcagacctaatgacgttagtttcttttgagtttcagggaagtaatgaagctgtgaagatgggccagaagtaggacaagcgtggctaatccctttctattctctggtatgccacaaaaccctccctgttggggatctcgagataacttggaggactggctcctatcctcccactcctgccctagttcctagacacagctgaaaggaagggtgcctgagcctggtcctcctctgcaaacccctgctttgtcaaaggatatagagcaggttatgaaaaagagagaaaagcaccaacagagagatgccccaagaatcctttatacaaaggaactcaacttttatctcatacaaaaagtaatttaaaaaaaaaaaaaaaccttcggccaacattttcctttttccttcttgttctaaaaaaaaaaaaaaaaaaaaaacataaaataaaaataaataaagtactaaaaagatatcttatctttaggaaaagaatcttgtaaatgttaaaggagcccttaaaggtatgctagtagaagggaatatgtctttttgagagctgatttcttacttttagatattcttttttaacttgtttcaaaattataatataattatataattcccttccccctttttttccctataaaatctcccatatacatgctcttcctatctttcaaattcatggcttttttatatttccttattaatttatatgattaaactattatatatttcatatttccaaagatagaaatacactgtgttcactctgtgcattgtaacttctttgtgtgttctcaggtctgtccatatggtatggaataatggattgttcttccttgtggaagactctatctcatgctctcagcattcctttagttaccttcagtcctttgcctggggttaagacctcatgagctttccccctccctgttagcttgtctatttgtgtcattcttgttatgtgctgtttaggcagcgatgatggacttcgtaaaagggaataaatctttaagtgcaaattatggccttaaaagatacaaagaatagtgggaaccggacttgcttagtacacaatagcaaatataaatacaaagaatatccacatacaaacacaaacacaattatactgtgtatatagaatgaaaagatatgacaataaaagtatagacataattttacgtagaaaaaattgttttattctgctatagaaagtattatcataaaaagacatgcttagagttaaggaggtcagggctttccatgattgtaacttccaagttggttgaccctcttcagatggacactttctctcatctcatgaaaaagctgaacaacttttccaggtgaatcagttcataagtaaataagctaataactttccaagtccagtgtgacgctaaaaatcatacgtgtcatgaggtgttacctttctgaacaagtttaatacaaaacatttcagatctagcttcatgtttgaatatcttggagttcttaaaaactatcagtacctggaaaccagcaacaacaattctgattgataagtcagcgattgaaaaatcactgattgatagacactatttttaaaagtgaccaaagaaactaaaatacaaagccaaagttaagaactattcttaatgtacttccaaaaatgctaaaatgttgaagcatctttgaacggtaaaggggtaagttgggacaacagtgttatgtccctctaactgcagaatttggaagaaaataaaatgacttcttaatttataacagaattacctcttccatagaatcttcccttcccaagtttatgagaccagctgccccattctagattttaaattattggcatttctgaagatgaagtaacaggggaagtgatgaactttataaatagactgcctaaaatatttgccatgaggggtcaagatgtaggcgaagctggaaaaagactttagcttggggattagccagaggccaacagttgttaaattcccaaaacttcctttaaaaagagactaagaatccctttgagaacatttttttttctcttcattgtatagtaagtgaaacccagaaagggagaggggggctaaaaacactgtacctttttagccaaaattaggtcatgccaaccacagcaaattggaagctctacttaaattgtagccttgcagggttgttgtggatcttgttgtcacgcacatggtaaaactgatgtctccagatcgtgggctgctgctggctctgctgagcaggcctgttctgctgtctgaatctaactgtccagcctagctctccagactgtgacccgaggccgtgtctggaaggtatgcagtagaccacagcttttgaaaaatacaaacaaacatcctgtaatttggcaatttctaaaacaaaaaacaaaacaaaacaaaacaacaacaaaaaaaaaccaccacatttcattctgctttatgctgctagcataacaaaatggcaaaggaactaaggacagacagtagagcacagcagtagcaggcaatgttgctgttggacaactctggcaaagacctatttttatccccaaaggaaaaggaagtagaaacacgtacatagctcattcccttatgccctgcctatctgatgggatgggacggtagagagaagacattcaggaggcgctccattcatccaacaagtacttcaaaacatgggaatgtcggacccactgtaaaatgcaaggtttcttccgttttgtaaaaggaacccttatttcctacttacagaacccaacatttccctggtattttaaagtcatcattatagtgttgctttggccataattgaaaactatatttccattatattcaggaaattcacaatttttttttctatttgcagaagatttttaacaaaattctaagatctatatggtttataaaactgtatcatagcatcgcctcacagaatttttgttgttgttgatttttggtttggggttttttttaattttacttatttattttcggacttattgctaaaggagcaacctttgtatctgaaaacccatatctgtggtgtgtcaacaaaagaggtttcctgtctgaggaccaattaccaatttatatgattgattgtcagtgaagtttccattgctggcttttcatagaataaagtttccattgttatgtaaccttccacctgctgttcgctgagctgagggattgggcgggagattgaagaagtaagctacagcttgtcagtagagaacactgaagtcacagttatttagagtggtagtgaaatgtgtaaataacactatcctctggtctccttatatgccagttctatattcttgaaaatcagaaattaaaagccaggtttgtactgtgtgaggattctggaaannnnnnnnnnnnnnnnnnnnttacatattcaagacaggtctgagggctatttgagtatatcttgtgctgtcatttttggtgtccctagtatggctcatagcactatattgtgtcactttgtgcccagtaataccagcacagctcaaatgacaaatatatcgtatctaaaagtatattacaattaaggtaggaaatacaaaatttattttccttggggacagtttatttatttattattatctttattcactttacctcccaatcacagccacctcctccttttcctcctcctcctcctagtctcacccttacaaatcccccatcactgcccctccccttcccctcacagaagggaaatcacctggggtaccatcacaccctgggacatctagtcctagaaggactaggcatatcctatcccactgagatccaaccaggcagaccaagtagaggggataggatccaatggcagggaagagatactgagacagctctttgggtacaatttttaaatagatgatatgaactgtgtccatagaaacctatggtatacctcatataaaagttcaaagattagtaaaaggccatactcattcagtaatacaaatagctgaatgtactgattgagtttgctttcccaggtactattagccagagatctctctggaaaagtgaatggctagaaagagataattttctagatttccaaaatatatcccatggcaccccaaactcagaaggcagctccgtcttcagagaacatatttcttattatcacactcccacgggaacatcctgtctcatgttcaggtaatgggaatggccgccagaatctacgcatgactactgaggggattagttttctgacttacaatgtcatctcactgagctgttcctgtttctcagtgcaaatgtatagtgcttgtcactctaaatgtttactgcttatctctagttggcctgacagacacatgatggggaggcctttcttgagagctaactgagcagacactaaagaggagatgagaagaagactagtaatggagtgagcatgtgctagccaggatggaacagacgcatcatcaggcaacttcagattggctccattcgcttccttgcttgtaccctggagtagtccttcataatattccaggcacactttaagacccattgcctgtagttcctaaatttaaactcttccatgcacatggttaataaacacctaataaatgagtgagcaaataaattgtgatcccctctttctaagacctatgggttcttattcaccctggtctccagaaatacttaggaaggtgacttggctccatagatatgactaccggtgacttgaattgaattgaatgagagaaaaccgggcttatgggggaggtttgatttagaaactcttataagaggttagtgtgaagtgattggtgtgtgtatggagtgattcgggtatgcatagagtgatttgcatatataaaaccatagctggaaaactgagcagatcctgacttgccagggctagatatgtatatattgagttgacatgatttagttattcccatgttggattttattatcaagaaatctctccattttctgaaattaagttaataggaaaagagtattttgttggataggttatgagtctaaaaacagcactccatgtatttaaccaaaacattcttaataatgtttaattaacttgtttttaatgaatctttgagacttctttctctgcactatattgcttgaaccatctgaacatgagctcagctacttcacagggaatctgactgaaagggatggacatgcatgtgaggggcagcacattactattaactggactttaagatgcttatcacaccaatgtattttatccttttgtactgaaaacccaaccatgaaaagctagtgtaaaacccacaattataaaaacggaaatgtataattttgtaactgcgtgtacctttatcctaagaattgtgaaagtggtttttttcctgaaatataaagaaatttgtatcaaaattaaaataattttggattattaagaaaaaacttgataactggaaatattttaaattcctataaagtcttctgcattgcattttttaaacataatttttaaatgggtcagaaatctgaagaagaatttcaacggttcattttaatccgtgtggtcctcagaatttctcaacaagaacagcaccaggccaccattcttcccaggagcctcccatcaggctcagtgctcctcgagccacttggaggagtggttcatagctactctagaatgcgtcagtgtattcacataggtactaaaattagaatgaatctcggttctttacagcacaaaagtaaagccctaaagacagttgtgattcgttgcaaacccctttgcatatcaaaatagaaataatgtcaagatttgtaacttcaataaccatgatacctaagcattaatgaaatggtgtacgtacaatagcactataaaatgaaaatacagtataatgaatattgttcttaacccatattgtatttcaggctctttgagcttgggactttattgcattcatctctgagtcggttatgcataatagtttttccataattgttgaggcaaatgaatgaaggataataattgtcctatttcaaaatagagaagcttggaagagcagttgaagtcatcactccatgagcctttccctgtggagttgcccttcccacatctaacttctgcaagattttgtgtatatatggtgtttactgtgttttaactcatattaaaattagtatttaaagtgtctttctcagtatgacaaaatgtcagctctttggagtacagaattgtattcatttttctatttgggtatacaaactgccgaataagtattctctcaaataaacagttgctttttgcaccatcgctaaacacctgacaggctaaagaatttttgccgtcattgctctaggaacttataacaataaagtctacgtcatatcatagatgcatggagagtagagctttataagtaatcattgactacaacaaaatgtggttctcgtctgcctacaaaacgctgctaattagtgtattatcatgtggtgggtagataatgtttctacacgtttcttgaattattattttaatgttatcagaatttttctgctgcttaaaacatgtaaattaccataacatttgtttatgtcactagtaaaagtcatgagataattgaatgatgcatcatttgatagatacatacatacgtacgtacatacatacataggtacatagatatttagatacatagataggtacacacatagattcatttgaaggcatgtccattgctccaatgggagcttaaacttcgtcaaatctttccatgtgataatcatctaaattattcctataagaccataaaaaattccaatacatagaaaaaaacttgtatctcttgtaagccctttgtaaaatatgccttttacttattccactgttagcatcagcagatggtaagaagaaaactcaaaacgataattaaatcatgaagacttcactagaaatcttcctatcttcatgacatatttgttttaatgatattgttctctaaaattatcatcacttgatttttttattaaatttcatttattcaggcagtctctctagtcacctgctttcatttatacttacttacttctattttgaaagcattgacttacatatctggatgttatggaactaacagcgcatttcttcttagtgctcctactgggagataagttagttatcacatgtacaaaagtacctgctcagaaattgtctcttgttcactaggaacaactccagcctagaaaacctgttacccagtagatattgctgcctactgcttaagaacacaatacattctcattatcattcaagaaattaaatgattacattaaactctttgttaaatactttaatacataatttaaatgaagtgagcatgccttgaactatcttgtatagaaattgactttaaagtctgattctactttcattacctggtcattcctgctctatatttcaacttccatctcagctactgatgcatctagacctgtattttcttgtttctgttaataaaaatagctttaaaattaccaatctatgcagaaataatttaaagtttaaagaaaaaggatgtgaattcttaactgttaaccagtgttgaacatacactttagtataaagatctggagattgttttagccataattttatatcaaatatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaaattttcaactataatcgattagcaggtagagtttacaacagtagaaatttaatcaatcctagcaatagttgtttacaccaagtaaaatccataaaatatgtaaaaatccagcataagtttttcatacagagtgaggttatggagtttgtattgagtactgattgaggctgatgggcatcaggagaagaagacaaaataatgcagtggcgcatctcagcaacaaaatgaaaaacaatggcttcttagtgggcaaatgctttagagaagttattccttctatatacgtatctttgttttgaaaaagtgaacatcactaatattagtcgtagggtgtgcatgaggcctagagtctccatgttgaacagaaggtatgtgcctgtagaccccacataatgccatatgatgtccatgagctctagaggacccatagcaccaaaggctgctctatttactaagcctttcttaatgctttttggttttgagattacacacacacacacacacacacacacacacacacacatatatatatatatatagagagagagagagagagttttgtcagaatgcatatctatgaaccacatgcatgcagagcactctgaggccaaagaagatattagatactctgaaactgaaggtacagttgggagctcctatgggactcagccagggtcctctagaaaaataaccagtgctcttgatcattgagctatatctgcagcctctcttccaaacaattttaccttcttctgcatgtgtgttcataaatcaatagatagttgatgttggattctctttaccaaaacaaacagcacacactggaatggaccattagtttccagctctagagattcatacttctcatcgccaaaagaaaagggaaattccctttgctgaagcttcctgctctataaagtgcacatgatgatgtacaccagggtcttacggggattcagggagcctgcaagcacagtgcaactcaccatatacagcgagggttaaactaggtatccttaacaatcagaatccttcttcctatttttcttttgtgagaaagttctaataaatacatctacaattaccagaataatcaattaaagacgttaaagacaaatttacatttttattttatatttccaaagatttaaagagtgtttatagtggtttttaatggttttggttaaaatctttaaagatggtactatagaatagaagatttacttatttctggattttccaagttttgaaatgttgattaagagtaagcaatttcttttttgatatttatttttatttcctatctatggatatttgatttgcatgcatgtcttgcaccacatgcatatctcttatctgtggagaccagaagaggacactggacactctggaactgcagttatgcttggttgtgaacccccatgtgaaccttgatctatagaagaacagcaagtgactatcacggctgagctgtctgtcagtcgtttctagccacagtgataagcaacttttggaaggaaattgtaaatttatctttttggaatatcaaacaagacttggatgagaggggtcagccttgaagtttcctgccataaaattaagcattagatatatattaagtaatattaacgtatttattggtatagannnnnnnnnnnnnnnnnnnnccccgttatgtatttatttttatcaaacaagtcttacagtctttgctctacaccccaatagggatcataaatgatggacaggagtgactaatatcctgacaccgagactctctttggcaagtttttcctcacagcttttgacacagtgagcaggacttttatcacaagtaatgtcaatttttaaccagattctaatcttgtatttgtcatcagcttgttcccttcatcagtgtacgatggacacatctttcttgcctgaaagcatacaagtgttaggtctagatgaccatccaaaggtagcaattatccttactatgtggaggggtagacatgtatatattttacattaaacggagcttttcgttcacttaaaatcactctgtattccacatggtaagagctgctacaaaagtagaaagctggactcattctgctaaatttgtagagatccctttgtgttgtattgaggcagatttggttcattctggagggtgaaaaggggagactgtgaactgtggccagcctgagccatccttctctaccctgcctttaaaaacagaagtttgtctatcaacacagaccattggctttaaatcagtcagatcaagtcaaccacctctttggaaattccatattaaaggcaaattattctatctttgtaaaagtttgatgctaaaggaataaaactcttttgtggggtcttctatatggactttttagttgcaccactctgtggttcatactagctaatcattttaagtttgtaaaatgggggttatctctgagacacattcttacccatgtactttgaaagtggaatttacttgaatctatgttttgtaatttagataataattatttgtatccaaaccaaatttgaacaactgtttcctaatgcatgtgagatccaaatctttaccataaagggagcgggtgtgaatgtagataataagccgagtagaaatggtgatcttatgtgagctgcagataccatctgatcatgtcttctaactaattggatctctcagaagcttgctagcattctaactagaggtctatcctgagattatttttaaagcacatttgttatagaaatgaaatgctaaataagaaagaggaaagtggtaacagggaaagttggcatggagaactgttgctgcactcatctcgcttcatctttcttctaaatatagttataacatactgcccgggtcagctgatgtatgcagggccctttcacgactgagtcccttcccagtcaactccatcatggttttagtgaatgtatgtggaacaaagcagctgagttccaatatcaaatccagagtgaaagttgccaatcctccaaatatttttaataaattactaatctcaagaccaggcttaagttgctacttcagggctgaaactaactttttaaaagtcatatctcttactaagatgtcatattataaaatactagaatactatttattctttgatggagccatttattccactcaaggagaagccctgaaaaggagatgtgttcatctatttttactctaagaatataaacatgtctgttacactctagtcagtaaatgaattcagaagccaatatgcctacatgctcaaatttcttctgtaaatgatgaataatattgataaatgaaaattacaaatctgcaatagagcttaagtactgaatagtaaatcattctgttactaactctgtgttccaatgacattttctagatttaaaaaaaaaaagccattcccatatttaaaaatattttgtgcctttgcatcaatgtaagcaaatgtgcatttgaaggaaagttcacaatttgttcacatataattcccttttggaatcaaagtgcccttttcaaaaatagtttatatctttaaaatatagtatttaatatcctctttcccaccagactaaatagattgcaagtgtttgtaagaattaaaatagaggagtggtggatagttttaagagacacgtttgttctcctagctttgtcagtgtgcattatggagctggtcatcatgcaggacggaacgatgaggatggcagctttagctcatgtgactgacatgcacccatcatggccattaatacaagttggcagtgaccttggctgcatcacaaacagtctcctttgtgtggggggtgggggaggggcagataaactatatttgaatgatacttctcctgtgctgaaggcaaagtgggtgcttttaagaactttactgcttaattgtcttctttagttctaaagcaaatatttatagttatcctcatccttatttcctatttccttttgccctctcaaataacctcttctggtgggggaactgccatttgtattcaatagcactttcagaaagagtcaaggctaattttatttttattatagttgtgtatctgcagccatatactattatgcccatcagagtcaaaactctaacgatcaggaagcacacatgcagaggacatagactcataatttgatataataaagcaattattattaaaaatttagctttcacatgataaaacttctcaacagcaaggactgggaacatgggtcccccagtgaggcactagcctcagaatccggaggaactaagtttgagccataccacacatgtaaactcactctggcttgaaaacccaatcctgggatacaaatgcagacagacagatcttgggtctgctggacagtcagggttggctccaggccagcagaactcctttttttcaaaactgatggaaatttttctgaggataatacatgtgtacacattctacctgtatccagataggtaggcacacatgcatatacatcatgacaacataaatagtcactacagggtttaaatgatacaaatgtatattccccacaacttctgagataattgaaataaaatatataaattcatcattgcatagtttctgtatcagatggatttatcgcgttgcagagaactgtgatgcataaaatattaagcaatgacattgtcatcattttaaataacctgtaatatacagcttagtaaaaggttactactgaaagacctacattttaaggttgatttaagtaaacagactttgagcaggttatggtttcttgcatataattgtttgtgaatcatatttctgtcaggaaataatcagtgactatgaagggagaatatttcccgctagtgaggttccatttaaaaatgacttcttcctgagttatggtggtcttctggtactttgaaccagctgtttacaataacacttacaggtgtgactgcactggagaataattgttcattccaaactttggcatgacttccaaattaatcaattggcacaattaaagcagagttactagtcatggatgtattttagtatttcatgtatcagagtgatgcttccaattagtgggtcatttcaagtgcaccacacaatttattttcatacagagttccctcgagcattatttatgacgaaggaagaagtgtatgaatggatgtagctcttggttatcatcctctgtgaaactggtctgtatatgcagtttcttgttatgcttaaattgctatgaaatacactgaaagttgaaggtattttatacctggattttactgcaagtgagtaatgattaagagtctataacactagctagaatgaaggtgcatggctgtaatcctagcactcagaaggcaaaagcaggaggaggccagcttggtttgcacaatgatgttaaggctagcctgaactacaaagcatgaccctgccctaaaaacaaaagcctgggagatgactccatacctataacacttaaaatcataaccccaggaaagaagaatctcagaagagctcgtattgtgttaaggtattccatttaaaccataaaaaaagctgcatttccttttttttgggggggtggttctatttaagatacaaataagacaggagttgaatccaatttcaaaaatacatcagaaagaaactatatagaaatccctcataaactgcaagtcaaacttctagctttcctttcaggtagaagcgcagattgtagatttacttgaatttcatacccttcacttttacctgacaaggacctttgacacaaaacttttacctgacaagtaccacattgtgtaaatttctcttcagaacaatgcacatctttataaattgcggcagcacagcagacaagaactgagagccttggggtcagcctctgccacctcgagaggcagactttagtgttcctcatgaaaagttggacaggttgcatatgtttttctttgcttctatttcctccacaaaaatatgctaagtaacatgcaatgacagtatgaatttacccagatatcatagcatatagaaataatagaaagagtttccaaaggacatgctcagacagtgtgactactacaaccatgatgaggaacaactatttcacagaaataaactatcaagcacagattaggggcagagcgatgccaaattttattattctttcttcaccctgtttttaatctgaacttggatttcttaacataatgctaaaagatgcagctttttggtggcaggtcataaatcacgatggcatctttacttacattacctagttaatatctcataactggtaatagagaaacagagtcttagaaaaacattagatttccaaactgaatttcagaattatgaaaatcacagctgtattgtaattgcataacataaatttctgcctgataattgatttttttgttgcagcatgtcaacagaattcatgaaatagactttactttcttgattagcttaattctaaaatacaggatttttcttgggaaagagggggttgttatagaagttagattgtatatacatatgttgtatttgaaaagggagtgaacctgtttgtgtttggctgtgtgagcacagannnnnnnnnnnnnnnnnnnnnnnntttcacaaaatattgcatacaaattttaatgagttgagctcagagctacgtgaggtgaacagtatcccaacccctgtaggttgggagctcaggaaattctggtatgctctgtctccatcgcccttcccaaggcaggacaggcgaacgacattatgctgtacgtaagcatcgtcagtgtgcactcgggtctagacacttcactgtaagaagtccacacaccaataatgtcaagaaattttctggaaaaggaaaagaatatttaataatgcaagaaattttttgacttaactccataccattcccttaaggagactaaaaatgttgtcactttgacatttcaaacatgtatgtagccacaagaaatgagggcatttcacagatttaaaggggttaaaagtaagtcaactacttattacttacttattggattcaattgatatcctaacttggaatatcacctcttctgaaatgattgctattatttagacttccatacataacatggaaattttgctagatatctgacattctgacaagcacctagctacacagctgttttctgttttatctcactgttttatcctcctgagaatttttccaacatatttaatgaaaactgaaattgtgagaaagaaatcatcactgtttcccacttctttatttactgtaattttactgcttattctgtattcacaaattctcaagaaaggattttctcattgtgtatctttactttatttcttatatgattgatgtctgaaattgccctcctttgcaatccactgtcttttattctatgatagtcattgatcactagttctcatctgaatgtaatagaaatatctaaatactactgtcacagatcactcagctactcagcatcaagaaacatgatatcacatcacatttcttgaggaatcagtttttctctctttcagtgaatttgagacaaaagttttcaatagtacggttttttttgttttgttttgttatgttttgttttgtttttatcaaacctggtgattggccaaggattcatagtattttgggctccaagtacaagcaccaactaaagatctgaagaatttagctacataaaggtgtattttaccagaagagacttcatacaattcaggaatattacaagaaccccttagaaaagttagtgtgggacataaaggatggcacaagagagcagaggacacctccatttctatgagaagcattgcagagaagcaagctgttgggctaacagcgatgaatctggatggagagtggaagtaaaaggaactgcaagaaaggcaagaattaaagtggagggaaaatgaatgttttaagaaatggtaaaggattgaactcaggtaaagagaagggaaatggagatacatacatatagacatacgcactttgcatgtgtgtgtatgctgtgtgcacatgcatgtgtgtgtgcctactttcaccccaagtactgacaatacatagtgtgccctcctttaacagggacgggaagacgagcattggcagcacaaagactatgtgaattaattatatgagagcagaaacctttgctgagtcggttgtcacatatcacactgaacaatccctggaacagctattattttttaaattataactgaattaaggaatgagtaaatgttgctttggtttgatttcttacctttattgatcagtgatatgaacttgtctgtggtcacatgaaatctcacataagtgtgagaagtgttcagaagcaagtgacattaagaaatgaagatctcacggaactccttcacacacacacaccccctggacatgtttccttaaggttattttatcactggaatttttgctatcaggcctactacaagtccacaagctacaggcttaagaatttttaaaataaaacctattatgcaactaacatagcatagtatatcttagttttcgtcaagaggttgagagatgacactgggaactacattcactaactctcttctttcccgttctaaatccagtctgtgtaatatccatcctatagcagtcactgcatgaacacaaatgaattcggcattgtttagtaataataactgaccagtgggaaaattttctccttattaataataaagtatagagaaaagataataatataatctcagttccccaagattcttaattttgtccgggatggcaaactcatccatcagtgaggaagataccctcccaaacacacaaattttaatgggagctacagaaatagtgaaatcagaactttcgggggtaacattaaatggttaaagaatcctgtgcaatttgagtgtttggaaaggtaggatgaaagaagctgtgtggcagaagaaaagatgcaaacttaaaagaggtgagacaataaattggtgctttgagtttgtgtacatgtgagtttggggagtgttgagactgttgctgtgtagcctcagctggcctcagacttcatgcctccaccccctgaaacgctggaattacaagcatgcaccaccacacccaggttagacttttattctttatgactatgtatatttttggattctagagctaaaagcaagaatataatttgaaacgaagagctttgacaatgaggggaaaacctcaagtaaggaacaattagcagaatacatgaaattcaatccagacttcaagtttagggaaggaggacctgtctgctgagtgttgtggggcagggagcaggaaagaagagccaaggcgaggtattctgtgagggattagccgaggggaagaatgtcctgggtcagagctgtgaaatatcaaaatagtttactggggaagctgtggtgctccttttccggaagcccttaaaataggagaggcaaaatccttgtgaaataatttctctatggtattatctaaaggtgggaatgatgatatgagtgagcccagccactgccaatattgacccagaatgacaatgctcacctgagcttaatagaaatacagatctatgcatttccactatgaagaaagaacagcccttcttattttaaaatcttttacttgcttggtaaattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaattaactactatgtcaactagttttttaagtacaatatccatttccttgtgtctaggggtaattaatttgtcactgtttccccttctgaaacaccattttctctaaatacacccataggccaaggatactgatacaaatattatttttttaggatcctaggaattttttattaggtaatttcttcatttacatttccaatgctatcccaaaagtcccccataccctccccccactcccctacccacccactcccacttcttggccctggcattcccctgtactgaggcatataaagtttgcaagaccaatgggcctctctttccactgatggcctcgtaggccatcttctgatacatatgcagctagagacacgagctctggggatactggttagttcataatgttgttccacctatagggttgcagatctctttagttccttgaatactttctctagctcctccattgggggccctgtgatccatccaatagctgactgtgagcatccacttctgtgtttgctaggccccggcatagtctcacaaaagacagctatatcagggtcctttcagcaaaatcttgctagtgtatgcaatggtgtcagcgtttggaagctgattatgggatggatccctggatatggcagtctttagatggtccatcctttcgtctcagctccaaactttgtctctgtaactccttccatggatgttttgtttccaattctaagaaggggcaaaagtgtctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatattctgtatgctaactgttttcagctaatatttctattaggtatatgtattataaagccataaaattacctctaaaaataatgttagtgtaaaagtgctagaaaataataagactctgagcactgaaaccacatagaatcccaaagaaattgataaatgtataaactctgaggtaacaacttgcaaataggagagtattatagcttgtatccaacagcgactgggagagatgtaggtaagaaagcagagatttgtccagaaattaaaacttactgtcagccttcttcaaaccaacctcagaggttacacggcttttgactttgtaccacttaggaacttgaaaggcaccttagaaacagaacttagcttggcttgtgtgcctgtatatgatacttgatgttgctacctggctgacaggcctgcaccaagtgggaagcataaggcacgtgaactctgatagttctgtcttcctgcacttctactgctttgcctgcaggtctttgggcttcagggacaaattacattctttgattgctaagtatctattcatatttctgacttaaataagcagctatttcctatgcctatctcaaacatgtgctttttgtaaaattagaagagtccgcagctctttctgcatgtcttcactgtgataaatactactatgctatccttgagctgtgagtatcaatttgtgagctttcagaggcttgcctctttctgtagagatactgttatcagatgatcacccaaatacattagaaaaatgccctgtactctgagattcaggacatagaaattagataggccatctttggaatccacttcgggaagtgtatgtaaagagatctccagggactgccatcaatttgcctatacttctgaagattttcttttaaattccagattagaaaaaaaatcaggctgaagtaccagctccatttagtaatttctgatctctacaaacagaattttatctatagggggaagtactgtaatactttccatttagtattatctgccaaggatgacttgatctatccttgaaaacagcccaggacagaatgtgtagacatgcagagataaggaggctcctgccaggccttgggctccaggagtctcagctcagctctggcccaggcgtctttcctctgcagtgcacttaccttaccccgcctggatattatagaggaagcattctgcttttctgaggacacctctattcctagttctttgacagcttaacttgccatatcccctcagttttatgtgcaaaagaatataaaggaaggtgatgaaatgagaaaacctggagtggagttgccacagtggagaagaaacgctttttgcagaaacgccttgtttagtccgcagtcatgacgaggttttggaggaccatgtaggtacagcataaagggcgtcttagtacatagggaagagaggagaacatgcaatgtaaaatatcggttagcagtaaggataaagatgggcgggagaaaaaacacagttctgtctcttaaataattctaagcttgtggttcttctttagaacccttaactttataaagaagtattaatttaggccacatggcaaatcgtataacttactttgaaactcattgtgttaatgagataaaaaaaaaaaaagaagaaagtggcttattataaaggatcaagtttgtacaactatttctaaaaattgagaaaaagggaacagtaaaaaatgtatactttactttctttgacactacactgtaaaggaaaattttatctccatcgcttaaaattatatagttctttttgggtcatctctgtgtcacaattttttaaattaaactgaatcatatgtcttttactctaacttcatacttatagacataatttttcaatttgtttttttctataaaaatgcatcaatttaaaaaatagtggataattcaatttgtcttttcattttcagttggaaattaatctgtttggctttaggctatgtaacacctctcattagacggactacacgtagatacatgagcgtttcaaatacagaaagcactgagattttcacataatactgagatcacaatcagagctgctgattgtatcatgttaggtcttttgagagagagaatgaaccaactgagcaaatgactgagttacaccagtgatgtaccccagcactcgagaggcagagacaggcggatttctgagttcgaggccagcctggtctacaaagtgagtcccaggacagccagggctgtacagagagccctgtctcgaaaccccacccccacacaccaaaaaaaaaaaaaagagtatttatacacaaagagaaacaggtctttatacaatactggaatttgaatttgttgtaatcttgagtatattgtcaggcagtcatggtgctatccacaactgaaaaatgaacgatgcgcccaggtacaatttcaaccaatcgacagtattttcacaaaataactgtatattgaagaaagatgtatcgttaaattcaattggtgccaatttagaggcctttgacttcacattgttttgtgaaagcttcaaagattatataccattatgataaaaaagaagtttaaacaacaaatttattaaattgaattttattcaagtgaatttttacaaatgagcatcgctgtattttacgtaatagaacaactgcattattatttccacttttcgggtgagaatatcagaggttagggtactgtcatttaactgagtttgccaaactcaggactgtgacaggagaggataggagtgttcgttgtcctaacacgtctctacaggtggtttacatcttcctggtgtcttctaaagtcacactaccctattaggctgttaagtaaatgcccacctccttgcttctgtaacaactcacccctggcctgctgttctatagcattttctccatagaggttcactacctaaatcatcagtgtttgtttgagctcctgtattgacacttgttgctggagtgtataagcttctctgttacattcccagtgatgtctctggcattgagctatcatgattcatctctctctctctctctctatctctctctctctctctctctctgactaacaaacagacatttttctatatttttaagagccatgagtttggcccatgcaagatgacaatgaagctagaatttgattttgtttttaaatataatccaagctcaagcctcgtttaaaatttgctatcagagtgtactaaatgtgtgacagcgatgagccttccccaaatcgatggctgagagctggaactccatcctcctggaagaggcctgttgcaccttaatctcatttctgaagtttgctgccacccttgcctgatccccctatccctgacaagcgttctctagtgctaaatctgtgtgctacacagccctggcatgttttgcagtgtggagagtctggttgtcctggagtcttgcacagataaaggaaggatacagttgggagaggaatgcactgactacaaagtgcatcctgaaggccatttagctcacaatgaaggtctgtgttttaaaatagctctataacaaagtaactacagagtgctggcaagggctccaactatttatagaactgagtaaggcgtggtaaataccgccacggtacccagttctcccttgccacaaccccaaacttataagaagcactgtaattatatttttctacttgggaaaaaaaaatcatagtagccattatcagtttaaccatacggaagcttgggctgagatttcttttttaaatgcatagttttgagtttcaacagctgtgctgggtctttaatcatatattatctttatgaagcctttttctaacatatgttaattggctgttttctgtgacaaattatgagctcttactttgatgaggttcaattgcaatcatgttggagtcgagtacgtcaagtttccacccctgctggctcctcaaaccactacaaacatccgcacgtcactgcagtgctgagtaatggcaggattggagctggttgattttgctacagattttttttccacaggatattttcagcttctttgtactaaatctgttgcagggtttgccctttttagcagacacatgctctaaaattaacatcaaatcttattggagattactataatacagtgaggaatatttcataatacaacatcccagcgtctgctttgctttactgagatttcagaacatttcttccacattttaagtcagtcacttgtaaatctgactagtactttctacatgaacagcatgttgcagcagacattttgaatgttcctctttgagggaagcgagttatctgagaggatgatgaggtagaaaggccaatgttataaagacattggaagtaagtgtttctctaggtgttgacaaatacgttggaatgttagaaattttgttgttcattatattctttttcctcttcaatattacattatcagtcaggtaatgaaaacaagacgtgttcatcgaggttaacatcctagaagatgtataacagccttttcagctttctgtcctactgtcaatgtttaatgtatgattcagatgaacagaaatgttctactccatctgctctgatagctgtgacagatagcttgtatcaaataccaacagatgatcagtgagagctataattagaacagatacaaaaacgcagtgtgtttgtgtataatcatgggaaattagtcaaggtaattgattaaggtcttcagtgcctgcgtcaaacatcagtagtattgggattcatttaagtgttttctgcctcaacatgtcatgtaaggggctctagataaactgcagttcttcaaaccaaagccagaggtcgatttccatataggcatcaggagtttagataagatgagccagatgttaacagagccaaatgtgactaggcactgctctcctcgggaggctgtttttaatcagctatttccctggggtaatacacagccaatgagctctaattcctgaggctacctgctactgcctgggaacgtcagtacgaggcttacactgagcatttgtgaaaaaaattagagaagaaattaagggtaggggaggttaacttcagaagtgattgctattgcttaaaaaaaaaaaacagtaaaatttgctacttttaaatgcttttaaatgattaaaaatagagtcagtcccaacttgcaaatacagatgcaagtgaaaagctataattggttaatattagttagacttgtataaagatggatattattttgagaatgtgaatggagagccatcttcagcacaagtaagtaatctcaaaatgtctttgtcattagcgctatcacaccaagggaggttgggtttgcaagccctgtgtggtcctgcaacagtgggactgcaaagtcaatccacacactccatcttgagccaacttacacacagaaatttagttccacttgataagacacatacttaattggctttaagaaaataaaccatggtaaagaacaatgtgtaaatgaaacagagcttggctgttaggaagcccgtgagccatgtggcttaattggggccagttgggatcatttaatgattgctgtcagaagatcagatttaatagaagaccacagtggggtacagttaaacaaattgtcatcgggcacttcagatgagccagaccttaattaagttgattagaatgctgtaaaggagatgaagagacagagaaaaattgatgaatcactaaattccacattgagcgatatataatattaccacaaatatcatctatattttacaggacctttatggaagtttgaaaaccatacatattagcctgtaaactttaacaattgtctaaggtttaattacaaattaaaattaggtgacattcagtttaaataccagatgatttaccaagtacttaacaacaagaacatgcactaaaaaatagtgtgacttccctttgtaaggtcatctttaagtgctgaacaatttgagaaagtaagtaacaggaatagcaaattattttaaggacataattttgattatttaacgtaagggaatatgatcttcacttagaatatcttgttaaccactcatgtctattatttactggttatttactgacgaggttactcaggtgttttaaaatgcactcactgttttatctgcatcttctaaaagacaaacttgtgttcttccacatgctacacggacacacacacacacacacacacgaataccaataaatctgaaaagtgtgcctaacatacaagctcacaagaagaaaacatttatagggtatttccatcttaagcattaaatatactaggctaaagactgagaaaaataattttttaaaagaacataatacgctttggaattttatttttaccctaataagacaaaactgtacgttagcaatgtgtgtcacttcgagctgaccttacttgggaagctgacaattcaggcttgctgctgggaaagcatagtgctccacttgctttgttcagtaacagcagcaaacactccaactgcatgtgcttatcagtggttacagctggaacacagaacctcatgtgtgatgatccatagtagctctccctttgtgctaaatacaaaccagctttaccttcatgggaaaccttacactgccctaactggtcccagcaaacgtgtggcggcaagggctgggtgcgtttataagaacaaagacgtgatagaagcctgcatcatctatatagcctgatatagaaatcctgaaatctgtcgtgccgttgaggagtatgaggcttttgacacatttagaccatttggagtttattttggcttggagaatgcaggatgccgttttaactacagtggggggaaaatgtccaaggcagactatggcatgggtaactgtgacagggaatctgtgattccttatgtttgtcaaattgtttgtaatgctgtgcagttgtctggaggtatgttgctcctaaattctcgagttgtgtaaatacagtgatttatttaaaagacagtggcaggttaagcccacttattaaattaattgcaagggttttcaaaatgagctccattttagccttattatatttctgacatacatttcatctccttttgtccttggggaaagatactaaagtaggactagaaacactcacatagagtttccagcagctgtggtcactgggaaattgatgtatttccctagtcatttcttctcttgcagcctgaagctcttctctagctggtacttatgagaaagtccttaatttgtatgacatgttccttcatctaatgcttattgttaacaatgtaagtgaggtctccatgttgtctatatagggatgacatcgttactaactttactccataacgtatacatgaaagccaacatacaagtgtaggcaatccacattcctggcaccaccatacacggtaccattcctgtagtatcatatgtaatgaggctataaccatctgtctttcaaatgcaaacatgtttccagtttcaggtaggaaaccaaaagtctaagtgagaggtttgatcatcaggctacagttacctgaagtacccatttcttaatgcatagactcattcagctttcacttctgtgtggattatttttattctaccaacaagatactgtataccatggtaaaggattaacctaggttaccaagttgtttctgtataagcaaaatgtgagaaaaaaaagtccttagtactaattattaaaaatagctaataaatacctaagatgagatattcaagccttgacaaaaagtgttcagttaaccaactggtaattattagtcccactgtttacctgattgatgccaggatagatcctggcactagaggcatttgattccccccaccccatggtgagtgctataaaggagagggacttagagctttgagaattgtctaggggaagtgcttctgagacagaaggaagaagttgagcacacagaagggagaaaacattccagacagaaggaattgcatatgcaaatgccctgtggtaggaagaaggacaatggagtaagaattttttaagcaattctatttgctttttgcctgtataacactagggtactgagacttgaaggttattcaggatctatcatattgatactaaactcaatcaattgggaaatgctcttcacagcggtatttatctagagaaagggactagcccttttatgttctcaggatgagcctcagctatgtgacttagaagccgaatgcactctattctgtaaaaatatatgataaacttagagaaaaatgaaaatgtgattttttaagaccaggaaactatttctcatcacacaggcaagcactgctaagaataataattgggttatttcatttgaagctcttaagggaaaataggtatgttctgctagttctttttaaccaaagtataattgcacgcctcatatgtctttcaaacaaaccataaagtagaaagtttaatgcatctaaatgcaagtaatgagcaaagctttcccttgaaaggtagtgaatagctgaatcacttgactcggtgacaaacacaggcattcagagacagggcacatatcactttggcctttggctgtacatgggactttcatttatttaataatactatttcttgggtgatacagtatacctaatttgcaggcttgagtttaacaaaacaaggttttctgaggatgctcatgatgatgcaaatgtgagccagaggaaacattatttgccaatccagataaaagaaataattctctccttgcagattggcattatacattctaatgcttaaacctctttgggctgtttttatttaagtgactgtcctgtgctcattgaaacaaaatacatgccttacaaaggtaattttagcagcagagaattaatttcttcccacatcttttaatgtggcatgggagtctcaatctacgatcaaaacatgtaactggaggttatgtttaatttctaaatcaaagtgttgtgggaagacgattgaaatttgtggaggactcagacctcgttgctatgtggttttcttccagaaactttagggtagacttccattaccatgtgagaggagccaagcgtcggtgacgagatgaaaatagtttcaccatcgactgaaagttttcattagttactttgatttataattgaaattttaaggagccccaagggccccgataacaagaattatttcctcactactcgatcttttctttgcaatgtgagatgaaatatgtaatcgatgtatatgactaacaaatatttgtttactgctgtcatgattaagttctctcccagaagttataattcacttgttttctttgtacagaaatcttcatttgcttcagaaagtaaattcagtatatatggtgccattttctggataatgtaatttttggtaaggcatggtagatgatgagggagcggtttctgctgtttcacccaagtccatttcggatctgtttaatttctcatatttacaccttaaggtgatcataacaaaccattaacccagaaccagaatggccttttctcaggtgtttggaagacagaaatgagaaaatgtgtgcctcccatctgccttttcctcgctgccctttatctgaaccagcactccagggcctgtgtgtggggtgtgctgccgagcacactcagcctgctctactcagagaaggaagtggagagttttggttcccattttacacttgtggagcagtttagggaaggaagcacctttacaccttttattgttcgcggttgctgacatcatatccttccctggccagtctgtgcgtgtttcctgccattctgtcaagattcttctgttactaggagggatttgctgaagggaaggagggccagaaagagtgggaggaggaagggaggggaggtgtgtgtcaatcaaactcgcttgtttgtaaatgagggatccctcaggagaatggtctttagctgtccccaagacattcttctctgagcaggtctcagaacactttgccttcgtctgtctgtcggcttatgccaaactcaaagtgaacagaagcctgccatactgaagttccccttttagtcagcagactgactttagttttttatttaagttggcaaaggaagaaaaagtgcagacgactctaactccgtacagtgttctttttcttcccttcgtgttcaaagttttgattgtttacatgtagctgtcattttccaagaatggttccttcatgtgagaactgtagtatccagacgaagcctgtggttgattgtacataatgaaagttctcagtctgactgagcactactatatgtagtttaattactaataatcttttctttcacatgcctgcaaaaccaccgaataggttactacagtaataataatctctttctctagccctcctgaaaataatacttgaaacaaaccatagagtatagtttatgtataaaaattaggttaataaatatttatactaaaaagcagaaattaagcaaaagttatgcaccggtggtgaccttcctaattctttgcatttttcctgatggccttgaaatgtgaggacaccattgatctgttgctattctatttgtgtggactttatacaagtctacattttatgaatttcaggaggcaacacttcagttactgaattgagcattgtccttgtgcggaaaacaaaataaaagtcgaattaggtttaaatttccatctctctccactacctggccatatttcaaagcggagactattttcaatgatatttccagggatcatttcatgtgtgtgttcatatttgcacatacatgcatgctaatatatttgcatatgtagttctaaattttttttcctcattgtgttttaagaattaaaaaaacaaacactttccttggcttcttctaagcacagtgtctggtttcaaagttcaaaaatgccagatggtgattgaaggggctcctttgctttcagaggccaggagctcttgttctctaacgatactcttcttcaggggtgtctccctacttgctttgttacaagtattttgaatcaaggtctgtagacagtgacctcctccctgctgagccactatgctctaatctgttcaccctgaccttccacccaaagtgagtaagcgcttaggcaggcatagtccggtaagccgatagtgccacaggtctcagctaagagaaaggaagggaagatgctcccatatactttgacttgagattcatggattgtttttgtttgtttgtttgtttgttttttgtggtggagaaagccttcttgtctcattggggtattacaaatgcatgggaaatacaagtctgggctgctgcttgcttcttgggtaagactatagtaaatgcagaaaagattcccacttgtatgctgtttaagaccatttctaagactaaatgggtagactatttaacaatgttggatacatcatgtgtgtgctttgcaaattctttatctatatgatcttggtgtctttatagtagtgtctttgccttgtgagtgtcttagtgtgtgttgttcatataacttaaaaactttgagactgctgctaacattgaaaactgtggctggagtcgtaatctttgacaagcacgtcgtaatcatggtgaaactcacacgtggatgccgtgaggccaaactgagctgcagtttaggagaaggacattgggtaaaggagagtggatagtcttagtgattaagcagtgcttaatccaccagaactaattatatcataataacctctgcaattagacaattacctaaacttatatttttaaaaatttactcaaggtaacaaagaataaagaaattgaaagtcagctgaaggtcagaccaagtatctaacagctttttctgttccaagaaccttgaactagagccaaataatctattaagtagtcaggacagtggcttagcgttacataatacatgtgggaatttttcaggtccactgtcagagactaacccgagtcaagagggaaattctgagcagtgtgtgaagtagttatatcctctgacataagagagacaaaataattgaagccgctgcttgcaaatgaaacaagcctgtggaaggcttcctacctagttaagttccaattcatagcaattcactttcattatgtgcaaatatttttagatataattttaaacagagtaaaatatagacttttaatattctgtgctctatgggtttgccatgtaattgataatcattattttaattttaattcatgacctagagctctctggtatataatatcaaggttctgtaattttgtgtctgactccctaaggagatatgatatgtctcttttaaacatttaaatttagagggctgtggtctattattaaaaagcatatagttacaaatgagataataaccttagcttttttgcaccacgtatttcttaccagtgaccgtcattcgcgaggattgttctaatgaagagtttaagagcttcaggaggaagtgctctcactgctaagcgatgcttaaacataagaggaaacaccccatattacttttcctgtgctccctggcagtgatcttcgtaaaataagattaaaggatttagttttaaattagttgacatttacatatatcaaagagcacttccataatcgtccatcttatttgcataactaggggcgttatcacctctgctgtcaaaacacgagattgttttccattcagaaatgaattagatgccctacttagcatacacaggtatataaaggttcattaactctctgatttgggtaatttttcataacagaagggtgaaaattgtcacctaatttcattaaaacatattaagaagctctttacaaaaatacagttcatttcaagtgttgggttttaaaacacagttttcatcatttaaatgacttcttaaattacttataagttattttaattataaaagcaaagtgccctgtgcagtaagctccagtgtgcgatgtgccatgtgctctgagaaagagttatttttactcattttattgttttgtgaagtttatttccctgatgaacctaggaaactggcttgctgcggaagaattgtttaatgtttcgtttttgttcagcaggaacgaatgcagggatttgggaactgagctgtgcgcgtgctgaagaaggaaacgtgtttgaaggaaacaggaaagagaaagaaaaggaaggaaaaaatacataatttcagggacgagagagagaagaaacacggggactatggggagaaaaaagattcagattacgaggataatggatgagcgtaacagacaggtgagtgtggcacatcccttcatatctgttccacacatacgttcaaggcactaaaatcatgctggactctgtgagctcaatgtatccagtttaactgttgattttcatctctttgggacacagcagggaagagaactttaactgttagaaatatgttttaaagattcctgattcctcactttccactgcctcgagacctttaagtggaagctgtatttgtatgacatgaatagcttaataattaggagttaataagcgtagaattgctacactgcacgcatcatcaaacaaagataggcttacatgcatgggaactgggccttttgtggtcatccacttaaaagtttataatatagcttaaatatcctctctctgagaaggggccagctttcttctcatcacaaaggagagtttgaagtaaagccaaacatttccagactctcctgacaacagcagaacttttacatgagctagcagttgtgtaaaacatagagagaagaacttcctgttaacatgtgttttctcttattcctgaattttataaacctggtactatcttttcttttctacacctccagtgataatgtctgtaagacagaaccagttttgaagacttcaaatatcaaatgttccatcctgtgctatgaacctccattatgcattatgagttcctacagtctgagtcactgtctttattctggaaagagtagtctggctatgtgagggtgactagcaggtttagacacatctttctgttgaatatcaggtgtcgatccttaaaaggaatcagtctacctgggtacacacagtggcatgcagacaatggaacctgttccttggccctaagagaggacagactcccactctaacctatttatggtccagaatattaaatatagctttggaaatagttccccacactctaagtctccaaaataaagacactcaccttctatttagtccctgcttacccttgtgtgacatgagaatagattccatttaaaacacaaatgctttcacactcataaattagaatgaataggaattgttgtttgtttcattatgtttactgatggctctttacaaaaagccagtgagcttttaagaactaagatttgcctggttttgttttttaagattatacgttttcagaaatgagtgtatttcacaggacttgaattgctttgagcttaattttgagttaaaggatgaaaaatataagattcatgagggattccactattttcattcatgtatagctgggatcttaaattaagactgaaatattgaacatcacttacattgcctatgggggcattgctgttggaaacaatctttttgggttggggtataaaaatagatgaattatcatttctaatttaatattaatctattttttagcttcgtgagattcattatatctttttttttacttataaagacagaagaaaaactatgggggttgaattgtgtggactttgctgtgctttttaaggaaacaaagcatctatagagatacaagatttgtcacatcatactcttgagagagcaagtttaaaagtttgcatgtagttgtcttgatctatgcttgtagatactcttacctgtattaaaaggtcacaataattttaagaagtggagaaagtatttaaattcagcttatgttgaccttttaaaaagtactaaggatcatttcctttattatataggatgtagagccaatttattatttttctcagtctgtgtgtacagtaggctttttaattcaataccattgaagaaaattagtaacaataatattactgtggttgaagctatgcttcagtggttgtccaagatgactattgactattttaaagagctgtcatttatgataatgtttgtcttgcttacctctcattttctgtgcaaatggtccaaagaaccacttggataagagaatgaagtatataggtcacttctgataatcaaaaccagcgagtgtgtgggggagctcctaacctgggcatcctttaaattatgtgttcacatgttgaaaagaggaatgtcagcagcttagctctttctgaagctgcctgactggggtggcctagtaggacctcacacagaggctagctgccgtttcttcttggaagcagtgaacacagttttttttttttctgcctttgcatttgtgtatttgaccacatacagaataatgtgggcctatgaagaaaaagaaatgctaacccaaagtaagccccgaaatagcatagaacttattaacacattgtgtttcagaaagataactcatctgaagacagaatagtcatttatacacagttctaccttcattgtctcgtttataacaaggaaacaatggctaaagctccattagaaacataaagtagtgtaatacagataaaatttcacatatttttactttacattttttcagtttctacttttataaagccaatttcttagtcttcattaagtttaagttaatatgtacaacaaactcaggaattgtcattttatcttacagatacactcagacagcttgttgaaagtcattaccaactattttccaatgatggcatgtaaattattccatttaatccttaaaataggattctattttatagttagaggttatttatttattaaatcaacaagtattatttgactgtaccctgcccaaaagaaaatccttcctagtgaatagcagtctcattcatggatgagcgaagtgttctgtaaaccaccaggtagcaaatactgtttgcattgtggtgtctgactcagctgtggagctcttcataggtgctctggatgcagccagagacagtagatatgtatctatattcagtaagaaagctttactgacaaaacaaatatgcattacaattgtctagtggaccacaatttatagacttctggtggactgaaatagacaagaactatggaaatacagaacaaaaatgtcatttatggcctgagaatgaaactatcaaagcactatgaaagaacagccagggggtgctgtatttaccactcaagcttggagaatgacctcgccaagcaggtaaaaatatgggaaccacagcattctagaggaaacagagtttccaaggcttgagatagaaaaaagcttggctgaagattcagaacacacttaagatttgagcctggtgtgtggctttagagttataaaagactccacatcgtgttgaacaacatcctaaaacgcttagagagtctgcttcacttaagagtaactggtcaagatcttacagcaaagggtaaaaaaatgccaaagatctagtctagtctcaaattactccttttcaaaacaaaaacatgcttctttcaatgatgctatgctgcacctagcataatttaatggctaaaagacctagaatttacttcatctccttttccagtcgtttcctattggaacccataagagatagataagagttcactttttagagatatataaacctatttatagttccagctctatatgttaccttggcttaatacatactgtagtacattacactacactaaaacagtataactcttcagcaacttatttaacctctctgaacctcattggtagagtgaagattaaaaatagtcacacacacacacacacacacannnnnnnnnnnnnnnnnnnnaggaaacagagtttcccaaggcttgagatagaaaaaagcttggctgaagattcagaacacacttaagatttgagcctggtgtgtggctttagagttataaaagactccacatcgtgttgaacaacatcctaaaacgcttagagagtctgcttcacttaagagtaactggtcaagatcttacagcaaagggtaaaaaaatgccaaagatctagtctagtctcaaattactccttttcaaaacaaaaacatgcttctttcaatgatgctatgctgcacctagcataatttaatggctaaaagacctagaatttacttcatctccttttccagtcgtttcctattggaacccataagagatagataagagttcactttttagagatatataaacctatttatagttccagctctatatgttaccttggcttaatacatactgtagtacattacactacactaaaacagtataactcttcagcaacttatttaacctctctgaacctcattggtagagtgaagattaaaaatagtcacacacacacacacacacacacatgcccattacagtgctaagatatgaagccatgtatatgaagtgcccaggatgtaagtgctcagtgaatgcccagatcagcttctccagttgcaaaccacactcttggagccattgtatcttatagtcactgtgatttctagcaaaagttgttggcctttcactttgaggagttctaccataaaagaatgtcaggagggggtggcacagagtagagcaggaacacaaagaagctcccttgctgagaatcatcatccagaacagtgctgctgcagaaagggtggcctgtgggcagggaaggaagagcacacacgagacatgagcaatgcacgccttgcgacagggaggttggaaagagagtcctaggtcctgtgcatgtgggattgttttcaaatgtatgttactgaccaaattatttttaaaatacttttcatcattttatcacttctacctccaagcttatggtaactaatatttcaatctccagtctctccatcttcttgtttccttgtttatccttgacccttaaggattaggcaatcatagagtcttggcctttttcatgttttacacattctttagttagtgcttgaaacaattggacttttaattggtttattatatgtttcaattttataaacaagatataattagaagcctgttcgatcaggaagatatatatatatgtatatatattcagaatgctaagtaatcctaaacctattcgctcagatgtttgtactgaatttttcatcttccctactttgaaacagctaagataattaaattccaatatattcatcaacttgatacaaaacaacatctaaataaatgaataactacaagaaggacgtatttgcaggtagtacacttaggatctaggacctaaaacagcacatacactttctatacctacacctacacctgcatctacacctacacttgtacctacacctaagcctacacctagacctacacctgcacctatacatatatatgcctgtagcattcctttgttccttcagatctggctatttgttttttgcccacaaagaaaattctacataattatcaatgtgataacttgaacacaaattaaagacaatcagtaacattccccttttagtcaagagaatcctcttacaaattaaaataattcagagttcatagcaattaaattttctagcattccttcctcttgggtttctagatgtttcttcgcatgtaacaactaaggggaggtctgcagaagtgtgttcactatagatgtcatctctaatagtttgtataccctgaggctttatcagctaaatctgattattttgtgctgaactaaagaataaaaaaaattacaattccctcagatgactcaaaaaaagcttccttttacctatattcagttctttacattttagctcaagttacacaggtattttcagtgcaacttcccttcaagatagtatccagaatttgaacacataaaaaagggccggtcacaattctaaatttggagataatatctaattacttaaataaagtttgatgaagttgtgaccaattcagtcttcaaatgtagaagactagatatttgagaaatgcaaattagttgctttgacaaaataagctcttggtgagttctgtcacctgccatggagagcagagttctgcaggcccattgtcaaaggcacttccttccgcgtcgccagaatcagaatgttcctacacgccagttttagctgagacagtaccactgagctaccttttttgatggaggaatcttgaccctgctacagatctggagaataagagattcaatggaaaaaaaaaatgagttttctgtcttagtcgaaataagtttgtatataacctcataatgttggtcattttatttttttccttaataacatattttaacagattataattttccctgaacttgtacaaaaatcatgttcaggtcattctatataaatgaaatatgggagtatcctagtgttgttaagacacatattgctcagagttgattcaatgctgggaatatctaatggacagctcccctctgcatcttcattcttttactaactagtcttaaagtcctgatggaaagtctttgattagatttgaaattatttattattgaagagattagcaaggaaaaccagaagtagagaaaatggtgtttgttatactttcgaaattatattagtaaaaagaaaatgtaacgtggagttgtcagggtgcttgtgtgtgattaaaaggatgccagttcattttgttttagcaattagaaaaattattgacaaatggtctctgaatcatggagttaacacacagcacacacatatccatcccataggggtgttcttttttctatttatgttagctaaatctgctccctgtgccagaaaagaattgccccaactgttaaacacattcattaggtttcctctgataggaaatccaagagaggttaaaacttgtagaaagggctaactgttcttcattaaagaaataagtgctttctctacatgctcaggttatgttattggctctgttttaatttatgattctgacataatttctattcaaagataaacaacctaaaattggtaaggatattttcctgtatctcaaaacttccaacattgtttgtagaaaacagacagaaaatgccctgtttggctctgtgaacatgtgctcacaacattttccccttcaaatgcacaagcacacatcacatgtgaagtagctttactgaggaccaacagtagggatatgaacattacaagtagaccacataaagtaagaaagttttccatacactgaattaaaagaaacactggtaaatgttttcaaaccttgccctttgcagtcaaaactcccttttgcattatgttattcatttaaaatggaatactttcaaacttatggtgaaagcattattctaaagtttataacccattatactttttgaaaaacatttggaaactatatatttttttccaaacataatagcaagtataaaaaataaaataaataacataattaaatggaggattaaaaattccccatttgcagtgtgtacttgtgtttctcttgaaatatgttagaccattaatgggaataagagaaaccaatttagatgtttggaaattcgacttttaattttaaattggaacagtttagcttaagaaatcactaacatttaaataacatttcaacaaatgtaactgtttggaaactacagctgaggcagcctcctgccttctgtcttgcaaggattgatttggaaggccctgagggagaaaatattggagttgggagctaaaactgaagccactgtgggaaggaagaagttactctcttcctgttatgacaggaaagcgtagacaaatgtgcttcctgagttagctcagcagggaatgtaggattctttgacctttaacttaggtatattttgaccatgttgaactagtaaacatgctttggacttccagatactaatttgttttatcttctccacatgaaattagtatatttagtagatgaaggtgcagaggagcagcctgtaaccacggtagagactgtacttacaagagaagtgagctattttcttctacttctatcatgtttaatatcccaaatagatttttaaaattggttgagtgcatattacttttagtttcagaaggtatcacgtacatttaagaggcatttaactattataagttattttgttgacttgaaaaatgtcaataatgaattgtatattttaaaataaattgtattagtgtgataaaaaagaaagaaagaagaaaagaaagagagaaagaaaggaagaaaggaagaaagggagaaagagagaaagaaagaaagaaagaaagaaaggaaagaaaggaagaaagaaagaaagaaagaaggaaagcagccaatcagacctgaagagcccatacaagtgtgtttaaaatgtcacaggatagaattctcttaaaatgtaaagcattaccaggttttgcaaaggccactcttaaaccttgacaaactaaatgatggacactggcttcccctgtccttacgtaatccaattatcagaaattcacagaaacaacttttaaagcccaaactcttcaatggacactcccttgtctgtgatacaatctcctatttattatccaccctcaaaataccatgcaaagcacacggtttaaatttttgtttagaaattgtgtatgttgacttagggtaagaggctgatagagttctattctctgaggccctcattttaacaagtgtattgtgttgagaaagttagggagcactgcttgcacatcctgtggaaatgctcctgtatttcactgaaacatggctcaatttgctggaggctaaggaggacaatggtttcctttgcagcagaacacactgctgtctcttggtcgcaagttgtgctggagggttacaagcacatggtagcagtctgcttaaaagagcccctcactgctctttaaagagcctttcatttaggatggcaagccccttcattgtataaaggagcgcttgtctagaacaccactctgtagtggcacggcctcctcccactgagagtaatcatcaggcctagcgctcatagcctttctaatgacagactgaattatacaaaagaaaactgaagaggaatactcagaacagttgtgccattgcttactgacaggaacaagggaggcatcctggagcatttagaaggccatttccctttttacaattagagattgttgttacagactcttgactctatccctaaccctttaaacacatgggaagacctagtggctcatggattattacagagcacattgtctccaggagctgctcctcctgtcactccttactccctcatctgcctcaacttagaaaactggagatcatcttggtgaccgaggggtaataacgagactgaggttttaaatactttcaaataaagaagttatgtttgtaattctaggtgtgacagaatggaagaacattgaaaacagagttagttgggtgtattagttccaacatattttaaaacaaatgacaattactttatggattaaaattatggctttaggatccagtcactcaggggtagattgcttaaccatctacagaaacctggttttatgccagttctgggaaaatagaagacaagaataaagagacagaaaaagaaagacacagagatgggtaagggagagggagagagagagagggagagggaggcagggagaaagaaaaagaataggaaagagggagggagagaaagagtggtagagagggagatagagggaggggaagggagagaaggagagaaaagggaggaagagaggggagggaggaagagagaaaaggagaggaagagagaaaatgaggagaaggcaggaggagggaaaatagaatgggagagggtggatgggttaagaatcacaccccttgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatcctcgttagatgcagaaaaagcatttgacaagatccaacacccattcatgataaaagtnnnnnnnnnnnnnnnnnnnnnnnnnnnnnnnnnnnnnnnnnnnnnnnnnnnnnnnnnnnnnnnactaccaccaccaccaccactacaaccaccaccaccaccacaacaacagatgctaaggcagtgatagctgctttgaagcaaagttgcccagactaaaatgtagataacatctgaatagagattatctgggttaatgtgggctgcagtaaaagtactatgtgcactgaaggatagtcagtgagttgagatagctgatccttctcctcacaccaggaaaagcagcattctcaaacagtttggagactctttctgacaccgagacgcgcattttattcgttctcacgtgtagggatgctgagcttttgacaagatgagcaatatggaagaaggagatcttagagtgaacactggagctagggtttggagcttttgatagtcactggagatcattcaatggttttctggaatcaaaggggggaaaaagagaaaagaatggagatctagatttaagagttacaattaagtggcagtaagaagttaactaccctgtgtaagatccattgtgtttaaagaaaataaatgctaaataaaccagtcagacttccaaagtatgagcctcaaaaaatgtatatatttcttaaaataaataaataaataataaataattaagcacatgatactgtcagccattagttggggaagccggttgtaatttaaaaggtttctgagcctttgatacaagagtctgccttactactaaatctgtgagacgctaggacaggtcttggaagtcttttcttggaatgatacagtacataatgcttgcttgcaaacaccagaccatatatgggtttgtagttaatgttgttcatgctgttgggtggattgaccaggacaagctaacatttaaagaacactgaaattgcaagtgtggaatatgttcatttactgcgactggcgagtgaagggcatgcagaactggaaacaggagcttaagggggcagttcctgttggaaaagcgtgtgcacagaataagatgaatagaagagacaatgattccaggcagggagagcatccaggccaggaagctgctgggctgcccggggtgacttgataaggatatgaatggttgggctgcctgggaagtagacaagtgggaacctgacaaatgtgggacttgtaggaaagggattatgggacttggtcatagattagactagaagaaaaatgctcaaaaatagcagttactgaccttagaaaatcagaaacagggagaatgaaaccaaaatcctaacagtaagttccccagtagttcccagtagtccccagtagttccccagtgcccagccaagtttctagagagagagagtaaactggctgagagttgtacccacaagctgcaagggttgtcaaataagtggcacaagagtaaccagttttgtgtgtgtgttgttttaacacagatctaaaatattaggtttataatgccatggctagtcttcaagtaattaaaagacaaatcaaactctagttttataattgggagaactgttaaacatgttgaagttgaagaagctgaaagtttcgaagaaacaagattgtttcttctgtcaccttcatttgaatgccctgaattaaatcttacatctccagtttccctgtctaccactatctagcaaatcacgcattttcaaattgtaggcagaaatcagttcagatcatttgctttgtctttgaatgtgttagcacccaagactctggcagctctacaccattgttttgcaaaggaaaaaatagtagtgtgaatacatacgccacatacgagtacgttttttgtctttaaaaaggtgttcttcttccaggtgacttttacgaagaggaaatttggattgatgaagaaggcttatgagctgagcgtgctgtgcgactgtgagattgcactgatcatcttcaacagcaccaacaagctgttccagtacgccagcactgacatggataaggtgttgctcaagtacaccgagtacaacgagccgcacgagagccggacaaactcagacattgtggaggtgagcaagcacactatgagctttctgctgtgggcccaatacatgcttttcctgcgctcctagtcctgtgcctgtgcttggggcgtttaccccatctatggctgcaacatgctggttactcctcccaaaagaagagtcaaaagtggcaaagtgatgacccatatgggatctagaaatcaaggtccagggtcagatcgatggctgcctcttggacgagtcagcaccatcctcccttgtgtatcaggacctgtgagttgggaattgtgaccaggtgctgtgtcatccatacttacaattcattttaagtgtataaaacagcttctccagcagaatcaaaacattttttcaggtgacctcatttgaaccttattatgtatgtcacctctttctaactcattctctctctctgtctctctgtctctctgtctctctctctctctgtctctctctctctctctctctctctctctctctctgtctctctctctctggaaaagacagctagttataaaaatactgcttttcctcaaaatgatatcattatagcattgaaaactgttaatacacgtgaagtcagatggataaagggccatagaatctcagtgaaccttctaatgtattttcaacatgtgtcctatttaaatggtgctttcttatgagcaatggctcccccactaaaaggaaaagagaaattttctctctgcctcatttttgcatttcctgtcctttcttgggacaagtagtagatttgcactgactttcccagagctggaagagaataaatggttcagaatcatgaagtccacagttggatttccagagcccagaccattctcacagatagacctctgtccaaagggtccaaccctaattccaagcaaatacacaaactcctacaaacccttctttttattacaccctctctcataattaattatttaagacaaattctgatttctttccttttatttgaagtttttgaaggcatcgcaattattggttttaaattttcattctgtcactttgcctaataagaacaaacaaacaatttcagttaaaagtcacagcatgtcatgtttgcttatgttggctagtagtctgtgccatgcacttgatgggatcctcaaacttaagactggtaatacaatttacctgccctttaggaaaggtcttttcatgaccacatattgaaaatgctaaaccaaacatgaaggaactagttagttgtgacgcttcaagggcttttgtgtgtgggtactgtatgcttcaaaccttatctcataccacagctataacaacaaatatgccagataacaaactaaattaaaatctgattgcacttgatgtccttggactatatagtccttcatatgctctgaaacaatagagctatattagaggaattagaaaattatgtttacttttaagttttgctttcaaggtttaaaatcttgaagatttatatatggagttctgcagaggagggtgctttatgtacttaaggtgacttcaaatttcaccgtctatatgatatttttannnnnnnnnnnnnnnnnnnnatccagtcctcaggggtagattgcttaaccatctacagaaacctggttttatgccagttctgggaaaatagaagacaagtaataaagagacagaaaaagaaagacacagagatgggtaagggagagggagagagagagagggagagggaggcagggagaaagaaaaagaataggaaagagggagggagagaaagagtggtagagagggagatagagggaggggaagggagagaaggagagaaaagggaggaagagaggggagggaggaagagagaaaaggagaggaagagagaaaatgaggagaaggcaggaggagggaaaatagaatgggagagggtggatgggttaagaatcacacccctctattcattgaatacaaaaccatttctttagaattaggcctcaaatactgtggtttcagactctaaacaaaattaacgaggcttctcttaaaggtagtctgaaatcttcaagggtttggtcttcgtgttcttagtggtgtagtagctactgtttggaaggctcgtcaccttaatttctttagatttttttccagtagggtacagggattcccattgttaatacagaggtaggttcttcaggggtggctaggaatgtaaagaatatggagcaagggtattgaggaaaacggattccaaaatacccttttgtgacccagtaagccaaactaatttcccttcctccaaagcaactacacagaaaatcctgtgctggggttttaaaatgtgctgttggaactgcctgtgtagcaatgtctgtgtggaaatcggagttccattctttttattctcgctgtgagcagacctgtgtctgctgccagccaaagtacttcccattttgggaaactgaaacatctataaatacagaaataatccgtgactactcatgcctgtgtgtggttctcaccagctttcgtgggaatggcttgagtgtctgtctaagggtagccggggctacagaaccacacaaaagcatccctggtttgttggtggaaatagaaaccactggctctcaaatgaatcttggtagcattattttattttctttaaccctaaaagctacctttacctaaattaatgctctcccttagggtgctgttctcgggaaaagggtcaggtggctacaaaagcaaacaaaaaaagtcaatgtacacctcagctaacactggcctgtacctgagccatggaagcgtctgctcagggcttagtaac

SEQ ID NO: 1350 - DNA, 2432 bp, Mus musculus
aaaagcttcggtgttcatagaaaaggagaggaggcgagcgcagcccaaactggggggtttctcttcaaagccagctggtctggctttattctacaggaatttttttacctgtcagagtttggacaacaaagccctcagcaggtgctgacgggaacaacttcctggagaagcagaaaggcactggtgccaacaaaagcattgaaaactgtgaagtaacctctggagagatgaagtgaagcgtggaaggccaatggctgtggcagtgaagaagtgcagagggaacgaatgcagggatttgggaactgagctgtgcgcgtgctgaagaaggaaacgtgtttgaaggaaacaggaaagagaaagaaaaggaaggaaaaaatacataatttcagggacgagagagagaagaaacacggggactatggggagaaaaaagattcagattacgaggataatggatgagcgtaacagacaggtgacttttacgaagaggaaatttggattgatgaagaaggcttatgagctgagcgtgctgtgcgactgtgagattgcactgatcatcttcaacagcaccaacaagctgttccagtacgccagcactgacatggataaggtgttgctcaagtacaccgagtacaacgagccgcacgagagccggacaaactcagacattgtggaggcattgaacaagaaagaaaacaaaggctctgaaagccccgatcctgactcctcttatgcactcaccccacgcactgaagaaaaatacaaaaaaattaatgaagaatttgataatatgatcaagagtcataaaattcctgctgttccacctcccagctttgagatgccagttaccatcccagtgtccagccataacagtttggtgtacagcaatcctgtcagcacactgggaaaccccaatcttctgccactggcccacccgtctctgcagaggaatagtatgtctcctggtgtaacacatagacctccaagtgcaggtaacacaggcggtctgatgggcggagatctgacatccggtgcaggcaccagcgcagggaatggatacggcaacccccggaactcaccaggcctgctggtctcacctggtaacctgaacaagaatatacaagccaaatctcctccccctatgaatctaggaatgaataatcgtaagccagatctccgcgttcttatcccacctggcagcaagaacacgatgccatcagtgaatcaaaggataaataactcccagtcggctcagtcattggctaccccggtggtttccgtagcaactcctactttaccaggacaaggaatgggaggatatccatcagccatttcaacaacatatggtactgagtactctctgagtagcgcagatctgtcatctctgtctggcttcaacactgccagtgcgctccacctcggctctgtaactggctggcagcagcagcacctacataacatgccgccatctgccctcagtcagttgggagaccgtaccaccaccccttcgagatacccacaacacaccacgcgccacgaggcggggaggtctcctgttgacagcttgagcagctgtagcagttcctacgatgggagcgaccgagaggatcaccggaacgaattccactcccccattggactcaccagaccttcgccggacgaaagggaaagtccttcagtcaagcgcatgcgactctctgaaggatgggcaacatgatcacattattacttaatagtttttttttttcttgcagtgtgtgtgtgtgctataccttaatggggaagggggggtcgatatgcattatatgtgccgtgtgtggaaaaaaaaaaaaaaaagtcaggtactctgttttgtaaaagtacttttaaattgcctcagtgatacagtataaagataaacagaaatgctgagatacgcttagcacttgagttgtacaacagaacacttgtacaaaatagattttaaggctaacttcttttcactgttgtgaccctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagaggtttggacagacccggcaagtggtgactaccggtaattgtaggaacacgcctgtcacctaacatccaagcacgctcacaaacctgcaggcatatcattggcgtatggcactcattcaaaaggatcagaaaccattcagagaggaccatacctaccttaaaagaaaagagaagaaaggaaaggaaaggaaagggaaaaaaaagtgtggcgtttgagagctaacatatttaattaaataaataaatctgggtctgcatctcttattaaataaaaatataaaaatatgg

SEQ ID NO: 1351 - DNA, 1299 bp, Mus musculus
atggggagaaaaaagattcagattacgaggataatggatgagcgtaacagacaggtgacttttacgaagaggaaatttggattgatgaagaaggcttatgagctgagcgtgctgtgcgactgtgagattgcactgatcatcttcaacagcaccaacaagctgttccagtacgccagcactgacatggataaggtgttgctcaagtacaccgagtacaacgagccgcacgagagccggacaaactcagacattgtggaggcattgaacaagaaagaaaacaaaggctctgaaagccccgatcctgactcctcttatgcactcaccccacgcactgaagaaaaatacaaaaaaattaatgaagaatttgataatatgatcaagagtcataaaattcctgctgttccacctcccagctttgagatgccagttaccatcccagtgtccagccataacagtttggtgtacagcaatcctgtcagcacactgggaaaccccaatcttctgccactggcccacccgtctctgcagaggaatagtatgtctcctggtgtaacacatagacctccaagtgcaggtaacacaggcggtctgatgggcggagatctgacatccggtgcaggcaccagcgcagggaatggatacggcaacccccggaactcaccaggcctgctggtctcacctggtaacctgaacaagaatatacaagccaaatctcctccccctatgaatctaggaatgaataatcgtaagccagatctccgcgttcttatcccacctggcagcaagaacacgatgccatcagtgaatcaaaggataaataactcccagtcggctcagtcattggctaccccggtggtttccgtagcaactcctactttaccaggacaaggaatgggaggatatccatcagccatttcaacaacatatggtactgagtactctctgagtagcgcagatctgtcatctctgtctggcttcaacactgccagtgcgctccacctcggctctgtaactggctggcagcagcagcacctacataacatgccgccatctgccctcagtcagttgggagaccgtaccaccaccccttcgagatacccacaacacaccacgcgccacgaggcggggaggtctcctgttgacagcttgagcagctgtagcagttcctacgatgggagcgaccgagaggatcaccggaacgaattccactcccccattggactcaccagaccttcgccggacgaaagggaaagtccttcagtcaagcgcatgcgactctctgaaggatgggcaacatga

SEQ ID NO: 1352 - DNA, 96596 bp, Homo sapiens
gccacagtacccagttctcccttgccataaccccaaacttataagaagcactataattatatttttctacttaaaaaaaatcgtagtagccattatcagtttaaccatacggaagctcaggctgagatttcttttttaaatgcatagttttgattttcagcagctgcactgggtctttaatcatatattatctttatgaagcctttttctaacatatgttaattggctgttttctgtgacaaattatgagctcttactttgatgaggttcaattgcaatcatgttggagtcgagtacgtagagtttccacccctgctggctcctcaaaccactacaaacatccgcacgtcactacagtgctgagtaatggcaggatttgggctggctgatttctctacagatttttttttccacaggatattttcagcttctttgtactaaatctgttgcagggtttgccctttttagcagaagcatgctctaaaattaacatcaaatcttattggagattactataatacatgagaaatatttcataattcaacatccagtgtctgtactgctttgctaaaattttagtacatttattacacatttttaaaagtcagtcagttgtaaggctggtaagtattttctatatcatcagcattttgtaacaaatattttgaattttcctcttgagagggatacagttattaagtgaatagatgatcaggtatatatttaattatcataaagaaaatgcacataatgtttttcctggcattaccaaatttatcactatgttaaaaattccattgtattttcatttttctttgcagttaacatctgttggttgagtcataagaacaattacatgtcccatcaaggctaatgtcctataagatgcatagcatgtatttcaattctctaacagtttttaatgtatgattaggatgaacagatatgttctaatccatctgctctgagaactgtgacagcctgcatcaagtaccagcagatgatcagtgatagccataattagaatatatataaaaatacagtgtatttgtttatattcacaagaaagtagggtaattgattaaagccttcagaacctgtgtcagacaccagtcatagtgggattaatttaactgtttctgctttgacatcaaaatattctaggtaaactgctgcagttgttcaaaatctaaatctatggatcaaatcttcatacaggtattagactttagaatcagatgagccagatgtgaataggagctactcctcctcatgaggctgtttttaatcagtcatttccctggagtagcacacaatcaatgagctctaaatcctgaggctacctgcgcttgtaggaaggcctgggaacatcattacagaacttacaattgggcatatgtgaaaaaattagagcagaaattaagggtaagaaaggttaacttcagaagtcttactttggtactgcttttttagagggaggtaaagagataatttcaaatgttaaaaaaaaaatagaatattaagcccaacttctaaatgcagagaatttctattaaaagatcattataagcaagccaaataaaagttattattgatttatgttagccagaactgtttaaacacgtgtattatttcgagaatgtacatgtgggtccatttcaggatgagtaaataaatgtaaagattctttttcgctagtacctctgcagctgtatagaatggcttcagaagtcctatgtgatactttggtgtgcagtcaattgacacactgtgtctggagctaatgtacataaggaaatttagttccacttgataagacacatgcttaactggctttaagaaaataaaccaagaacaatgtgtgaatgaaacagagaacttggcacttgactgtatggaagcccatgagccatgtggtttaattggggccagttgggatcatttaatgattgctgtcagaagatcagatttaattctccttataagaagaccacagtgggatagagttaaacaaattgtcatcagaggtttcagatgaacaaagccttaattaggttgattaggatgctgtaaaagagatgaagagaaatagaaaaattgatgaatcactgagttccatgttgagccacatataatagcaatatcatatatattttgagagatagtattatagcattttgaacatcacatatttgagcatgtaaagtttctgtgtaaaccttctaaatgtgaaggtttagagataaaaataaatgacattccacttaaataacagatgatttatctagcattttctctttaatgtacaacaaaaacattggcagggggacaatggtatttcttcccatttcaaggtcatctttaaatgttaagtaaattggaaaataaataatgaaagaagcaaattattttcaaggacataattttcaatcatttaacataatatttgaatgcagagtaaaataaagcttttactgagaacgtccttttaggcattcacaccacgatcttaataatattgtgattatttactggtgataatactcaagacaactcaggtgtcttaaaatgtactcttattgttttatttacacatttcgacagactaaaatgtgtttttccatgtgctgtgcacacatgtgcacacatgcacaaatgtatcagtaagactgaaatatgtgttcaacacttataggcatatgagaaaaatatttttagagtatttccattttaatcgtgaaatatgatatattaaagatgaagaatataacgaacataatttttttctaacagggtcatgagatgcctgggaatttagatgtttttatcataatagcatgaaaatctataatagcaacatctccaacttctagcctagcttgctttacagactattttgtttgactgaggttgatgttgtatagtgcttaacttgctttgttcaataacagcaacaaaaatccagctgcatgtgcttactgagaggttagagctggggaacagaacacaatctgatgttaaattgtagctcttgctttgtcataagacagtgcaggctttacctttgtggtgagccctaccacatcactcagaggcctttgaaagaaaacatggtggctgcactgttgtgaaaaattagaaaaacaaagacatgatagaaccctgaattaattacctaatatgatgtggaaagactaaaagctgtggtagggttggatagcacaaggttcttcacatatttagaccatttggagtttattttggcatgggaatagagaatgctattttagctgcagtgtgaaaaaagtgtccaagacaaaatagaccatggataactatgacagggagactgtgcttccctcacagttattaaattgtttataatgcaatacaattgtataaaggtatgtgtctcctaaattctggaactgtgtaaataaaatgatgtatgtcagggataatggcaggttaggcccacttattaaattaattgcaggggttaagaaaacgagttcctttttagccttattatatttctgacatacatttcatctctttttgtccttggggaaagatattaaagtaggactagaagcattaatgtagagttttcagcagccgtggtcatggggaaaattgatgtatttccctagttatttccacttttgcagcctgaagctcttccgtagctgatatgtaagagaaacttcttaatttttttaacactgtaaatttattcttcatttggtgattattgttacaggataaatgaggcattatctgtcagaattgctaatcattagctttggaaagtgagatcttcctggtaaatgtaaggactacactattcacttgatagcattactatatgataggactttcactttatgccttcaaacggaagcaatcatacgagcagcaggccatgttcccagtactactgtgtacccaggattcacatatagtaccacatgttatgatcataaccatcctacaaatgaagatttttttcccagttatgggtagggcaaggaaacaacagttccaagggattaaataatcagtctggagtcacacagcgtccaagtaccaagctagaattctaaccctgttttttctgaccccaaaatccatttaacttccaattctcagtatcaattattctaattccacataggagatgctatgtaaatatggcgaagtattaagtgaggttatcaatctgcttctgtgtaagcaaaaatagtaaaatatttttagtagtagtcagtaaaagtagaagctgaagaaaagaaaatacgtcagttgagagatacacatcttaactgattgtcagtcaacgaatagtcattagctctttctatatgtttgacactagggtatatattgtggataaaacggtgaaacaaacaaataaaacagatgttgaggaagacaagcaaacatacagtttcaattgctgcgagtgctgcaaaggagaaggactcagtgcttagatcttatgagagggaaattcgatgtcatcaggagggcgtggagtacttcctgaggaggtgaaactgaagctgagacagaagggaggagaagtcaaggaggtacaaaaggaaaggaggaacatccaggcagaaagaattgcctagtacacaaaggcctagtggcaggaaggagcatggcagatgtgaggaaatggaaaagatggtcaacattatttgtatatgtggtactatgttactgagacttgaagatggtttgaaattcatattgatactaaattggaataaattaggaaaataaattggcatatggcatgatggtatttatctagtggaaaagaatagctgttcttttattacccttagaagagtgagtcttgggtatgtgatttggaaataaactcagaatgcactcatagctaaggtaatggtatatttataaaatacatggtaagcttagagagaaatggagcaactttcaaggccaaagaaatcctcctcaactcaagacatcacgcagtcgagcatcaataggagtagtaatttggttataccttttgaagttcagaatagctcctaatggaaaaaaagtaaaagttctgcctgttccttttaaccaaaatataattgcatgcttcatacattttatcaaacaaatcacaaaatagaaacctaaatgtaactagatgtaacatattgagcaaagttttccacttaaaaagataatgaatcatttaattatttgatttagcaatactaggtttgcagcaactgggcttatgatcatttttgccccttacgatgtatccagcttgtatttatttaacagtattatttagtgttgtgtgatagagtgtgctcagttttcagctttgagtttttacaaaacattatttgaggatactagtgttagtgaaaatgtaagtcaatcaaaaagatctgctaatatgaatcaaagaaaaccggaatttttttttgaaaattgacatcacatatttcaatgttttaccattattcataggctgtttttatttaagtgactgcattgtacttattgcagcaaaatacatgctttgcaaagataagtttagcagaagagaattaatttcttcccacatcttttaatgtggcatggcagtttcactctaagatcaaaacacataactgaaggttatgtttaacttctaaatcaaagtgttgtgggaagatgattgaaatctgatgatgactcagatacgcttgatatgtggttttcttcctacagaaaccttatgtagaatgccatttccatgttagaaagaacctaatagtgaggagattaaatagtttcactatagatgcagagtttgtgttattcactttggttcctagtttgaatttttttaaagaacctcgagaaactcaataaccataagaatcttttccccctcagtatatctttttttttttttttaatgtgggagcaaacaaatgattagcatattttaccagcatgcattgattttttttttgccggttttcataattcttttttttaaccaaaagttttaatgtatctattttggttctttgcttgcatatttttcatttgcctcaaagggtaaattccaattatatgactgcattaactgtgtacgatgacttttgtaaggcctggtaaacaataactgagatatatctgctatttcaatgaagtcaatgtgtttgttttcttattttcatttcttaaagcaatcataataaaacactaacctagagctgacatgaatttttctcaggtgttttaaagatggaaattaaaaatcacgctcccggtctgaattgtcctcattgtcccttatctgaacctctccaaggcctctgtgtgtggggtgtgcagcacagcacactcagacggttctgctcagagaaggaagtggagagttttggttcccattttacacttctggaacagtttagggaaggaagcacctttacaccttttattgttcgtggttgctgacatcatatccttccctgaccagtctgtgtgcgtgtttcctgccattctgtcaaaattcttctgtgctactgggagagatttgtaggagggaaggagggaggaagagggcaagaaagagtgagggagggaggagggaaatggaggggggaggtatgtgtcactcaagggaacttgtttgtaaatgagatagcccagtgggagaatgatctttagcatctgtccagaagaaattcttctcgacttgggtctcaaaccactttgccttcatctgcctgcttatgccaaactcaaaatgagcagaagcctgccataatgaagttcccctttttagtaagcagcctcattttagttttcttttatctgggttggcattttttctttagaaaaaaaaaatgcagaagactgtaattctatagagtgtaactatagtagagcagttcttcatctttttttttttaaattagtgattatttatatgtagctctgtcattttctaagaatgcttctttcctgtggaaaaaaagtagtggcaaggctgttggaattattttaagcttatggttgattgtacgtaatgaaagttctcagcataacttgaaattttactacatgtaggctagctgttatattcctttttcatatacacacaaaacagttttacagattactaaagttaaataatctctttcttcgcctctctaggcctcctacaaattgatacttgaaactgaccttttaatatagtttttgcataaaaattaggttagagaaaatgttgtgctaagaaaacaatgcgtgagctattgttgaccttcctaattctttaaatttttagtgacagccttgaaatgtggtgacccataatcaaatgttctaaaccacgtttcatgatagactttacttcatgaccagttacttagtgtcatcatcaccacatattactctgcacgtgtacttcatactaaattttggattttagaaatgttctgaaggcaatacctcaagaaatatttatacagaaaacaaaagtttagttctattgaaatttaaacttgcttctctctacattgctttgcatatttcaaaaaagaaaatatattcaatggcatttttatcaaccacttatatatacatagatacatacacacattctctttggcaaaatttttttccagcatgttttaagaaatttttttttaagtccttgctctgctctttttaaaaatggtctcattcaaagttgtgaaatatggggtgatgatatggaggaactctcctaagtttggttcatcaggaactctctctgtctttctgagacttttctccaaggatgttttgctgcttgtttggttatttgtattttgaaatcaggatctgtagatgttcttgtctcttctgccttatcaccacactctaatctgctcaccctgaccttccaccttgaagtgaataagcgcttaggcaggcatagtcctgtaagccgatagtgccaccggcctcagctaaatgaaaggaaaggaaattgtcctatatgcatttgctgtggattcatggattggctttctgtgatagagaaagcttgtttgtatctttggggtcttaaacgtgcatgggaaataccattctaacacactgcttgcttctaaggtaagactataggaaacacaggaaagttgccccattgagtgacatttaagacgttttctaaaaatagatggacagtgtctagcaacatcaaatatatgatgcaattatgctttgtgggtttttcatattttaatgtgatttcaatatgttataactatttttatatgtatttgtcaaatgtgtgttatttctataactctttagaattttgaaccacctccaacatttaaaattacagctggagcaatagtttttgatgagcactgtgtggtcataatgttactcaacatacatattatgagaggcagaactgagctgcagtttagtagagaggcgtgaggcaaaagtgaatggatagtcttagtatttaagcagcacttaatccaccagaagtaattatatcataatagcttctgcaattaaataatcaccaaaaactaaaaaaaaaaaaaatacccaaggtgataaagaatttggaaattaaattaaagaaatcagaagacagctaatggtcagaccgaatgtgtaacagccttcctgttccaagaactttgaattggagccaaacaatctattaaatagccaggacattggcttagcattacataatacatgtgggaatttatcaggtccgttgtcagacaccagctaaaataaacagggaaattctgagcagtgtgtaaagttgttgcattcattgacctaaaacgaagtagaataattggagctgttgcttgaaaaacccattgtggaatgctttcttgttaactttcacatttcagagcaattaacttccgttgtgttcaaatattttcagatgtaatttaaaaccaagtaaagtatgtacttttaatattctgggtttcttgggcttatctcatgttattgatgatcatttctctaattttaattcctgacccagagatctccagtatgtaatgtgaagcttctgcaattttgtatcttactccacaaagacatgatatgtctgtttctaaatatttaaatttaaaggaaggatggcttgttataaaaaatatggttataaattgaagaataatcttaattttgcaccatttattttgtgtcaatgcttatcttttttgattcttgttatctgagatgtagtttaagggctttcaaaaagaaaagatctcactgctgatagatgcttgtaatctaagattaaatattccatattatttttaaggtgttctcacagcaataatttttttaaagtaagattaaaggatttagatttaaattagttgacatttacatatatcaaatagcactttcataatcgtccatcctatttgcataacgagggacgttatcacctctgctgtcaaaacaggagattgttttcccttcagaaatgaattagctgccctacttagcatacacaggtacataaaggttcattaactctctgatttaggtaatttttcataacgggtgaaattgtcacctaatttcattaaaaagattaggaaactttttacaaaaaaaaatacatttcaagtgttagtctttaaaaaagcatagtttgcatcatttaaatgacttgttaaattacttatgagatcattttaattgttaaaaaataaaactacttgatctgctcctgtctgtgatataccatatatttttaacaaaaaagttatttttattcattttattgctttagctccatatagtttatttccttgataaaattagaatatgatagttcttatgaaactgacttgctgttagagtggtatttaatttttcttttttgttcagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgagtggagtaaactttttttgtatcattatttattaattatattttctccacatatgttaagggtacagaaaatatcttgaatctgtaaatatctattaagagaagtttgggttaattaaatgtgaccagttaaagtgctgatagtctcttatatataaaggagaaaaaaatcactttatctgtcagaaacatagtttacacatttgtcattattcactttttacttcaacacaaatttgaaatgggaagtgtagttgtgtgacatgaatagcttgataattaagagttaatcagcataacattgctacattgcacgcatcatcaaacaaagatattcttatattcatgggaactagaccttttgtggtcattcacttaaaggtttataatataggataaatatcctgtatgaaaatggctttcattttattcatagtaaatgagattttgaaacacatccaaacattttaacattgtgctgacaacaacaacaaagaaaacacccacacaagatattaataacttaaaacatataggcaaggactatcggttaattcataccattttaaatctgaatttgataaacatagaggcagatggtgttataatttttttctagaatgccaatgataatgtctgtgtgatacaattaatctgttgtgaagactttacacattcaaatgctcagtttggcattaaagacttgtatatcatgaatgcctgcaatttgactctatttttcttcacactaggggagagtggatttagttaggctatgtaaggacagctgggtagtttgtataacgttaaatatcaaataatggtcctgggagaaattatagtactgctgggtcccaaccatctcatatggatcatggaacctgcagagaagacgtttctggactgtggaagagaagagtgttttgcctacttttcggttacactgaagaaggctacacagtagccctggggacaaccaccagactgtaatttccccacaaatgtagacactcatgtcctctattgtcctgttttgtcttcttggacatacaaataggactagaactgattgattcatttttttaaatgtaatgttgtttcatgtgtaaactataatgaataggaattaattatttcttgcatcaaagtcagtacgccattaaaaagtagagaaacttttaggttttcaagtttatactcctctaaattattatatattttcaggtacacacaacttgaactatttttggctgcatgtttagctagagggtgaataatactaagatttatggtggattcctttagtgttttcatgcacatcgtttcttgctgtggatcaagccaaagagcaatcattgtgtcaatagaaaaccgctattttttaattggcctatagcttgaaattgaaattaagactgaaatattgaatgtcatgtaacactgtttggaccttgttatttggaccagaacctattttgagtatagtcaaaaacatatgaattagcatttgcactttattaccaataccagataatttttaggtttatgatattcattatatcttcttttgcttgcaaagttagaagaaaatttttgcaggttgaattcatgagcttttattatgctttattagaaaaaacagggatacaagattttttaatttctatttttaattatgggtacataatagttgtatataatatggaatacatgtgatgttttgatacaggtatacaatgtgcagtgatcaaaatcagggtaattgaggtatacctacctcaagcatttatcatttctttgtattaggaacattccaattctactcttttaattactttcaaatatatgataaattcttgttaactgtagtcaccctatgtactaccaaattctagatcttattcattttacctatttttgtatccattaaacatccccactttatcccctccccactccatgcccagctacccttcccagcctatagtaaccatcagtctactctctatctcagtgagttcaatttttaaaaaaaaaaagtttagctcccacacgagtgagaacatgcaaaatgtgtccttctgtgcctggcttatttcacttaacataatgtcctccagttagtttcactcatgttgtaacaaatgacaggatttctagggatacaataattttaaagccgggagtggtagttcatgcttgtaatcccaacactttgagatgcagatcactggagcccaggagttcaagaccagcctgggcaacataaggagatgcaatctcttattttaaaaagttaaaaaaaaattaactgggtgtggtagtggcatgcacctgtgttcccaaccacttggggaccactaggacccgagatgtcaaaactgcagtgagccgtgatcatgttactactacacttcaacctgggcaacagagtgagaccctgtctcaaaaaaacaaaaaacaaacaaacaaagaatcttaatgtcgcacttttgagctaataattgaatatcttttctttttttatatatagttgcagctacagtggctgttaccctcatccaggttagaagtcataataactttagaagaagaaaacttatttaaattcagcttagtttgacttatcatttttttaaattctgaagacagatttcttgattttattctttagaatttagggtatatttattcttttctccagtctttagatacagtaggcctgtaagttcaatacttttaaacagaattagtaaacttgaaatccaccatgttttaatatatatttcagtgattattttagaggctgttgacaatttcaaacatcttacatataaatgcttgtcttgtgcacctctcacctactatgagagcagttgtaagagtcatttgggaaagagcctaaattatgtaggtcacttctaataaacaaaaccagcaaatccgaaacagcatatcatactgtgtagaggcacccgtaacctgggctttctttcaactgtgtattcacatgttgcaaagaaaaatgctttgccctctttgaagctgccccactgtagactgtccagtagaacctcatgcaatggctcactgtcatcttttcttaaaagttgtcaaagactgctctgccattgcacttgtttatttagctatacacagaataagttatgttttttccagaaaaagaaatactgacttcaagtgtgaaatgaaatattacagcactgatgttataagttgtatatcattaagaaataaaactgttgtgaaatagaatggctgtttaaattgaattttacctttactttagctgtctttcataatggaagtagggaacagctcaaattcagaaacatcaatacatgaaatagtttaggtgagaataaaaattgacagctcaaattcagaaacatcaatacgtaaaatagtttaggtgagaataaaaattgacagcttttttatttaaaaaaattttttggcatttccaagtttacaaaaactatttctttcttagtttcaagcttagacaacatggatttcttaagcaagtatgtaaaaataacattatgaattgttaatttatcttacagaaattttcagacaacctaataaaagtagttaccaattatgtgccaagaactatatatatatatataattacaaataatttttattaataagtcccattttatggctgaataattcatttatctgtgaaatcaacaaatattactagactgcagtgtacctaacaccaagtattcagtggtgaacaagaatctcatccagcttatcctctgctttaggggttcagcgagctttcctgtaaaggaccacatagcaaatatttttagccttgtgagccatatagtttttgtctcaactactcagctctgccctagtagtctgaaagccgtatgcagtatgtaaatgaacctgtgtggctgtgctccaataaagctttactgacaaaaacagggcgtttggatttcacttgtaggctacagtttatggacccctgattgagttaaacagacatgaaatataaaaatatataacaaaaatttcacttatatgtgctatgaaagaataataggaggtactttatttacatcagggttggagaaaggcctgaggaagtgctaaaagatgagctaaaagatgattcagagttaggcaggtgacagcattccagaagcagtatttgcaaagttccttaagagaggaaagagcttgactgaggagctgaaggaagatcagtgggacttaagcctggtgtatgactgtagagaaatgagagaaaagattggatgttagacaggacccagatatcgcaaagctttgaaggtcctgttaagttctaaataactggctcaagattgtacagttaaaactgggaagtgaccaagatctgagcccggatctctcatattcaacacgaaacaaattatgctttttaaaattatgtcatgatgcatctagtgtaatataataactaagagcatggttttgtgtcattacttttcccaattatactgcatccagtataatcaaatggctaagaggcatagtttttagagacacacaaacttcgttcttgtcccagttctgccacttactagctatgtgaccctctagcaagttacttagaccctctgagcttcagcagtaccctcatcactagagtgaggatgaaaaaaagttagtacctttctcattaggtctttaagacaattaaatgaagcaataaatgtaaagcacccaccaaataataagtgctcaataaatttacctattagctattcctattaagactcaggctctttgaaccattagctattatagttaatgtgatttctatcaaaacaactcttgtactgtgtagcacaataaagaatgttacctaaaccttcatttcatgagggttttattttaaaagggtattgaggagatggatggaaaagtggaacaggtagagcaggagcacaaaggagccttcagaagccaacaaggggctagagaatgataccagagcaggagtgagctgatgcagagaggatagtttgtggacaggaaggaaagatcacacaggacgtttgcagaggatttatgacaaggatggggagaagtcgtttcctaaatgttatgcttgtgggacctgttttcaaatatatgttactgaccaaattatttttaactactcctcaccatttttatcactaccagcttctagcttatgctaacactacagtttcagtctctccgtcggcattttttttttacccttgaaatacctccatcagttaggcagtcttaccctctttcacatggtaccaatttttaatcatgctcctgaaacagatttttttctgtgacacttttattgtattttacagtaacatatatatgcaaaggtttaaaaagttcaacaacaaactggtttttatgaacagatggttttgggggtgcttgtttcatttcttttgtgtttaaaattttttaaattaacaaataattgtacgtattcatagggtgcacagtgatgttttaatatgtataatgtatagtgatcaaatcagggtagttagcatatccatcatctcaaacatttatcatttctttgtcttggaaacctccaatatcctccttctagctatttcaaactgtaagatatattaactgtagtcatcctttggtgggatagaacacttgaatgcatttgtcttatttagctgtaattttgggtcctttaacagtttttaaatgaatattgtccttatatgactctttctacaaacaatatatttagaaatctgttatattaggaagaaagatatataaaaattaggcatgcttagcctaaacctatttacttgtatgtttgtatttgaaaatttcagctttcctactttgaaaggataggagaggtaagcccaaatttatttgtgcaacttgttataaaaagacatttaaatatttgtcagataacacagttagggcttaaaatagtaagttaagaaagaaatatatttaaatgccttaagttttcttttctttcatcagatctggcacactaatagtttttgccagcaaacaaaacttcatgtaattatcagtgcaataactggagcacaaactaaagacaatttgcaacattctgttaatagaacaggagaatccccttatgactaaaagaattcagagttcatagctgttacattttctaactttccctcttcttatgtccccatctcagtctcttcatatgaattataaattatataagatgaactaggaaaaaagctggaaaaatgtgttcagtgtagatgcagcttctgacagtttctacatactgatgtgttttcaaactaaatctggtctattcgacactaaactgaaaaataaaaagagatgtatagattccctcaagtgactctttaaaaagaaaaaattttactccttactttttcctggttttcatcaagttaattacagttctaaatttgggagttacatcttaataacctaatagaaaatttgttgaaagagagatacattcactctttaaatgtgagtaactggataattgagaaatacaaattaattgcttcaaaaaaataatttttcggtgaattccaaaccataagttggagaatagatggaagatgcagtctccactgctaaatgcactttttttggccacctccacaaacagaatttccagacttgtgagtttttctttaaatactgtagaagaattatacttgttaatcaagaagtatctggaatctctttcagacctagtgaaaaaaagctcaatcagtgaaaaattattgattttcctatcttttaatccaaaataagcctgcaaatacctcataataatgatgatgatgattgttttttcttagtatcatttcttaacagatgcctgcctccccaacacttgtattaaaaattatactaaacttatttcatataaataaaataagggtgtgtcatagtaatattttaggacatcatacccatcagaattgaattatagggtctattgccacatattggggatgccttcttaaaagctcctcatgcatataagttaaatcattcttttattaatcttaaaattaccaagggaaaagtttttattcaaagatttggaattgctggtgattgaagagttgaaaaagaaaaccagaagggaaaatgacctaaataatacttgtaagagtttccaaattaaaaaaaaaaaaaaaaaaaaaaaaagcagtaggcagaatgctcagatgtatgtttaacagctgtggcctcaggccattcatttccattttatcccttagcaatttgaaaagaattcacaaataatctccccaccatgtagtaggatcacagcaacagtgtgccacacatattactatttatcctgttcggtgcatgatattttatatttatgtcagctagatctactcctttactgccagaaagatattgctccaactcccgtcaatctcattcattcactttcctttggtaggaaatctgagagaggccaacattttcataaggaaaagaataattgtcacttctagaattctgtcactcttctttgaacttgagggcctcaagggtttttattgtttccagttctaatttgtatatctcatataatttctacttaaaactgtaatttaaaaagaatctgatgcttttatttattgtatctcattttgtgaagaaagttgatactgaatggcccctttcacctctgggaatgcatgcacacaccactctgtctgctacaagtcacctttagctttgcaaatgcacaaactgtgtgacattgtattactgagaaaccaacactaaaaatattaacattataaatagactacatacaccgagaagtttcttccaaactgtagattaaaagacatgatgctaattgtttcaaaagccatgtcctctgcagtctgcacttctttaacatttagttcaaaatgaaactacttcaaaaattattagggtatttttaaagtttgcatcccaatgtattcttgttgaaggtagtttggaaacttattttttctgaggataatggctttggcaaaaattttaaaaaattaagtaaatgacatcattaaggaaaaaaattaaaaattgataatatgtaatgtgtatttgtgtttcttttgaaatatgttggaccattaataagaattagagaaccagtctaaatgtttggaaatttgacttttaattttaaattggaacagtttaactaaagaaatcactaacatttaaataacatttcaacaaatgtaactgtttggaaactataacggagacagccttctgtcttgcaaggattgatttggaaggccctgggggagaaaatattggagttaggaggtaaaacctaggctattgtggaaaggaagaagttacactcttcctgttatgacaggaaaatgtagacaaatgtgcttcctgagcatttgctcagcagggaatgaagtatcctttgacctttcccttaggtacatttggctttgttgaactagtaaacatgtttttgcccccaaaatattaatctggtttatttgattcttctcagattcaaattatatctcttatgtagatgagatacagagaaacaaaggtatttattttatgactgcatctacagattggatttagaatgaaaattagccctttaacaaaccaggcagacttgagcagcccatataaaaaatgtgaagcctgctgtgttagtcttctcttttcaaaaggcaaaacattcctaggccttaaaatgggccacagtaaaatctcttatatcctgatcaagttaacaattttcggtcatccttcttccttttcctcatgcagacaaatgcatcagaattcagctgtcacaaattttaaaactcaaacttttatgagtttgttaataaacactcgtttcattaatgtgcattcgattatttaatttagatctaactgtgatttattattttccctccaatgcataagatttggagttttattttgggatttgggatgttgacttagggtgaggggttggtagagttctaaattccacactctaagccccttattttaatccttttatcatgttcagaattttaggaactactgcttgaaaatcctttggaaatactactgtatttcagcgaaacggaggctcaatttgcttgaggctaacgaggacaatagtcccctttgcggcagaacacactgctgtctcatcctcgcaagttatgctggagggttacaagcacgtggtagcagtctgcttaaaagagtccctcgctgctctttaaagagcctttcatttacgatggcaggccccgtcattgtataaaggaacgcttgtctagaacacaagtctgcagaggcactgcttcctcccaccgagagtaatcatcgggcctaaagctcgcgagcctttctaatgacagactgaattaaacaaaataaaactgaagaagaatactttagaacatttgtgccattacttactgtcaggaacaagggaggtggagaaagagcatttaggagggcatttccctttttcccaattaaagattgtcgttgcagactcttgactccagccctaaccctttaaacacataggaagacctgtggctcctggattacagagtgtattgtatctgtgaactgtccatctgtcactcattagtcattctgtttcctcaactgggaggaaactgagagattatctaggtggggggatgaggtggagtagccgacctgaaatattttcacataatgagggttatatttatcatgactcttatttggagggaaaaaaaatgatcaaacctcaaacctttgaaaatagaattagctgggtatacgaatcccaaacacatcctaaaacaaagaaactactatttatgagttaaagaatggtgaaaataaaaaaataaaaaattatccattcattgagcactgtaaggttcaattaagattaggctaaaaatattgtgtttggtggaaagaagtatttgggacccatagatcagatttttgttgcttcccttagtgatatgtctgaggcaatttgcagttgggcctcaattattattatagatgtgagtagctgctgtttctaaaggtccttttctttcagaactctttcctgcaaggtgcaagaacagttaccacagttaaaatggcaggaaagttcttctgaggtgactttatgaatggggctgggcctgggagggtgagggagggggcaggcgtgtggagtggagaaagattatgaaatgccctttccatttcacagtagtcaaactaatttccctaccctgtaggaaatgatacaggactccttctctgtttttagaacttgttatttacattgcctgtgtaaatcagagggccacctttttttattctagctgtaagcagacctgtatttactaccaaccaaaattcttcccattttctgaaattaaaataaacatccataaatatagaactagtttgtgcccactagtgcatgcatgtggttctcagtggctgtagtgggaatggccggagcgtctgagggcagagttggctgcagagtctatacaaaagtagctttgatttactgtcagaacctagaaaccaactggctctcaatttagtgttcttagtattattttttgactttaacctagaaagcagtccttacgttaattaaaatgttatgcattactgtgcttgcacttatcagaatttctgatggttcttaatgtaacattacaaatgacagtgcctgcatactgctcaataaacagttgactgggtccatattgagctgaacttcagcccctaaaatccatagttatctaaaagagggaaggaacactaactaacagaaagaaagatgcactttgtgtgaagagggttggttttctagtccatccaggaacaagtctggggaccttggataaggctattcatgtctttgtttacggtattcatctgaaaaatagggatgataaactgtgctaaagaataagttcaaagagatactgtcgaatgtagggagataattaattataaaatcgttgaacttcttagaaaaaattatcaaataagcaacactgttatctaaaaaataatataagaaatctgatatgcttcacttgcaccaaccaacccacacacaaaatttgaccaagtccagttttttctcctgattaattttaccaaatgtaagtttctactgtaagttaaaatgacaaaaaaataaaataaaacaagtatgtgaaatttccctctctcagtagcaaacttcttgttaacatagtctgagcatccatagaaatttattttcagctattcattttggattacaaaaaacactataattcctctgtccatatatctattcattctatcaacatttatttatttagccaagtattattattggttgtcaggttacaagaatgagcaaaagatggcccaggtactcgagaaaaactaggatatagctgagagagacactctaatctagacctaagtaaataatggtaacacaagctgacaggtcctaggagaccagtcttttacagtatgtttcaaggagcgactaagcctggtgcatcagagaagatactacttgctttgtaaagtgtttcacagttaacaagttatttacactggtattatatcccttacttgacctctcacaaaactctatatgatgcctgttattatctccactttccaggtgaggaaactggggttccggtaagttaagcaattttacgcaagggcacacagctcataaaaggcagagctgggacttggttttcaatttttatgtttttctttctacattgtactgccccagtcatgatgcatgtatcctgtttctttaaaatgtctttaataatgtgaatttgctgttttatcaatctggataattatttttctgtgcattttcagtacatcatttaatgttgtctactcaaattctttacagtcttttgtgtctcgtctagctacaaaaaaagttattttatttcttgaaatatggaaattagaggcgataatgtatgggtgggattgagtaactaaaacataggagattctgtagggtgcatgcttggtgaaccatattgccatttgctcttaactcaaagccctatgatacttaggcatagattaagaacatctaaaaattagaataaatattttaaaggtctctagtccaacttcctgcttaattcaggagccccttctacaccttccttgatatgcagctctatgtgaacatattcagaaatgagctgcttcctgcttggtgggaagttctcatcactagattttcccttgttttgaatctctttctaattttcaacaatgcttactaattttgcctcttcgcatggacatatgcttcagaccttagaaaatgtttagcatttcacttttaattctatttttttctgagttatacattccagattctttcaatggttcctcatgccagattgttctcagaccctacatcagtctgtttaccatcctgtagatgctctaattttgtcagtgctttcttaaaatgtcaccctcagaactgaatatgctaccaaagatggttctgacaaacaaaaagatcagtaggataattaattaccactatagaacgctaaaactttagatcctttcccaaaattccttaattatccccaacctgaacttttgtaattgttttttaaaaatatgaatgtggactttaaaattaccttcatttgattcatcttgattgtgacccagctttctaaaggctgtagaaggcgctatggatatagactcttatcacctactgggtttgctcaagcacccagatttacgttgcatgcagatctgataagcctgccttcctatatacccatctaaaccaatgacaaaaatgtctcctgggatgggaaaagtactgaattctatggcactttactagagactttttgataaacttaacattgatcaattaagtcggcctcattaattatagttcatcagccatatttaaatcagctaaattactaccatccagtctcaaattgtgcatgaggatttcatcacttttccaaatgcttattctttgaaaatctgaactcatcagaaagttcagtacatttttgcgaacaaactcagtcatcctgaacccatggatcctccccattctttctgtatcctgtgattgtaaaattaaatttttatcttcagacttttttgtctttcatcttttttatccaggcaagggataaaaaagaaaaaaacttttctctgaattttttgaagtatatttttcttgaagtctacagcatatttacatatatatttttctccagacatcatttaccttctttattataaattccaagatagtgtaattactttatcttaagatttgtgtcactaataagctaaacattgtagtaaaataaaggtatatgtgtccaaaatctctatttttgagagattaaattatttaaaaggcaagtaaaaaagcatctactctaacataaaattataccgaaacattcagacttcaaaatggagtatttccattccataatccattcgttcagcaaaggttcattgagtggccactggtcagagtctgtgagaggcctgagggatggtctttggggaattcaaatctggcagaagggaaaactcatatacaaccaactttgtaatactggagtaagtctcataataaagatttgtaaaaagtgctggaggactacaatgagaaaggaatgagttttatctgaatgtgacaaggaaagcatcaaagaaagaagttggcatttaaactaacccttacagcgtgatgggtgcatccagtggccaggtggaaaaggagagatggaagtaataccacaatcagctttcaccaagtcaagattagaaataaccagtaaggtagatttcatttcgtactcatcttgactgaatttacatctactattatttttctagctcagtccagagaaaaagttagtctgaaaaaaaaactgaattcacccaactctaaataaaaatacgaattcagattattagatatgactgaaaatataactctgttggccaagtcatgcattttgttccaaataaagaaaattccttttaaacgttatggaattaaatgacttttttttgtccagccacaaggaactgatatgaacaagggagatattattttatgtaatggaagccacagtacctagcacaaatgcctgacatagagaatattcaataaatattgcttagcataatgtttgacatgcggaaaatgctccataaaacttggccaaattatttttatattttttgtgaatagactttcttaaatttttagtaactgatttgtatggtgctatatttaatgaatgtttcttttctcaatttcaacttctaatttctgtttttccttcgcacctaataggttctagagccattatcaacataagatgtatggtatctgtccttactctaggatttaaaagtcagggccactataaaacttaacataccatcatcacatttggggctatttaaagattcaaaaatataaaggaaaaacataaaataaaaaacatacagagtagttctgctttctatgctatatcacacattaagtctctttaatttgataacatgttgacttatgtaaatactggaaaagagagactctttgcctaactactgtaaaaacctctttctgcctcacctaaggttccaaacatgttatttaaaaagaaatatggacttgtccccattacaaactattatcaagttaagaaaaatgtaaccatcacaaggcattatttaagtataaaagcgcagaattgaaatctttgttattgagtggcatattttaaatgaagagttatattccagatctctttagaaagcctaatgcttaaaaataattttatctaactatgaacaatgagaaaaagcattataaaatacattttgagaatgctatgaagaatatgaacataatgcagaattaaatttagagcaattaagagtagattttgaagatattttcttacgtgctttaatacagtcatcatttcagtttgcagttttaaattgcagaagaagctatatgcactgacttctttgatgggtattattaaataagtattcattatccagcagcctatttggttacacaaaaattgaggagcactaaaagtaaacacaaatagtgacattaatgatatttctgtactgaaatgtactttgattatgagtgttgtaacgtgcaaaattctgaggtctgagtacaacagaaaccatactgtattgagacattccacatatagcttgtggtcatgaagtctgattaaaagtggttttagatatatgaaagtagtctaggtcagtgccttctgtattgaacgtattctgtagcctatttcactaagtaaaatgccaatatgcaggtacattttcatatcaaaattggatctaaaagaaatattaaaagacatttagtgcagctctgtgtaattaatgattatgtttctttattcattccaaaaagatggttttcagcccatccttaatatcaattatgactcatctgcataaaacagaataaaagtttctaaagtagtatgataatcagatatgaaaataaaacactagctatattttttcagaagtactttagaaagacaatcaataaagatgaaatagaaggtgaaaaacactgacaattacaagaaagaagaattatccaagttgaaatgtaaataacgtaactgagtaaatattgactagttgatatgggctagtaaatatctaaatgccttattttccaaacgatggtcactacagctttatctttctatcagtcataataacatcttcaaatagccataactggtagactcttcaagtcaccaagacaagtatattttgctagttcttcttttttggttaagtcaactaagaaatttgggggaactaatatttattgagcacctactctaagcattatactcaatactatacacacattattggatacaatcctcacaacagccttaagagtaggtataaatctctgttttacaaatgtgaaaaatcaaactcaaagaactttatttaaagtgaggcgaggcacggtggcttatgcctgtaatcctagcactttgaaaggcttaagcgggaggatcgcttgagctcagaagtttgagaacagcctgggtaacatagggaaacctcgtttctagtaaaaataaatacaaacaaagataaagccagaacatgttggtgcacgcctgtagtaccagctactccggaggttgaggcgggaggatggtttgaccctggaaagtggaggctgcagttagctattctagtaccgctacactccagcctaggagacggggagaccctgtctcaaaaaacaaacaaacaaaagagaagttgttaagtgaatttcgcatgactagcaaattcggcattcaaattcagagttctctaaatacaaaccctatgttctttgctttctaccatactaccttcaatgtcatatgataaaatagtgtaattattattaagtaaggaatatatgtattgttaaaacattttgcatatgagttgttaaaaaaatttcatgggaaaatttatcacatatatacatacatcaattgtatctttctgaagatttcacatagtagcttcccctatcaatttttataccatggatttttaccatgtgcccacacatgtctactggtctaagcactggggataaagtagtgagcaaaataaaaacggcatatacccttgtggagcatgcgctgtagtggaagagaggttaaacagatcacacaggaaaatataaacagttttgtattttttattttgcatattttatatacaaaatatattttgcatatttttgtatatatttggtatatttttgtgtatattttgtatatttgaaaatataaaatgtgattgtaacatgaaggaaaaataaaaggtgataagtaaaacaataattaacaaaatgtggaggaatgaggagactgggaggtcaggctttctgtctgctagtccacagtccttgtcaacataaatctatttagttgtgggggagggtggggagtgggagaaggtggcaggccaggattcagagttctctctgaggtttctagtttggatgactgagtttatggtgagatggggattccaaaaggggctgcagattctagactgaagataatgaggttgaactttggaaggtttgagaatccaggatgtttagacaggtgtggaactggaggacatgcattgggtgtctggagacaaagagaaagatgaagggtaggaatatgcaattaggaattacacacaaatctgtgataaaatgagctggcctctctgcaaggtgggttggatttgaaggtatgaaaaaagtttaaatgattcattctgaaaacagtagcttaattaagtaaattagcttttcccagaatatgtgcctcaaaaacctagttctgaagagtgatagtaagtgctcctcaaaataaataaatatgcaaagaaacaaacgatatgtcagcaataggttcgaaaagcaagttaaacaaagtttaaaaggtttcatagcctttcatataccaatgtgcctctttttccaaacatattaggccactgaacttttttcttaaggagtattttataggaacagtactctacagaatgaatacctgttgggaaacaggtattcattctgtagatgggaaacactggaccatataaaggtttataagagactccgtctccaaaaaaaaaaaaaaaaaaaaaaaaaaagaatgttcacgccttttcagtagccagactggagcaacaagctgaagttcaattaaaagagagttgaaattgggaagagtgaaatgtatttttgcatttggtaggattggcaggtaggaagttttcaaagccagggagagggagctgttgtaggcagctcatcaggaaaaagacagtaggaagagtgaggctttgcagtttgagttaaattgaggaaggaatgattccaggcagggagatcatcgaggacaggaagctgctaggctgtccaaaattgaagtgataaggacatcagtgatagagttgcctgggaaatagtgtgaacctgagaaatattttgaggaaaggaattatgggtcttggtaatagattagattaaaagaagaaaatggtggcattaacaatacagtttctgacctgagagaagaagaaagatacacagaagaatgaaaccaaaaccctaagcatatgatggctaacggacttcccagtgccctgttgggtttctagaaaacagaatacaacatcgtctgagatcacagtcatatcccttcaagtgttttcaattaaatgacatgagactagacaattttaagacttgtttgaacacagatctaaaatgctaagttcctaatgtcatgtccactcttcaaatagtcaaaaacaagctccaaactaattattaattgggaaatatgctaaccatgctgaaattaatttttttttaaatcttaacttgctcaaagaaacatgaccagttccctggtcaccttcattaaaataccctacattaaatcttgcatttagagtctcacattcagcagcaagctagaaatcacacattttcaaatgataagcagaaattaatattagatttatttgctttctttctgaatgtgttagtgcccagggctctgacaactacacaccattgttttgtgaaggaaaagaaaaaagaaaagaaaaaaaccacacatgcatgaatattttttaaaaaatcttggctgctttcttttttctaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggtgagagagcatgcgtggtgagccccaagcctccgcaagcaggggagtttggacctccccctgccacacacacatacacacatcatgttctttttcttaagatgttcatagtcccatagatagacccaggattattatctatcgcaactcttactccaccttttctctccccttcaaaagttagagtgatgtgatgatagagaccatgtaagatctggtctttgctagaaatcaagtaccagtgtcaaactatttgcttcatctttggcaagtggtcattgtccacagctgtgtatcaggacaccatggttgggaactcttgccagggaatagctcatccatattttagacacttctgatcatttattttaggtatataatagtttcccggcatcatcaaagaaaaaacgtatttaaaaatgaactcaccccaaccttacactttcagtttttcgatttatgtctcttctttgtaactcattattctgaatgctttcttgctggaagagtaaaggcaattattctcctagaaatgttttttcctaaaaattatatcattatatatatcaatgaaaactgttaatatacatggaatcagaaatcagatgaaaatgaatttctaaatgttagctcagtgtttaatcaatgtcagatttaaaaaattgttttattgtgcccaaaataaataagcatgatgctgaaagtcaaaaatgttttagatgtgttagcataagtaacataccatacagttttggctggaacattttttttcccattttattttattttattttatttttattatacattaagttttagggtacatgtgcacattgtgcaggttagttacattggctggaacattttaaaccttttcagcatcgatcctatttaaatactttgtagtacccttcatgagcaatgattaagactacaaaacaaaggaagaggtataataaggatggttcccatctgcctattttcttaatctatttgtctactctggcttccctagattgtgcctgctttctcagaatgaaaagaaaattaataagtgtttcaaaagtatgtactcaagagccagtttgccagagtacacgtcattcttgccattgcttagactggttccacattgtaaaaaaatgtagtgctaatcctgatcaaatgaatatgcctcccacatccatctcccttttacctgttacaattgtctaagactaattctcatttctttgtttttatttgaaagtttttcaaaagtattgagctgattattatattttatttttgccttaacgaggccaaggaaataatttcagagaaacaaaagtgaatgataaatagacctagggtgatatgtgcttaaaatactatgcattattttagtttttcattgataatttgaattgtgtgcttgccttgatcttgaaatttaggatcactgataaaatttacctatgcatttcagatagttttttatttgcatataaatatgaaagtacaaaaatatgaaggtgaacactgcttgtgtgtgtgcactaatacttatgtaaaataaattcagaaaacaaaacaactatttactaaaaactccatctcattactaaaaccattataacaaaagtcagggtaacaaaagaatttgagttggaatttatcattacactggaactgctagtccttaatgtcatgtgaaatgctgtagatccataatgagccaattggaaaatatgttgacttctaaaatttgctttcttaaaggagtttaaaacctagaacattcatcttctgagggtttttcttaggaatatattatatgacttgaaggcaacttaaaacttcatatattggccaggtgtggtggctcacacctataatgccaacactttgggaggcctaggtgggcagattgcctgagctcaggagtttgagagcagcctgggtaacatggcaaaactccgtctctgcaaaaaaaatacaaaaattagccaggcatggtggcacacatgtgtggtcccagctacctggggggctgaagggggaagatggcttgagcctgagaggtcaaggcctcagtgagcctagattgtgcctctgcactccagcctgagtgacagagcaagaccctgtctgtttaacaacaacaacaacaaaaaaacccacttcatatattgtatgaaaacttcatattttttgataggtggatatttgaaagtcagacttctttaaatgccacaaaaacagcactgggttaagagtcattgtttttcatttgaatccttgtcttgcacttttgtgcagtgtggtgagttgggtacctctctgggctgacgttttctcatctcaaaaatgaaggcattggatttgaaagtgcttttgcaagattataatttttaaaaaagcaatacttgtaaaacaggagtaaagaaccagttccattttcttgttaacatcaatagattaaatctctgaatctctcaaaaagacacttcgaggcttttgggccaaatctagagattggatggctcaattatttggatgaacataacatgtaagtctaacacattgtgggtccgtcctgttcaactccctgaattatgcattcttcacatatttggcttttccacattttagtaataacagagatcatggaaaaagaagtaagatgggaccgctaagcttgataaaatttacatcatcttcacatggaatatttttcaaagtgctgcatcactgaaattaggatacttgagacacttggtgaagagggaatctggattggaagttgcatttataaaaagttccccaagtaggccaggcacggtgactcacacctgtaatcccagtactttgggaggccaaggcaggcgcatcatgaggtcaggagatcaagatcatcggggctaacatggtgaaaccccgtctctactaaaaatccaaaaaattagccgagcgtggtggagggggcctgtagtcccagttactcgagaggcaggagaatggcctgaacacgggagggagagcttgcagcaagccgagatcgcgccactgcactctggcgcaggcgacagggtgagactccgtctcaaaaaaaaaaaaaaaagttcccaagtaattcttagacacactaaatttgaaaacctctgcagcactagtacataaattgtgctggaggcaaagacctatgatacatcagggatttgaattcgttcttagaatggatctaccataaagtcaaaagttaagattgtttactgctcctgggtaaaattttaaatcctatttattttaatttaatggaatacatttaactgaataagtttaatgaggagcataatatgtttcatgaagggtcattagttttatatttcccatttggaccattacccctcttccttaaccctctaaaaacagtttactcacaagaagaaaaggtatcgggagagatagaaataatataatttccagcctttacacagaaatacaaatttctgggccataccagagtagtgctacagggtcataggaaattgtgcagtgcgtgggtgttgaaaaagattccttcttttagcaaaaaagctctgcgtaattatcatgtctttgcttgataattagcactactccaacaatggcacaaagactcacaaaggcttaacagacagactgagatcagtttttttatgattatattataatgcagcttgaatatctgtttagatacaatatataaatatgccagatttagtaaatgtgttaaatttttaatccattggttaaaaaaacaaaaacagttattgtattaaaagcacttcctttgaaggaagtccattttacttaactctgtgacaagtatactgggatatttacccaaaacgctagcttgtcagactgttgaaattcagttcggatggcattaaggaactgcccccttcactgcttgttcactagctccactcctcgttctcttagctgtctaagacagcaaaccctaccagtttatgttgggctctgttcctggaagaagatgtggttgttgagtacttcaggatgatctgaagatgcagatcccacaggacatgcttacagcccattgcttcatttagcaatgatttagcaagctccactcatgctcagcactgtggaagagactctgaaacagcaggagacaggcattcttgttaaggatgtaaaacatatatgcaaaaaatcagcttgggaacaattggacggcaaaggaacaataacctcattaatgcagtataagctgctgaaatgaaggtgtaggctaaacaattcaacagaactcattcagccaggtcatgtgtttttccagagcattccaagtgatccttggagtgacaggactcccagacaggttacctccatatccagcacgttttgtaaccacaaaatccttatgggagtatcacttagcacccagccaggaaggaatctctcatcccctcagtgaactcagtgattctaatgagctactcattcagtctgggcccacagtccagtgattaagtgtggaaggggaataaaacacaaggccctttgctgctctctaggaaattcagagatggatgtaactcctgcagaagaaacctttgattcacaactgtctcagtagaggattattggtttttctttttagaggaagaacatgtgtgtctctctctctgtgtgtgtgtgtgtgtgtgtgtgtgtgtgtgtgtgtgtgtgagagagagagagagagagagaaggaaagggacatagggagatggagagaagatgagagatgagagattatatttacctgatattttattattttggaaattttatttgctgtcacctgaatcctgacttctgttttgatttagagacatctaagaacagttgctgcagcaaaatgttttctgcacagtaataattaaggcctaaattgggatgggaaaagccttaaaatagtttataacttgtatagcttcacaatggtgatgaaagttatcaacgagctaagtgctcttacatagtttagtgaaaatactaaatacaatttttgttgaaaagcaaatgcagcaaatagcgaaattggacttctttacaaactcagtatcacaaaatttggaaatggatgtaaatgtgaaaatatgtctactttacttgaccattcattatatctaattagcttctaattttatacttataaaaatatagatgtaaagccactgtagccagactgcctctctagattcctcctctctgggcagagcatctctgaaagaaaggaagcagccccagtcaggggcttatagataaaactcccatctccctgggacagagcacctaggggaaggggcagctgtgggcgcagcttcagcagacttaaatgttctggcctgctggctctaaagagagcagcggatctcccagcacagtacttgagctctgctgagggacagactgcttcctcaagtgggtccctgaccccccgtgcctcctgactaggagacacttcccagcaggggtcgacagacacctcatacgagagagctccggctggcaactggtgggtgccactctgggacgaagcttccagaggaaggaacaggcagcaatctttgctgttctccagcctctgctggtgttaacccaggcaaatggtctgaagtagacctccagcaaactccagcagacctgcagcagaggtgcctgactgttaaaaggaaaactaacaaacagaaaggaatagcatcaacatcaacaaaaaggatgtctgcaccaaaaccccatccaaaggtcaccagcatcaaagaccaaaggtagataaatccatgaagatgaggaaaaaccagtgcaaaaaggctgaaaattccaaaaaccagaatgcctcttctcctccaaaggatcacaactcctctccagcaagggaacataactggatggagaatgagtttgacaaattgacagaaataggcttcagaaggtgggtaataacaaactcctccgagctaaaggagcatgttctaactcaatgcaaggaagctaagaaacttgaaaaaaggttaagggaattgctaactagaataaccagtttagagaagaacataaatgacctgatagaactgaaaaacacagcacaagaactttgttaagcatacacgagtatcaatacccaaatcgatcaagcggaagaaaggatataagagattgaaaatcaaatttaatgaaataaagcatgaagacaagattagagaaaaaagaatgaaaaggaatgaacaaagcctccaagaaatatggggctatgtggaaagacaaaacctacatttgattggtgtacctaaaagtgatggggagaatggaaccaagttggaaaacacttcaggatattatccaggagaacttccccaacctagcaagacaggccaacattcaaattcagtaaatacagagaacaccacaagatactcctcaaaaagagcaaccccaagacacaatcagattcaccaaggttggaatgaaggaaaaaatattaagggcagccagagagaaaggtcgagctacccacaaagggaagcccatcagtctaacagcagatctctctacagaaaccctacaagccagaagagaatgggggccaatattcaacattcttaaagaaaagaattttcaacccagaatttcatatccagccaaactaagcttcataagtgaaggagaaataaaatcctttacagacaagcgaatactgagagattttgtcaccactaggcctgccttacaagggctcctaaaggaagcactaaatatggaaaggaaaaactggtaacagccactgcaaaaacatatcaaattgtaaagaccattgacactatgaagaaactgcatcaactaacgggcaaaataaccagctggcatgataatgacaggatcaacttcacacataacaatattaaccttaaatgtaaatgggctaaatgccccaattaaaagacacagactggcaaattggatagagtcaagacccatctgtgtgctgtattcaggagacccatgtcgcgtacaaagacacacataggctcaaaataaagggatggatgaatatttaccaagcaaatggaaagcaaaaaaaaaaaaaaaaaaaaaaaaaaaggcaagggttgcaatcctagtctgtgataaaacagactttaaaccaacaaagataaaaaaagactcaagaagggcattacataatggtaaagggatcaatgcaacaagaagagctaactatcttaaatatataggcacccaatacaggagcacccagattcataaagcaagtccttaaagacctaaaaagagacttagattcccacacaataatagtcggagactttaacaccccactgtcaatattagacagaacagcgagacagaaaattaacaaggatattcagggcttgaactcagctctggaccaagctgacttaatagacatctacagaactctctaccccagatcaacgttggacttcagcattcttctcagcaccatatcacacttatcctaaaactgacataattggaagtaaaacactcttcagcaaatgcaaaagaatgcaaatcataacaaacagtctctcagaccacaatgcaatcaaattagaactcaggattaaaaaactcactcaaaaccacacaactacagggaacctgaagaacctgctcctgaatgactactgggtaaataatgaaattaaggcagaaataagtaagttctttgaaaccaatgagaacaaagacatagtgtaccagaatctcagagacacaactaaagcagtgtttagaggaggtgaatttatagcactgaatgcctacaggacaaagtgagaaagatctaaaattgacaccctaacatcacaattaaaagaactagagaagcaagaacaaacaaaagctggcagaagacaagaaataactaagagccgaactgaaggagatagagacacgaaaaacccttcaaaaaatcagtgaatctaggagctgattttttgaaaagattagcaaaatagactgctagccagacttaataaaaaagaagagagagaagaatcagatgcagtaaaaaatgataaagaagatattaccactgatcacacagaaatacaaactaccattaaagaatactataaacacctctatgcaaataaactagaaaatctaaaagaaatgaataaattcctggacacacacaccctcccaagacaaaaccaggaagaagtcaaatactgaatagaccaataacaagtgctgaaattgaggcagtaattaataggctaccaaccaaaagaagtccaggaccagatggattcatagctgaattctaccagaggtacaaagaggagctggtaccattccttctgaaactattccaaataataaaaaaagagggactcctccctaacccattttatgaggccagcatcatcctgatgccaaaaccaggcagagacacaacaaaaaaagaaaatttcagaccaatatccctgatgaacatcgatgcaaaaatcctcaataaaatactggcaaaccgaatccagcagcacatcaaaagcttatccaccatgatcaagtcagcttcatccctgggatgcaaggctggatcaacatgcaccaatcaaaaaatgtaatccatcacataaacagaaacaatgacaaaaaccacaccattatctcaatagatgcagaaaagggcgtcgataaaattcaacactccttcctgctaaaaactcgcaataaactaggtattgatggaatgtatctcaaaataataagagctatttatgacaaacccacagccaatatcatactgagtgggcaaaagctggaagcattccctttgaaaactgcacaagacagggaggccctctctcaccactcctattcaacatagtattggaagttctggccagggcaatcaggcaagagaaagaaataaagggtatttaaataggaaaagaagaagtcaacttgcctctgtttgcaggtgacatgattgcatatttagaaaaccccattgtctcaccccaaaatctccttaagctgataagcaaattcagcaaagtctcaggatacaaaatgaatgtgcaaaaatcacaagcattcctatacaccaataacagataaacagagaaatcatgagtgaactcccattcataattgctacaaagataataaaatacctaggattacaacttacaagagatgggaaggacctcttcaaggagaactgcacaccactgcccaaagaaataagagaggacacaaacaaacggaaaaacactccatgctcacggataggaagaatctatatcgtgaaaatggccatactgcccaaagtaatttatagattcagtgctatccccatcaagctaccattgactttcttcatagaattagaaaaaaactactttaaatttcatatggaaccaaaaaagagcccgtatagccaagacaatgctaagcaaaaagaccaaagctgaaggcatcacgctacctgacttcaaactataccacaaggctaaagcaaccaaaacagcataatactggtaccaaaacagttatacagaccaatggaacagaacagaggcctcagaaataatgccacacatctacaactatcttatctttgacaaacctgacaaaaacaagtaatggagaaacgattctctatttaataaatggtgttgggaaaactggctagccatatgtaaaaagctgaaactggaccccttccttacaccttatacaaaaaaataactgtagatggattaaagacttaaacgtaaggcctaaaaccataaaaaccctggaagaaaacctaggcaataccattcaggccataggcatgggcaaagacttcatgactaaaacaccaaaagcaatggcaacaaaagccaaaattgacaaatgggacctaattaaactaaagagcttctgcacagcagaagaaacgatcatcagagtgaacaggcaacccaaagaatggaagaaaatttgtgcaatctatccctctgacaaagggctaatatccagaatctataaggagcttaaacagatttacaggaaaaaaacaaccccatcaaaaagtgggcaaaggatatgaacagacacctctcaaaagaagacgttcatgcaaccaacaagcatatgaaaaaaagctaatcatcactggtcattagagaaatgcaaatcaaaagcacaatgagataacatctcacaccagttagaatggtgatcattaaaaagtcaggaaacaacagatgctggaaagggtgtggagaaataggaacacttttacactgttggtgggactgtaaactagttcaaccattgtggaagacagtgtggcgattcctcagggatctagaaccagaaataccatttgacccagccataccatttctgggtatatacccaaaggagtataaatcatgatgctataaagacacatgcacatgtatgtttattgcggcactattcacaatagcaaagacttggaaccaacccaaatgtccatcaatgatagactggataaagaaaatgtggcacatatacgccatggaatactatgcagccataaaaaaggatgagttcatgtcctttgcagggacctgggtgaagctggaaaccatcattctcagcaaactaacacaggaacagaaaaccaaacaccacatgtgctcactcataagtgggagttgaacaatgagaacacatggactcagggaggggaatatcacacagcagggcctgtcgtggggtggggggctaggggagggatagcattaggagaaatacctaatgtagatgacggttttatgggcgcagcaaaccaccatggcacgtgtatacttatgtaacaagtctgcatgttctgcacacgtatcccagaacttaaagtaaataaatatatatgtacaaaattatttttatgtgctatatagatacatattatacaaggatacttttcttaagagaaaaaaacagattcacttacctaatcatttgcagattttccttctttcagtcattgattgaacaaaaatttgttgaattcctgctctgtgttatatgctatgaaatgcctggagatacagatataaccaaggtccctcaaggactctcagtccttaagttggctcacaaggccatgcatgatctgatccatgtatttctcttactcttcagcctcactttttgcaatttccctgccattaacctgcccttacaacccccatcctatactcaagccacatcgtacatacgtacattcctcaacctctccaagctctgttttgtcttaaaattccttactggatctctacttggctgttacttatccttcactcaagtcaggtcccaattacactttggaaagtcatccttgaagcccccataacttaggttaggtgcttcccctgtattacagtcatcatgtgttctatctttcccatcagagcactgttgaagttgttatccaattgcctgtcccacactagattctaaactcccaaagggcaagggactgtacacgttttgctcaccatcatattcccagtgcttaacatgaggtctagagaaagttacctcctcagaatatatttatagaataaacaaacaggaaagacagacatataatcaagtgattatcatgtggcataacgttgcacatttaaagtatgaaaaaatgtttttacagttccaatgaaacaattcattaaattttgatagagtttatcaaagcacaatttaaaaacactcaagtaatctaggtccatactctccaatatagtagccaataggctcatgagactatttacatttaaatgaattaaaattaaataaaatgtccaattcagttcctcagttgcattagtcatgtttcaagcattcagtagtcatgtgtggctagtggctactgaattaaacagggaagatatagaacagaatgcattgatcatcacagaaagctctatgagacagcactggtctagactgaaatatgaagagggagatatttaaacaaattgtgttttcaaattaataccaaaattaattcttcaatataaaatttgaggagtcacttcggaagtgagtaactgtgtaccttgtgattttggaattcagagcataaatgttcacttcgagagactctgatctggaactaaacactcaccataaaactaaaagcacactttacccctaacctataaccacagagtcaatcagtaaacttatgatctggtcagaaagcacttgcaagttgtccaggctgacagggaacattaactgtgtgagctgggtgaagtatactgtatttttttttaacttgaagcttgtgaatggaaagatgatagttctgtcttattactatttttaatttacttgaagcaacattggaccagtatttacctatataattagtaaattaatttctccagaaaagtatttttcattataaaaaaatttagagaaatagtattcttgagatacattacaaatccttcttagatttactataaaacataattgatatagatcttactgctagtgactaagtaagtctaccctcccctctgttaagccaagcatataattgcttttcaatacatggtattgaaaaattaacaaagtattagtattttccataaagatttaaaccttctatgttgtggcttctgagggaaaaggggaaaaagattttgttatttaaaaagttttttattttcctgaattttaatataattttgtttatatatctttaaaagacttttattagtacctgtaaataatatttttacttgttccccaaagtcttaaagaagaaatgagtctaaaattttttaaatgtattcatatttctcataactataccacaatgatttgtatagatcaaatttgaagagccatttcttttttaaaaataatcttcttgcttaatttacatgttttataaacacgaagagctgcttcacatctcatttattaagaaaataatcattgttgaacaaatagtaatgtgaggcaataaaactgagcttcctctagtctctgttattacacagctctaatagtttgcaagcattagtatgaacacagtgagcagataattacttaataatagtagaagcagaaaagacagggttcaaaatatagacttttatcagtaatataatttctttatcaatattaatcattaccattttgtcatcattattattttacatgaaccttcctgaactagagcaaaacaaagatctcatgtgatctctcttcacctgactcccaccatacctggaaatgaaaagagaaaaatatatagcctggatgataattgtcaatttttaatgatatttacaaatttcatggcatatggaacttggtggtaagcagcatatttgaaccaaatgttacattctagccattgatatcatctaagtaaaactaacattggctctaaaaggtgccgaataagaatcaaagtgtagaatattcttacttcctcaggaaaagttactgaatatatagtcatgaaatattcaaaagtaaagttctaagaatgattctgaggcttgcctagaagcagaattctaagatgatggctcttttcattaaggagtgtttattttaatttcttcaccccactgttggttttggggggtttgtttttgttttgtctaattacaaatccctctcctttccctgaagggcatgacgaagctttgttcatctctgtacctccagctgccagctcaatgcctagcatattgtggacattcaatatatatcaacttactgatgatcattagcataaataaaatttttaaatatacaattttttctttggtgagatccgatgtgttctaataataaaagtgagaatctttcaagtcagctagagtgagtaaatgttgttttgcatcaaaaataaataaataattaaattacaaggcacaggaaaccaagtaaaagtattgcttgtggtgctggtggaaaggaaaggacttccagaccaaggtacagtattttgattactggagaagagagaagaaacctgttagtgctttggccagtattgggtcaaatgaaatgcctgtggcccagtgtgaatcaccagagtatcttgctaaaatgctgattctaactcagtgggtatagggcagggcccaggatccctttatttctgaccaggtgatgctgatgctgctggagtagaaaggatctagatttccttttccaaacatgtatttccttcttcatggaatttggaagtgtgtctgtagactatttcctctttgtaattttatggagggttagaatcatgctataaaacaggttcttacaactgaaattctgtgaaactaattcttgaaaggaagtgtcttaggtttttctggaagtgtgatacattcataaaaggcacatcactacccagtgaggtgggactctggcacatttcactccttagtgtgtgcccatcactttgtactggctgcctggagcacacagttaaggaagatgctgagtccaagtccagacattcaggaagtgtgatgtgattggttaggggcatgtgccttgggtgcagagagatagtagtacccataactttttcattattttcttggtcaaaataatcaataggacattctgggaaaagacttaatcaaagtcagtcattaaaaggactgtaattaggtaaatgctgcatatgtgtacaacagattaagtaaatagattatattattggaaatataccccattttatagctatttggcatattatccagtcatgtctcaatggtgtttagtgtattctgcactactctgaaatttaaccacctggaagaagttatgaataagaaaaaaaattctctgtcaattatttctaaaggtcatagagttaatgactagctggaaggttaattagattctgaaaacctcttcatatcaattaaatctcttatctttatgttttagtaaataaactgaataactatttagagctactgttctagggtaagaaacgttgtaaacagtaaaactacacaatgggtgtttgggttttttcctcacattaaaaaaaaaaatagttatagcaggcatggtggctcacacctgtaatcccagcactttgggaggctgagacaggaggattacttgagcctaggagttcaagaccagcctgggcaacatacagagactccaactctacaaaaataaaaataaattagctggatgtggtggtgcatacctgtactcctagctacgcaggagactgaggtcagagaatcacctgagcatgagaggttgaggctccagtgagctgtgatcatgccactgtaccccagcctgagtgacagagcaagactctatctcaaaaaaaaaaaaagtattacaaaaaagtagatatatgaattaataatagtaacttattttaataatagtaacttattttataatttctgaattactttatttttcaaaaataaaagtgtgcatattactatttaatcataaacaagttccatcactatgatgtcaaggaggaaaccatttcatagaaaaatagaccaaagttaccctatgcatgagctactactaatctaaagccaacttcactctcagttatttcaataggacataagtttattgattgactctgtggttagttccagaaacccaacccctttgaaagttactgtacacatttgtaaataaatggtatatttagcacctatactatgacaattataaactcatttgtgtcatgtaaattttctttggataatataaccagacttcagatgaaaagacatagatctgcattaatctgtaaggtagcctagccacatgtggctatacaaatataaatataatttaaattacataaaattaaaagttcagcttttcagtctcactatccacatttcaagcaagatgtgactagtggctcccaaatataattgtccattatgaaagaaaccctctgttggacagtaaatgacgaaactggtgcatctagtgttctctttcattcaaataactggcatgggctggccgaggtggctcatgcctgtaatcccagcactttgggaggccgaggcaggcggatcatttgaagtcaggagttcaagaccagcctggcctacatggtgaaacctcatctctactaaaaatacaaaaaaaaaaaaaattagccaggcgtgatggcacacgcttgtaatcccagctactcgggaggatgaagcaggagaattgcttgagcccgggaggcggaggttgcagtaaactgagattgtgccactgcactccagcactccagcctgggtgacagagcgagacacagtctctaaataaataaataaataaataaataaataaataaataaacaaacaaacaaactggcatgatggttaatagatacagcccaataaaggatatgtaaactggagaggttgcacctggctacttcaccttccattcctgcagcaggcatttatgacatgcccactgtgcgtcagtcaggacctgagccagggcagagaaatccaaccaggaaagttgaatcactcagttggcatttactccaaggaacagaatatttgttaaagtctatgtgattttgtggagaaagacgagaaaatggagggatcactgaagctggaattgccctgaggaagaagagaaaatggaaaaggcacaggaaaaatgagtagtaagaacgtagaaataagctaggtcccttgtgaacttttccaacaggaaagaaaagatcatgcgtgcacacggtttcttctgatttttcttaattagtatgtgcggaattttatcttcatccagactccatgattggttttccttaactgtagttgttctgaattaatttcatgtgggggaaaaataaagctacaaagtgatttttctaaagaatattgttgaagcattgttatgagagttcatctttcaaattttacttctaggatataggactttaaaagctccacaaatttgaaggaaagatggagattaaaaattcagttccagttacagcaacatcacacactctcattctctaacggagggcgagttatgtaaccttgctgggctttaggttcctcatgagttaatgctgtctaccctgagctccttacggggctgtcatgaggattgcaggttataacagctgtcagagcccattgtcaacccttaagttttaaaaaattagttttattttcaaagtcaagagaaaaagttcagagaagaaaaaatgctaaccaaaagaaagacaaaaattcttaatttacgactgcatagtttatgctaataagtgtattatttataagtaaatattgaatgattatataaataactgtagcattttacataaattaagaagatctaacaaaggtcaacgaattgattttttttttcttttccacaagtatttattaagtgtatgtgcaaagtatggtgttcacggccctccagggccagtagcagtccatggtggacagaatatacacagtatttgttctctcattcagtagatattgatggacatgaagatcatttgctaagcattctgccagttactggtgatgcatctgtgattatgatacccaattatctgaaccataataagatatagacaaagtacagtgggctaacagaggagaaggaaagcagttacaactgtgagcacctgaaaaatcttactgtagatttcagatgaaggcatggccttgaataagtagaataatttgatatgctaagccaatctgagaaccatttttcccatttaaactaaaagtgagactaataaatgtagtgatatatggacattaaatgcatatatgtatatatatacacacatatatgtagtatgtatatgtagcagcctttattttttgttttctgttagcactggattttttaatgtatggtttttctataaacagatggttataatttctagagaaattccatagaacacaaatgttagaaaaatgcagtgaatttcattgcctttaagcttaataaaaggttcaaccttaaagttgcatcccacatcgttagtttaactttacagatgagatttttttttcccctctctaaattctaaaacatgatacatctggctgagaggctggaaaattgttacatgcctgtgcaacattcttacaacctaatcagttcttcaacttttctcgcagtttaatcattggagaatgttctttgtttttgtagtcactgtttcacatagtaacagcttgttgtattttggtctgtttgccagagggtaggtttatttttaaaaccctgaactctgaatttttctttatttttccaagattgaaagcagctgaaatgcctggagttacaggttgaaggctgcttcacaatatgtggaggaagcttctttccctcctccctttgtgtgtgtgtgctttttttttaatttttccctaacaaatgtcttctaactggtagttgtctaaaaatagaaaactgcttaactaaaaatagcctggctctcagtcgtgccaaggaaaatggagaggaataggcgtggaatagaaggctgagtaatccagttctattcattcagagaaacctttgagaatgcgggcgatgataaagtgccctcaaaaaaccacaggcccgactctctcttcagacttctaggtgccaataaacattttagccccaggatacttttttttttttcctcataggttgtaaacattttctgaaagacaaggctttgtttcagggaacctgacaaactgccataaataactaactttcctaaggtcttaaaaattcatatttgtaagatgtattttaaaagagaatcttaaatgaaagtattgtaaaataatgtacgtcgtgtaataattaacagaggaaactctgttataataaaaaccacttactgcttgcaattaaactcaaaactttaaggagtttcacagcaagaaaattattcctgtgactcattgtaccttaagagagcagctgactcattttagtttagctccctgagacatgaaattctcttgttcagtctgtatccccttaacatgccaacatttagtctctttcttaaaattattattttcactcaagcagatttttacttttaatctttaaaatgatgtagaaactactttgaaaaatagcatttctggagtaggatggcttttagtttcaacaaatggaattctgagtaagtcataaaaaaatacgtgtgtgtgtgtgtgtgtgtgtgtgtgtgtgtgtgtgtgtatgccagttttgcaatgggaatgctttttttttctattttgttttgcttaagtaatctgtaaaccaggtcaaacatagcaacagggtgtggaaatgtcagcacagttcatagggttatacgagtctgagcattgttatgttcagttcctgtaatgctgctggtgataagactcttgagacaaaagacgataattgatggaaagaggcttaaatcattgctagaagaatcaaggtccttgtatctgtgtacatcgactcttctggtctccttccgtcttgtaaagcattttgtcgtcttgcatgttggccccctactgctctttgtaatggatgcagaccacaagtgattcctttatgcagcatacagggtgtaattgtgtctgtgtggtgtattagtaattaccaagctgaattcccatattgtatctttactgcaggcatggaaaaataggacatacaaccctgcgaaaccattttcaacctagatagtgagccacttagagctgtattccagggacaaagccttttacatgaatactttttaaacaaaattttcattgttgagtcatttgtaccatgcaggataaattcagtttgggaaattattacctttgatattatattattcatttctgactcttcagcaaagtctgtaatatggaaaatattggttctttttaactgctgaaataaaaaatatttttagatgtaatagtgatatgagctatggtaactatgctaggctatcatacagaaagagtactacgtgaattactacatataatagattctgtaacatttataaacatgaaataatatagttattttagtagcattttatcttaaacagttatatgttatacataatttatcaatattggctcaagcattgttaaacttcagaaaaagctgacaaaaaattttgttacagtaaacagatataaattattaatttctttgctataaaatttgcatccatcctttatgtattatgtagctgatattgatttgactacctccaaatcattgtggatttgaaatgtctacagtattatctgtaatagaaagccaaaataatgcaagcagcttggcttaaacaaaagaaagtatgcttattctatgcatcaaatgcttataatgacagttaagaaatattaaatagaagtgcaaagaaattaatacagcaatttcattatcgattttcaatgcagttagacttatattgcaaattattcattaaagcattcaagatttttgttatatttttaccttcatttctgaaagtggccttccagtatgtatatcttaaaaatttgcttccacttttatatgtagattttgttttattcaagcaataattattaaattcttaggatatacagaactttatattgatgccaggagaaatacaagtttggaagacattgtctgtgacctcacaaaacttacagtccaattaaggtagaaaatacatgtgggaatcaactggacaaaacaacgtaatgagaactatggggtatttagagggaggcaacatagcacagtgttgaggagcatcagttctggagatagactgcctgagttctatatgtccttgggcaaattacttagactgtctgttttattttttattttattttattttttttgagatggagtttcactcttgttgcccaggctggagtgcaatggcgtgatctcagctcaccgcaacctccacctcccgggttcaagcaattcttcctcagcctcccgagtagctaggattacaggcatgtgccaccacgcccagctaaattttttttgtatttttagtagagacagggtttctccatgttggtcaggctggtcttgaactctcgacttcaggtgatccgccagcctcggcctcccaaagtgctgggattacaggcgtgaaccactgcacccggccaactctctgtttcttaatcccatcgtctgtaaatagaggttaataatactatcttctgcttagctgttatgagaattaaatggataaacatttataaaatgcttagaacagggtctgacacttggtaaggtttacaataatgataacgacgacaatgatggcagtgccgctcctgataccatgtcatcaagcaataagtggtagaaagaagtttaaaaggtcaggacaggcagccatgattggtagtcctttttaggctcaaacaagtcaaattcagaaagatggatatcaattgatgaaaaacgtgggcaaactttcaaaaaaccaagtatgcaaagagtcacaagaaaaaagaaacaagggcatgaaaagtattagcttgatatgaagagaatattcacataaataaaaagatataagaaagatggcaatgaaaatgggaagaagagacagggaaatcaagcactctaaatatttgatgtggaattaaatgtgatacaattggcatcagaaagacactccgtggtctcgagcagtaaattagcataatgacaattcttgagagaggttccgctggaaaagacagaaacagttgtgaaaagtggaagtgccaaaatattttacgttttgtaagtatgtatatgtgtgtgtgctaaaaagcctgaaagctttcaccaaacttatatttttatttcataggacaagttgcttcagaaatattcatataattttagtttgcactaataaggtgcacatgcatttctgtgactgaggactatttatcacatacagtgtattaaaaaagcaaattatagaggcctcaggaggttttttgttgtgtttgttgttttcgttttgcttgtttttatttttttttttttgagatgatttcatgcccattgcccaggcttcaatgcagtggcacagccttggcttactgcaacctccaactcctgggctcaagtgattctcctgcctcagcctcccaagtggctgggaccacaggcacataccaccacacccaacgaatttttgtattttttgtagagacaggattttgccatgttgcccaggctgttcgaattcctgggctcaagtgatcctcccacctcagcctctcaagtgcttggattacaggagtgagccactgtgcctggcctaggaggtttattttaaactatataagcttctttacagtaaattgaaacataaatcaaaatcttataaatttagaagttcctaatgaagtagtgcactttttaatttttagacagagtctcgctaggttgcctgggctcttctcaaactcctgggatcaaaagatcctccttcctcagaacatgtgcagttttttgttttgttttgttttgtttttgacagagtctcactctgttgcccaggctggagtacaatggcacgatctcggctcactgcaacctccacctcctgggctcaagcaattctcctgcctcagtctcccgagtagctgggactacaggcatgtgccaccacacctggctaatttttgtatttttagtagatacggggtttcaccatgttggccaggctgggtcttgaactcctgacctcaagtggtccgcttgcctcggcttcccaaagtgctgagattacaggtgtgagccaccacacccagccaggacatgtgcacttttaatgatcacctaaacaggtcaggattctgaatacaatactgtcaaatatgaaaactctccccttacactttcacatccatataataaaagccctgccctttcataaaaaagacagtgtggtgctggaggagggacagacacacattttagcgtcagacaaacctggtttctgccactttcataaactctgtgatcttgggcaacattctgaatttccaccaagcttcagcttctgaagcagtaaaaaagggataataaaactcacttttggtcttcctgtaagaattaacttatgtacatatatagccattagcacatgatgctcatacaactggtatttattttcctgctgttcctttttgcatatgtaaatttaggcaaaaattttaaactttcacttgtatatacacacgcatactttggacactgaaatcttcagtgtatttggtgcttacatttaaataaaatgtcacattttataaattatcatataatgtatgtatatttcttgtgtaataacgtgatgaaattcttcagaaataaggtcctcactacacagatttttaaactagggaaagggtagaaaaaggaaaaaaactaggagtcaaaagtaattctattaagtccagtcaaaatagagttaaaagaaaaaaaaagtggaactctgccaaatagaggggcttgcccaagttctcttagtgaactctggtagatagcattaggatataatttatttcctggtgtcccctttgaactactttgtatccaagaagaggagttagacaatgagagagaaagtgaaagaacgagagagatgtagggagaaagagaagggggtaggttgattgagatttcaagacaatggaagtaattagcaaggataacacaagtgtccctatgctgccagtttctcttctgacacaaaaataaataattgatttcattgaagtattagtcagtcaacaatgcttagtgtgatgatattgttaacagtgaaatatatatgttgtgcattgcttctagggtgaaacttaagtatctttgccctggctcccgcagtattttcatggcagtgaggatacatactcttggaaatgagccaggaacactctaatgtattacacatgtggcttaataccaggtgaacaggtattttaaatattctaatcacatacccacaatgtatatcgctactgggaaaaggatatcatttttaaccactggtgtttgttctgagccatacctttttcacactctgaagattttcaagacgaactgtgatttggggagggatggccatctcagtcaactttaactgataggaggtacaacaaatttatagttctgaactctgcacctggagtctggctaccgaaatcaaaccacttgctgaccagcataaaaataaataggaaaatatttcagtgttttccacaattgcgtttgtacaaatacaagagattttatttatattaaagaaaactgtagtttttcgttttttcttttttctttttcttttttttttcgagatggattctcactctatcatccaggctagagtgcaatgatgcaatgtcagctcactgcaacctccacctcttaagttcaaacgattctcctgcctcagcctcccaagtagctgggattacaggctcctgccaccatgcccagctaatttttttgtatttttagtagagagggggtttcaccatcttggccaggctggtctcaaactcctgacctcaagtgacccacccgccttggcctcccaaagtgctgggattataggcgtgagacatgagacactgtgcctggcctgcaaattcttatattatgattaggggaagaaatttgttttccattagaaaccaccattaagtttgcaagcattgtaacataaaaaaaaaaaaaaacctcactttgctgaggcctaaatttctatattgaaatattactttctgggggaaaaagataaaatctacccaaaagtacatctaacgagaaataattctgaagattctttcagatgttctgcttcatgctgtacacacacacacacacacacacacacaaacctacacaaacctacatatattcacatatacatgcagttaatgtgagactggcagtttccagcacaaaatacatagcttccatttcactgtgcacaagttcctgtgtcagatcaacaaaactttcattgatttctatctatctgcttggcttcgacaataatgtaatgcaatcggggagggagagtttctaacttctcccagccacctgccttaacctcatgcttcattcatctcggtatagactggattcctttgacaattagtcgatagtgtacattacctcatggaagcagactttgaactatgttttgcttccttttaatggtactgtttcccctcatcttttaacagtgatcttttaaaaagaagtgtgattctgttcagaatgatggtgatggctgtttgagacattttaaaactattaggtggttaatatgtggttaatattatttattcaacagaaaatggactttaagcgcatgtgaaaagcaaagcatcataattgtaaacttcttttaaaagttatacaactttatttagtttcaattttccaaaagtccagtttcccatctgagagacatgggtattggcccggctgtgggaaacctccagagaaaacaggggagctccgctactgcggaagcagagtcagtgactgtgggtggcattttctccgctgagtcaggtcctgccagccctaccccaggcttctaccaacagtgcagattttctggcaagatgcaaaacccaagtgtttgtggttcttgaagctcttctgcagtttctccttttccttggtactttgggaaattttcactttagaagatcacatcttactgtgtcttccttgtaactgttgaaaaaattgggaagtttaagtcatttattttatttttcctctcatctggcctataaagtaacttggtgttatgtgcatgtttttcaacaaacaggaaagggaagagattatatacccatgattttgaaaataatttttatacagcatacaagatttctcgatgatccctcgctttgcccagggagaaacaatagtttctccataaaagcatacatttttctcttttccccaatctattccctcaacccaagagaaaatgtagtcttgtagttaccagcctttgcatcccccatctgctcaagcaaattgaagagaagaggcaagtggttggcttctgcatctgaagaatataggtgccaaaataataaagtggacctttttgttagtcacagagacttgaggttcttgctagtattactctaatcattgtaataaacctgtgcttcattttatgcagataggtacagtctgtatattattgggaaggacttccttcctaggcttaggaatgttaggagttgaaacatttagcagccgggcgtggtggctcacgcttgtaatcccagcactttgagaggctgaggcgggtggatcacaaggtcaagagatcgagaccatcctggctaacacggtgaaaccccgtctctactaaaaatacaaaaacaaaattagccgggcgtggtggcgggcatctgtagtcccagctactcaggaggctgaggtgggagaatggcgtgaacctgggaggcggagcttgcagtgagccaagattgtgccacagcactccagcctgggtgacaaagggagactccatctcaaaaaaaaaaaaaaaaaaaaaaagaaaagaaaaatttagcaccctttcttttccttggggcttcaacaacctacacttcattttaactagatagatagtacctacatattggtgaagggctttcccatctattctagatagtacctacatattggtgaagggccttcccatctattcagttgatattatagcaaaatagtaggaaaaacattttagataatattttttatcagaaaatgaattccgttacaaacacatccctttatgaaaaaataagatttgtcagtcatttcaccaatttcagctgagagtaagtgttcaaaggatacacagatacacaggcatggtttaggcaatccttattgttaaacaaccttgcagacgcagaataatttgatagctaagagagaaaattctggagctcattcatgggttcatagacttggttccaccactcactaactttgtaaacttcagcaagttcttgggccactgtgtgcctctttttttcatctgtagattggcagtcattgtggaagagtagcttgtgaggattaaaaaaagacccatgcaaagccacgggctcagtccctggcacatgtacatgcttggtaaatggtaggtgttattgctgaggaatggattcaattaaaatattaagaaaattaatattttgatagtgatggaagactggtttaatttcctcttcatgccatagaagaggaaatgttgtttttataattacctaatgaagaatctggaagaaatgattttgcaaatgatacccttaagctcatcactgaactaacaaaataactgagatttcataagttatggaaattgaaatacctaatttaaaaagtcaagtttgcagtacatttccatggataatgcctgaagttattgaagccatcatgactacaaaatcaggcagccaggaggccaggtctacagagtctgttcagagaaggctgtctggggccacaggacagagtgcgccgtggggctggcagcatgcacttggccttgttgagttagacaacaggtgccgagccactgccaggtgtggatatcaggatgaacaaaattgctgatggcctgtcataaagctttatgttagatcataaagtgctgagcccatatgatgagagatgagttcacatagcaagggatcacttgaagtgttcacttgattttcccctccctgtctttcacacgatcttcaaattctctctttttcactcattttcattccttccctctctccctccctccctttctttcctctcccccttccagtatttttctatctatttataacctctgtctctcattcttggtattcttatttttaaacattttctaagtagaatgacggttactggaggccggaaggggttgaggttaccagaggctggaagaggttgatgagggcgggaatgaggagttgttgatcaaagggtacagatagacagagggaataggttttgagagctactgcacagcagggtggctatggtcaataataatgtatttatatttcaaaataactaagagaataaatttcaaatgtctcaccataaaaaataagagaggtgatagatatgttaattagttagatttaatcatgccacattgtatacacataacaaaatggcacattataccatataaatatatacaagtattgtttgtcaatttaaaataatattactaataatttttttaattatggggaaaagttcatcataacagttaacaaattgattaatgaaatttatcttaacaattttatgaacaccaaagcatcatcaaaataaaagtagaagaggcatttgatgaaattcagtttctattaataaaaattcttaatggactaggaatagaaatttccttaagtttatgaaatatatcaacaaaaagggttcatagtaagtgtataatggtgaaacatttggctcattccttttaaagttataaatgagataaatatgctcccatctctgctttaagtcatactgagggcctagtcaatggaacaaaatgagataaaaaaataaaatgtatataaatcacacacacaaaaatactctctatacccttccatttttcagttctcagtgtcactctagcttttatagcatcatgtgaaatccaaggtgacaatgcacacctaagaatattatcatctgcataatatatgcagtcatgggaaatgagattttgtgaagtaataattggtccatgattctggactgtcgattcatatatggatagcattcagagaataaggaaaataaattgagatgaatttgattttaattattaatttaatttggaaacataaattttgaaaaaaattaacctgataataaagtaacttagtctatataggccttgattagcatgcagtatcagtaatagtacactttgcaaaatatttcttatgaattatattttatttgtaagtatttaacctagaaagaaggatctatttgccataatgcaatgtatgttaggaattttcagattgtatttattcatgactcgtgtcctctccgagcaattacactcaattcataattgcctacactagtgaaaaaggatccttcacattaataccataaaacagcaggaactgcaatgtgagtccaggcacagcaacccccaataacaaatgagccaggaaactagcaggcaagtcccagtggaaagttgagcagaggaccctaactctgaaatgctactggcacttttgatgtcggtcctagaaatactctgattatttttctggtactagctggaaataattatattgttaggtaagcaaataaaggccctctaattagcaaacttgaaatttacattaaattatgaaattcccagggcccagtactctgccaggtactaaggataccccgacacaaggcacagacctgccctcaaggagcgcagccttgtgtggaacagaggcaggcacacagtggcattgcagcatgcagaactacgacaggactgcaggaaagacgagtttaaataaagaaagccactggaatgatgtcagtgtgtttgcagcagaagccttgagaaactgcctcagaattttgaagcacatttatttttaagcacctgaagctcttatcaaacagtcctatcaaactttctttcatcagacacctacccaagtcaactgaacgtaaaatccaccacttattataaattcacatattaggtgagtggtaatgagataacagctacagaggataaatggattcaattctctccatctctacaagtaatctataatgtgacaggagagataaaaggtagaaacttactttgggaggccgaggcgggcagatcacgaggtcaggagatcgagaccatgctggctaacacggtgaaaccccgtctctactaaaaatacaaaaaattaacctggcgtggtggcgggcgcctgtagtcccagctactcgggaagctgaggcgggagaatggcctgaacctggaaggcggagcttgcagtgagccgagatcgccccactgcactccagcctgggcgacagagcgagaaaaaaaaaaaaaagaggtagaaacttatttgcagaaaagaaacaattatttgcattttaagtttactgctgtgagttttggagatttagtctgtgagactttcttaatgcatgatgtagttgttggtagatagaggtttgttctctgaccatttgacaacatcctgaaactctaacaacttctacctccaggtcaactgttgaacctgcaaggagccttttccccagatctctgacttccagtcggcctttctgcctcttgttcactagagagtacatcctggtttcctgtccttatgctaagtctgatgaaaccccaggatgtctgtctgctggcttaactggccctggatcagcaactgtcccctgaccagcaaccatctacccattatacctttcactgcctctgttaagcagaaggtttgccagtatatgaaccaatacagtgaaaacactaatattgcattagccaagtcccaggagagattttacatggaaagggagaagtaatatacaagtaagactagagaccaagactgctcaccttttacagacctggcaaacctgactaaaacgcgagagaggtttggttttcaagggggaacatttggattcctagccactagcttttgcttagtctgcctgagcctctccattgtatatcatcaggctgtccttaccattagtcccctgtaggacacctatccagaaaagttaaccaatttgtagcaacattctactgtcagatatcctactagttgccaaggatggaaagtcgtcaggagacttcctgtctgcaagaatcttataatctagaaaatgatataaaagcagaaaacagatagcaacaatatgaaataactgttcattatatagttctaaggaagaataaaagagacattaattctattaactctctcttccacgtgattttttccttttataatttaagtttatgtacgaggatgggggatggtggggttgaggggcagatgttgctaagggtagaatcagtgtatatgtacagtatgtatacaaacctaataagtgccctctatgtgtttttagatttcattgtaattccattttaaataagaacttctgttgctacagccttgaattccattattctttcatcgacaataacaacatttattgagtgtcatccatgtgctgggaacattcaagatgctgtggatacagaggtgaaaaagacaaagattctgctctcatagaacttcgttctaacacactgaaactcttctctccccaggcagccacaggcggctgtgacttacgtattgtgttcccacaatcccagtgacgctctgcactcctgatacttcacttttctctaatcagaacaatatgggtattgagcagtatgtgttaacagttgtcaatggcagtctctgggatggcatatcacaagctcaggcaaaaccctcaattagcatctaagtgtgtttgttcttcacagggcatattaactggggagatagactataagagaccctccctgctcattgctgtcagatcactatagaataaccaaaaccaaagtgaaaattttcaagagtgaatgacttatagccactccttgaagagcaggctggtttattaggaagagggagaaatcaattttaaaaagatttgaatgtcacgtattatgtgggaagaagttgaggataccataaatgaaatctgtgttcacaatccagaattggtccttgaaaaatctctctgcctgctatttaagaaattgaagaatagaaataacttgcagtatttttggtgctgtcccaaattgaaaactgttattggtgatgttggtcctgtgacttaagacatgacaaccacaacatagagaatgttccccatcaggacaagggccagcccaggagaaaagtgggccagggtcaagcccattagatgtctttacctctcttaagcctggctgtcaactgaacgtaaattccaccactttaggttgggagacaaggaattaaaggaaacagctcaatctttatcttgggagttcctgactgtctcagaaatgaggaatttgatatcttaagttctcaggtatgattaaaatagtcatgacataagtcaatcagttgccaacctcaagactttattttgcaatgccttatggaaagttctgtgtatactctgcttttctgataagctggtaataaactggagatcccaactgacagatattctgtaaagtacatcaagggtaatgccttgtttcggaggggagacgtagaaatagagaagagaatgcacaaaggtgtctattgcagtaagttttgttctcaacatgtttgtgtcttcctggcagtaacagagcagcagcagccacagatggcttggaagcccatcatgccccagactctgagcaggtctaaacacagagaaatcccaccatttgtgaaccagttacaatagtctgtgtcacctcctccattccctcagctcccacagggatgtcctgtgccgcaatcttgaagtcattccagatattgctttaacctaccagaacttgtactccttacattttgaggtaataatcttattaaaacaaataaatagtactgtcactctacaagaccacccaactcatttgaattagtgtctgtcactgttagaaagtatgactgtcaagtttgtttgcttattcatttatccagtgaaccataactgagaatcttggttgagtccacacatattacccaagccctgtgttagggaccagagatgcccatttttcacagaactcactacctggtggtgaagcagacatgttaaaaaataaattacagtataacataccacatataaaaaagaggtcaaggactgtacaggtacagaaaagggagttcctgagtgccttctacaagcgttaggaaaaagcttcaccaagtaagtgagggcattaggtaatagggtgtcctaggacaattaaggtttgtgtaactgagaggaggagtaaataaggatattctaggaaggatggaatggcgtatatcaaagcagtgtttctaaaggattgagctgacttgccaaatgacatgaaatttcccccttggccaaaacccagcgatatagtttggctgtatcctgacccaaatctcaccttgaattgttacagtccccacatgtcatgggagggacccagtgggaagtaattaaatcttggggatggatcattcccatgctggtctcatgatagtgaataagtcttatgagatgtgatggttttataaatgggggttcccccgcacaagctctcttgcctgccgccatgtaggacatgcctttgcttctcctctgccttctgccatgattctgaggcctccccagccatgtgaaactgtgaagccattaaacctatttttctttataaattactcagtcttggtatgtctttattagcagtgtgagaacaagctaatacacacagtaggctggagaaaagaggaaatgagcctagaggcaggtggagggttttcaaggagaacagccatccaattagatgtgcattttaattagaccctgccagaagtatgaaggaagattgactggaaggtgggagtccaaaaacaaacagacaaaacacagaagaccaaatagaaagaataacgataggtgagtcaagaaattacggaatcaagggtgatttctgagttttcagcttgaacaagtacattgtgacatttgctaggaagggaaagatgggagagaaatggatgaaggggtaggctggaatccagaaaataaatgggaaaagaaatgatatagtagaagagatcgtgggaaatcctgtagaaatgaggaaatgtggtgactcaaaagatagctcagaagtgactggtgaatgcaaagatgtaggatataagctactcgcatttcaaatgactaatcacgcatagactcaaattgaataaaaaggcatttacaactaggaaataaaaataatgatttgacttattttgatgacccaggataacatctacatcttttgttaaaataagtcattaatggtttatgaaagatgctccaacatgttatttgtaaagcatcagtgcctcaagatacagcctttttgtccctgtaaccaacccatttgcaagtaaaatgccatagtctaaaatgtttagtatgtgaagttacaattattatacattttatactttcaaaaaacctgttctctgatcttatattaatttactcctttcctctctcaacctttgtttaatttatagttctgtcttgtcttttccttcctcatttaagaaatcactaacattgcccattcttcaaaacaacctacaacttgattctttgcattccagcctttcttttcttaacttgcattataaagattattaggataggctggacacagtggcccatgcccataatcctagcactttaggaggcttaggtgggtggattacatgaggtcaagagttcaagaccagcctggacaacattgtgagaccccatctctaccaaaaactacaaaaattagccagacttgatggcacacacctgtaattccagctacttgggagactgaagtgggaagatcacttgaacccaggaggcagaggttgcagtgagctgagatcatgccgctgcactccagcctgggtgacagagcaagactctgtctaacaacaacaacaactatagctatagatatagatatataggattaactgcatatcctatcatgcatttcaattattatatattaaatgttctctctttagtatttcacttcacatctctgctggattgaggatctcagggagtgttttacagctaacgtgtgccagacttccccatctcagtcccattctaggccaactcatgatgcatgccctgtccgggttccaatagaggtttggcggaagaatccttacaaacaccaaatccttgatctgtcctgaggaagcctgaatcatctgattggccccagaatcaccctgattttccatgaattccctcaggcaaatgttggcccagaataagaccaatgtaaaagcccaggagaatagtggagcagtagactagcatccaagaatgggggaaaatgatgaactttgcccaagaatttgaaagcatgcttaattcagatttatagtatctgactcacattcacaaatttccctgtgctctttcctacaaaggttttgtttttcctttgctaacctttaccttctgcctaaaatatcactcccttttttctctttccatgctgaaaattctgtgccctctttcagctacacttttgatcactgagattatatgcttatgactttctggcattaaaagatttcactgactgctcagtttttctgagggtgtctatttagactagtacccctaaattttaagcgttcaataatgtaaaatttgtgagttataatgtttcatacatagtacaaatcacacctacattgcactgctttctaacttaaaaactgtacatttcaaaaagtagtaaatttgggagttattaagagggaataaaaacattgagttttaacgtagtgtgaaatggtagtaataaatggaaaaaaaagagattgcagttgcaaaatactgcactgagactaatcttcctccctctaacatttgaacattcttttctgttctgttcatctattcatttcagtttgtcatgaatgctgcaaatatctagtaagttccgaccacttgccaggccttgtgctaagttctggtgatacgagatgacaaataaactattcctaacctctagtagctcatagtagcaggaagaaaaacacatacataaacaaatcatctttatcaaatgtccagaaaaatcatcttagcatccagaggaccactggcagcacctgacatatagtagcagttagtaaatatgtatcaaggggtctggaccctactacagcctttgcctccagccagccagacagccttggtcaagtcaagaaacctccacatacattaacattgaagtggaaatgtgtgttccattcattcatctagcatttattgagcaactacagtaggtcagactgctctctggtgaaactccaaagtgaataaagcaaagtgctttgttaaggacctctcaatctagcagaggggaaaaagcacataaaggatcaataatgtatgattaagactatagtgggaaaatgtgtagaataaaatgagtgcctgaatgaaggagaaactgattcagcctgagcgatcagaaagtctaaagagaggagacaatgtgtcagctgctctttgaaggaggaacagatattggtgggctcattcctgaaggagagcccagcttgagaagggatgcagaaggaaaggcatgcagcgtttgcaccattattcctcacccactgtgggcatgaggaagggccggatgatgcttggcggtctcatccagactagagtatcaataattagcaccatttgaatgtttatgtcaaataatttgtggcccttaagacagagttggtggatgtttccttgtgttcaatacatgaaaaggctttcaaatctttaattagtgtgtcttttatttccattatttgaagatgaaaatgattcagtcaaaaaaatttcagctccaatattaagattatcttttgaggaagcatataaaaataaaaacaatgacaatatccaaccccatccaccccttccccagtagaagttgatatctggctagaatgagcattaataaataacctagagaaatacagtattgtacagttttatattttcaactttttattaaaatttttaccacaagtgaataatttttgttaaaatctaactttttgtactctgtattggatatgatttgcttgcctaattaaagtctacctgctgattatactagatttaatatattaatgtgtcttcatttctagaataagaacaaagaaaagggactatggtactacagggagagatagtatagacaatgcttacagttttattaaaacctgtggagaaatttcttggcatctaatcttccctcagcctaaggcaaaaaccatacaatgttataagtcaggtcagagctttttagttttaaatttggctgctttcctaacacataagcgtacaaaacagtatctggcacatggtaggttttcaataattgtttgccgaataaattttaaatgaagtaaggcactgggcacagtcctcaaagcacctctctgtagatactaaagggtcaggaaacagcagcagcgtgagtaccagcacaccaatatggaaacactttcaggaaatattcttagaaactcaatttataggcagtattcatttcaactgcacttcctattcctacatgaatttactactttctaaagattattcagcttgttaagagtagatacttatcttcataaagctgtgaacgacaagcaaaaaaatgattcaggatcagaggaaaggaaactaccttttctaagttgatgcttttttttcttggtttttgtgtgaacatgacattgatgcaactaatagtaataattcctgcatgtgttcttgacacatcaaccctctgaagtaaagatcacactacctatgcaacaaagtgtgattacttggatttttaacaaaggttaataggagtaatttgggggtttctccaggtttctctgcatgtagaatgggcaggcacaggaaaaggatgatgatgaaaatatacattcttgaggactgagactgcagacatgtaaagaaattgagtggttgaaagcttttagtctgtgatggtggttctctgaaaaaaagctgaattttacttaaatagcattaatataaaaatacagcttcatataatcgaaaaaggtcaataatttacttatttctttttactaacgagataatttttgaaagaataaaaggaaaaaattttttaaataacaaaatagtatttaagaagggaaaaatcagttttaatcactgcataagaaaaggattttctagttgataacgtaatgcctaaaacaagaaatgagagctccatgtagcattctttttcatttatattcctttcagtaacgaaatagaatctgttcccctaatgaaattctatttcattagaatttttgaagcacctgtcacctatcatcatcagtttgtacgtatttcaagtttttccgatgagcaaatggaataatgcagggtccatatgtccacatgtctgggaggaaagattccacgtggtttttggattacctgtctggactctttctcccatttattgcttggaatatgtcaccttctgtcaatctaattactcctctaggaaacggctgttctcagctcacagtatgacaatcgctgtcttgtgaaaatatcccagaagcctctgtagttgatggatctacctcaacagtgtcactctgacgtggaaagctgacttcagtatacaggcttgctcaagatttacttgagttctctgaggaaagagtttcttcagatacgtaaggagagaagctggtggttttaggagatctcttgccttatcttgacatacatgaataaatcttttcaaaacgtagtcagtcagctgagagacagtatatacatttaggacttccagcccctgtaaaagaatgacaattgaagtacctacattacctgaccagtgacacttgtaaaagatcagagaagctttcaaaggccaacagcagagattttgattttgctagaaaagggcccgaaggaataatgcttatttatccatttagtcagccctttcgttcatatcgactattcattactgtgataaagacagacttggctgaatctaacagaaattcttttgttatcattaaacagctgtagatttttaatataataaagataaaactgctcttatagttccacattcacactatgatattcaagtttgtgccatcacttccattttcagagctttataattccaccataatcatttgttcttggcagaaatgtgttatacaagcactcagctgaggataatatttttgaacatttttttcaatgttctttctggttatgtgattatgggaatttggaactcaatattaatttgctcttcagctttgtgtttgtatatctcaaaatgctcttttttaaataacacaatttaacttgaatcattacttagattcgggtgatattcatagcaagataatgcagtcagatacaagaagaatgtattgggagaaaatgagccacatttttccttctcatcactgccatttcctttgtgactccatgccacctgccttgtttgtttaatagtttatataattcttcaggtacaaagtgagccactgacctaattggtttttttcattcataaactgatgtgttttattgaccaatatgcattccaactcttgactaaaatttgacatctaagaaaatcaatattttagctctattttcatacttgaaattttccctcagcctaattttttaaaatttctacttctttttttttttttttttttttttgagatggagtctcactctgttgcccaggctgaagtgcagtggtgtgatctcggctcactgcaatctctggctcccgggttcaagtgattttcctgtgtcagcctcccaagtagctgcaattacaggcgtgcgccaccatgcctggcttattttttgtatttttggtagagacaggtttcaccatgctggccaggcttggctcaaactcctgacctcgtgatcggcctgcctcggcctcccaaagtgctgggattacaggcgagagccaccacgcctggacaatttctacttcatttatttcagtgtccagtgtactaactatagttacatatgagtgagagagatctagtctgcactcatcacttcacacgggtgggaaaacgggcaggggaaagtcaggccccacactgtctccaggcaggaggcaaatactcgttgactgaccttggaccatcatgcttggccatatgggtttgagacctggcataggtttacctaatctcttcatggaagacttgtgagagataatgggttaatatttgtggagatctttcaacaaagtgtaattgatgtttgaatttttataaaccaaacacaatatctaccccctgaaagctttgtgagaatatttagcacacatgtatgtgccagatggattgtaatgacagttgataggcctctcctcacccttgcattctgttgtcagaaatctgcatatcaaaacaactataatttttacaataagatttattggttaaaagatttgggtgcacactgaaaaatctactgcctggataagactataaattaacattatggaaggctttaaattaaaggtttatataagaaaattattggcagggtgccatggctcatgcctgtaatcccagcattttgggaagctgaggcaggagcatcccttgagtctaggagttcaagagcagcctggacaacataatgagaccctgattctacaaaaataatttttaaccaggtgtggtggcacacacctgtagtaccaactgcccaggaggctgagttggaaggattgtctgggcctacaatgtggaggctgcagtaagctatgaccacgccacactgcattccagcctgggcaacagagcaagactctgactcaaaaaaaaaaaaaagaaagaaagaatatttttaacatgtcttatagataacttttgaaaaatatcaaataatattttcttgatctgacatatttttctctatacaaatgaattctaatgaaaaatatgtggaatataatgcaaaaacaatcagaaagtattcttaaaagctcaaagatatgcagagatcaaagcagaaacacatcataatacaatagttatcagccagaagaatgtttttgtggttgagataataagaaaagagtatgaagcacaggaagttaagttagtaaataaaattattattctaatgtattgtgatgttctttatagtattactgtagaaagtctctaaaagtacttgttatgagtgaaaaatgatgcctgtagatccaagataaggggacaggtggccccaccaattataaattccccaagattgtaaatgtatattttatcatgctgtgtcaaaatattcattttaatattcaaacattttaccacataataagctgtaaccatatgtttatttgttatattataccactataacattaataaatatttacagagccactgtgtatcccagatatattagaaatcatagctttcttgattttttattttaagtgaaaatattcagtgcctcagaaactaattttaaataatgttacatttgttacacattgataagagccaaggagtttagatttttaagactgacacccccctttttaactcatgttgttttatttattttccccaattgcatgaattaaagatggggtgttatctcagctttgaattccttagcttgatgtcacagcttttgctttatttgtatgtgaattctgtctttaataaagatgagctctgctgaactttccattaatgagagacacttaggtatgcatctctttataacggatcttggtggtaccaggaaaattcagaaatgttgctagtctattaataattaacatgacaaactatgattaatcagaagttttatgatctctaaaaacataacattatctctgtaaatcgaattgtatacaattaagttgacaaccgttagtaaaaaaaaataataataataaagcaggccaggttgtggtggctcagcctgtaatcccagcactttgggaggctgaggcaggcagatcacatgaggcaaggaatttgagaccaacctggccaacatggagaaacccattccctactaaatatacagaaattagctgggcatggtgatgtacccagccactcaggaggctgaggcaggagaatcacttgaacccagaaggcagaggttgtagtgagccaagatcactccactatactccagcctgggcgacagagcaaaatcctgtctcaaatttaaaaaaccaagtaaaactcaagactcctaacttatactttttctgttacaatgttacattagtatttattcttctgtgacagctgagactagaccagacccacatccaggagacaggaggttcaagatgaggcactgactttttactttcatgtgtcagtctcagggtgattcctactcagctgaaaaactaggaggaacccttgctagtttggtagttattgacttggttacctgttttcagtgttcttcgtcttccttactcagctcagctgttttcacttttctttccacctgtgtttaggaagagaccttctcagtattataaattttgataagattttcacatatatagaaccctaacaaacaaaagtagttctccatataagcacagcgtctgagcattcttcaccgatgcttggtggggatattagctgtgttctcttacaccctttagctgtcaagtacatcagaagtggaggctgtggggacaggacaccactaatgccaaccattagtttaaattcacacttggatctgtttccaacatttctgcttttgtcatcatcacaggttcggaaatcattgtgtaatgtcctgatttctgatttttctgtgggaagagagtgttgcaatttgccaccttaattgtattctgctgtaattgtctctcactagatatttgaagcacgtaagaattctgtatcatgaaacttgagtccttataccctctgttcattgactgaatttagttgcaagaggaatctttcgcttttatttttttaaactgctgatgagcactcgattgaaatgactcagctttcatctgtggtttctcttccctaatagaataaagcatatgtaataacctgaaatactggacagcttgaacttctttaatgcccctgaatgtctcttacagcctttgtctaggtttgaactttccaaattatgtatttcagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgtaagtactcagaacacccttcattttttttactcttgatatttctctgaacctggcaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgtaagtaccaaaggtagatggctggtctgctgataactgctgcagtaacataccttaaccctctcagtgatggctttctctaagactcttcggaaagtcaaacagataaatagccatctcatcccacgggcagctcatttagaaagcaaaccctaaaggatgctgagattatgtaatctaacagagttgccatcgaaaagttcattctgaggtagaacagttcacagcaggaagagaaagatttatgagacacaccgtaaatttacacaatcttttaaacacacagtccatgcaaatcacaatacatgagtaaaacactggaacctccttccaagcaagtttgagaattgctataaaatacatagattatacattgtttgctaagagcagatactcaagtgggtcagcaattctttcatgtaaactgacaatcatcacctaaataaaagctgatttctgaataaaacttcagcccctctccctatacatgaaattcaacaacagcactgaagggttaaagctaatgctcgctgcagggaacagactgcatgaaacctaatggtaagatttcaacatgtttgtgtgctggggtgattttaaagctttatcagaatattatccgctttgccaccaacattttccatgctttaacatttggctaatttttgttttaaccaaatgaaaaaaattctaacagtcaatcatatgccttgccagatatttaagagaaataactgcatgtattattttgttgtccacatatataggaggaaagtacatactttttattagattctgtcatcaatcaaataatgttaattttgtggcttaaaggggtgaaacccaaggctcacataccttctaaataactaatgttagtgtctgaaccttaattgtatacaagctcctcagtaggcaatcagttccttttgaaaaaagttcattttttgtaagttagcaaaacagcctaaacctgagaaatgagagagactgaagtgaaaatatgttttggtgattacaagtgcagatatgtggggacaaagttcgaggccaaattcacaactgcactcacaagataaattaatactttaccatagtagctgcacactcaaacctgaattgaattaaattgaacactttaaaacttatttacaaaatgtgtgcatattaaaatttctatccttataaatacctatctgcttcttttgttaaatgaaatgtcagcagtagaacttttgttgaatcagaattattaatacactgtatcatgaaggaaagctaagtgctgtaaattcttaagggtttcataaaactgactattatatgcgcacattcatagtgggcactttatgaaatggagtatttagtattatatgtagccatgcatacttgttatgtccagaattattaaataataaaatatccattggtattttattttgcctagaagaaaaaaagaagcggctcatttgggccaatttttatttttatttatttatttttatttttgagacggagtttcactcttgttgcccaggctggagtgcaatggcacgatctccactcaccgcaacctctgcttcccaggttcaagcaattctcctgcctcagcctcccgaatagctaggattacaagcatgtgccaccactcccggctaattttgtatttttagcagagatggaatttctccatgttggtcaggctggtctcaaactcctgaccttaggtgatccacccgcctgggcctcccaaggtgctgggattacaggcgtgagccactgcgccacgccatttgggccaatttttagttcttatgatctgagtttatcttgctatataatacattggtgtggagcagctgtgcattaaggtttgtaagtgtaggatgttaaggcggagtaccttaggtgtgtcagatagtaagaatcccctgcacagttggaataaagacagatgtatgcagtactgctgatcactcaatggaagcgatcatataggtggagttttaacccctaaagttctggaagaatgcacattggatcttgtttctcatactttagggagagagacatgtaatacacacctgtattccctcacaggatttcagcctgttacgtaaagagttcaagatcaagatacgtgatttcttaaggggtgcagtggtgtgtggtaggggctgaaaaaccacattagagtttacgggcagagctgtgagaaggagccacccagctccgagctatgccacagagtctccatctctttagtaagtgcttcagtcttcacgatgaaaagcccagtttttgcacatcgctctgagttgctggaagtcaattttgttgaaagtttccacagctgctaaaacatttacagcagggcaaggacactctgccctttgtatgtagagagtgtctccacctctttaaaaacattacaagactgtttttctatttcgaagacccagtttgaagagtttcccttttaaaacagaaaatttaatattgcagtcacctgttagcatattgtaatttatgcccatattcctcaattacataaaataattcatgggtgatttggaactgtgtcgagcagcatttcctcatgctgggttcgccatggttcatgctgggcttcacagcaagagaaaacacctccgtctgaggaaccagcagaagttaggaaaggggctgaatgaatgagaggcgggtgcaagttggttgagagtaaaagggaagggaggaagtggaaagaaacagtatgtattttcttcaaaataatgggctgtgaagagagagaaataatgttgtatgtaggatcaagggaggagttaaaatgaaagcgcttgagattatttacatgcagaggagaagtgcttggaggaaggaaaagattgaacatacaggtacaatggagatagaatggcaaagcctctcaaggaagggaaggaggatgggacctaaacaagaaggtgttacagatggagccaggtgtagctaaggtggtagctgggtagaattacgctgagtaggtgaccatataatgacctctattttattttatttttattttttattttttgagacggggtctcaccccgtgcctcaggatggagtgcaacggcgtgatcctggctcccctcaacctccgcctcccatgttcaagtgattctcctgccttagcctcccaagtagctgggactacaggtgcctgccaccaggtctggctagtttttgtatttttagtagagatggagtttcaccatgttggccaggctgttctggaactcctgacctcaagtgatccgcccgtctcggcctcccaaagtgctggtatcacaggtgtgagcctccatgcctggctattttgttttttaatgtatttagtttagcttctgtagttaattagggaagggggaagcaggtgattgaaaaaggaccgagaagttagacatcatgaggaataggagttggagagggaatgaacaagtccatgatagacttgtcaggcagccttgagggaatttagataaccagcattggtactcacaagtcatcagagttgtatgattttttttttcctctactacagcccagcagctggtaatggttaatcaaaatttaaaggtgtcattagtggcaaaaaaagggtggggggaagattcagttcaatcactcacattaaataaaagagggcccattaactaaaaatattttactttaactattttatttgatttttttattggacttttccttgtggtaagtttgggaaaatagtgggttttggatgagagttcagatacttttctgattatgactcactacagtaaccgtgatcactttgttcagggatagaaactaaaagttttttagctgtcatgtctgtgtccttcaaagctgggaccggcttcatgggccctcgacttggccctgttctcatagggctgcacttggttaaatactctgctgtcattgtcttgaagttcttaatacttttttaaaaagggcccccacattttcattttgcactgggccctgcaaattacatagccagttctgctgacagcatttcatttaatcaccccaaattctctctttcttcctatcttgagtgtttgtaaaaggtggagcctggccctgaagtctttgcaagtttggtgtttttaactactttttggctttcattttttagacaaaaaaaaaaattgtttaaatgtagatgctttcaagtttcctaattttgaaaagtcaaggagaaaaagaataatgccaatttcttagaaatatttatatgtgattatagcatttgcattccctaaaatgtttagagcagcttcatctcttcatagatacaaccatttcatgccttagataagaaaatcaaggtcaagggagattaaatgacctgcctggttagatggcaatttattacataacctggactgtaactgagattcctgatagaaaggctagtgtttattctgattctctaaaatatcttctcagtgtgctcatttttaagcttataatttgctttcaaaattattatagatagttcctttaactcagaaacagaaaatctaataccgtatgttctcacttagaagtgggagctaaacaatgggtacacatggacataaagatggaaataatagacactggggactccaaaaggggggaaggtagcagggcggggtgaagtttgaaaaattagctcttaggtacaatgttcactatttgggtaatgggtacactagaaatccagtccccaccagtatgcaatatatccatgtaacaaacatgcacatgtatctaaaataaaattaaattttaaaaaattattataggtagttcttgatacaggtaaagcaaaagattaatagaatacaaatgatcttggtatattttatgaattttgaaattttcaactatactctgataccataattatatttgactgcttagccaatcacaaagtagttttataataatcattatcatccagttgtttctgatccagaattctagaagctgaagaattaattcttggggataatagtcagaggaaggaaggagtagaatgactttcactgacctgcttgtttggatggttctgaactcattacataattattaataatcctctttattttggatgtgcatataatcacccaagggtgaggggatatgggctttgctctctaatgagacacaaccaacattctatagcatattcagggaagatatagttttatagcagatccttagatacctattaacagttaaacatttataagtagtaacagtgaattcaaattaaaacatttgtagcccagagatggctttaaatacaaactctaagcaaatatggaaaaggggagtctttaagatttattttttcctaaaacctgagacactccagtgtagatactcacccacatttcatgagaacccatttagtttattatttacatggtccaaagataataaactgctaatatctagcccttattcacttaacagaatgatttctgactacagtattttatttctatccaaaaacttatactgtgttgcatagtgtttggtagcaaaagcaacagactcagtcactagttagatgactttgggtcacttacttaacttaccaatttgaaaaggaaagaattatatctatggtcaagggatgtttaaaaggttaaatcatatcatgtatgtcaactatacagcacagtgcctgctcaataagtaatatacagtaaatagaagctttacttttgtgtcagtagagtgtcttcctaaaaattctcctttgaagaaaaatattaagttcgtataataagaagtagagtaggctctgcattgcctcacagcaaaagggcactatttaaccaacatcataaatgattttataaccaaggagaaagaagagcaggagaaagagatcaggatatgggcaaggggcaggacaaattgcaggattaaatagggtggtcagcgtgggcttccaagagaaggccagattttgagcagagacttgaaggaggtgatgcagttcgtcatggaaatgaggcagggaggcagaaggtgttaggcgatgagataacggaggttggcaaaagctagagcttaatagggcctgtggacccttggaagaaaaaaattctcatcttgagtttttattctaagatgagagccctcacagggttttgagcagaggagtgttggcatgacttaagcttttaaagggtcaatctaatttctggtttgaaaatataaaggatggcaaggaccggagcaggtaaatctgttaggacgtgactgcagttatctaggcaagagatggcactgcttgagccagtgtaatagtcacaccctccagtcattttgatacccaaagatagtccaacagatttccaaaatgctccctaaggagacagtcccacccctgtagagtaccagtgttctagatctagagagttactattatggcccaaggttgcagcaggaaacagatggcaaactctaaagggtaattgaagacagtttgttaaaaggactgtttacagatgggtagagttaaggaaaacctgagagaataatgaagtacattagggcttgcaacctagaagctgttcctatctctagatctgaaagagtaagtggaggggaaaagtaccagatcacagcaagatctatgtgtataggagagaacaactcaaaaagagatggggtcttcgctagagaaacgcagcctcagccagcctgtggcccagcaaggatgatgccactataaaaaaataccctgactttgctcccctcctgctctctgtgctgttgctggtgcctcccccactgaccagtgggaagccagagggcaggagagcctggttgatgcagtctggagggtcagctcctgggcacacagtacagtgaaggggctagagggtgggtctggatggagcaagtggagaatatacctagtagaatcactttactttgttttcttgggtatgctagagcaatccttatttggccttttaatgaagaaatacaatattttattcatgctatagacttcgactttacagcatatgctgattttttgttgttaaaagggggctggacatgtaaggctaaattcattatttgatgtcttatcaaacatttatattccattatgtcatgatgtctatccaaaaattatttcccctgtttactgtagataaatcctaataaagactgaccatattacttatatcacttgaacatttttatttccctctaaaacaatgacagattgggccagatgtggtagctcacacctataatcccagtactttgggaggccgaggtgggcggatcacctgcgctcaggagttcaagaccagcctgggcaacatggcaaaaccccatctctactaaaaatacaaaaaaatagctgggcgtggtggcacatgccaaccactacttgggaggcagaggcagcagaatcacttgaaccagataggcagaggttgcagtgagcagagatggcaccactgcactccagcctaagcaacagagtgagactgtgtctaaaaataataatataataataaaagtaaatatgaaataaaatacaaatgaaaaatcaaagatgtgtgaaagaaaagagttttgaatgtaaagcatttgctgttgtcaagattgacatgtccagaacatggaagaaaagaaaaatgggaaattaataataagggagcataaacataaacaaagaaaagtattgtgatcatcaccaagataaacagagaaatattacacagaaagatgtatgatgcaggccagccaaccaaacagtaacagaaagtggatgtcagcactaagggcaaacaatagtaaaaacaaaatgggaccaaaaaaaacaaccaactgagcctcaagcacatatgcatttaaatttgcacaataacttattgagaacccccaagggaatgccttaatgccttctataaatcctattccatatatatgtccattttatattaagaatgccatatgctttgataccatatgagttctctggcattatattcaaagagtatttttactcgtaatgcttaaaaaaaagtagctacaattatgttcctatgttcatctagttagtacagcagaaacataaacatgattttgcttaaattgacaaaataattactcaaaaatcaatcattgaaacctggattaatctaattagacatccacacagcttcagttcactaaatatttgccaactttcacaattgagatacaggtcttgccatttgtcagtggcggtacacaccaaaatatgaagcatagtgttttctgaattaccacttcaaaatgtgaattattgaatgatacatgctctgttgaatcttgtatgttaaaatgcctattatctttagagttacttttaaaacatagactttaaaaaatgataattaaggtatatgtgctatgcacatgcttggagatgattttctatcattaaacttctacataaatatgcttcaataagcaattaaatcaaaggcttcggtttgcattttaatcctttttctctgtgaagtcatcacaatcaggcacctttgatcttgcagtcatttctggcaccagattcagatatcacaaatgaacaattactacttaatagaatggaatccaaagacaatggagtctaatgaaatggggctttgttttaaacaaaagtgaaacgttttttaatggttgcaaagaaggagttctaagcacatttaagaaatcaatttatgatctgaacgtcttgagggctcttcttaatggtcttctagacacaaagtagtttggaatgtagaatttttcttggaaaaataagggctgtctgtcttgaagagcttctgttattaattcttttcttttacctttgttttgttttctgttcctgcaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtatgtcctcataaggatgtaatgctaacaaatagttggaaggaaccattttcggcaaagccaacactgctttatctacgagatgttttctggttttccacttactctccttcatggcttaccatccacccccgagctaggtctcctgcatgatagagcctaaattctttagtatgtttttcgaaatctttcataatctgccgtttatctttttcattctgtcacctatctcctcctgtggctatattttaaccacatactctcaaacaggatgtcagatatcctttctccacacttttacttctgctcgtcctccctgcctaaaatgccattttccctcttcctcctggccaagctaccacttctgtgaaaccttcccctgtgttctgtgatagtatttatcccatttagttatttattatttgggtcaatttttttttatttatacagtaacttatcccacaaaggacttaggcagaaaggaaatatgataagatagcatcatttgtaagacatgtgaaataaaaacaaagctgaatcagaaatgaagttaattaaacacatgtacacctgccacaaatttgtctctgcacttttacttgctgttgttcaattcacagtgtccaagagaaaaataaattatttctcagaaaaagttcatccattcttagtacttagaacaatcaaaatacattatgatgaattgtatttaatatatgtctattttgatactggatttaaagaacatttaagggaagaatgttctcttgatttgctaaactaacagtaggaaccaagtcaatgcgtattgaatataacaaaattattcctttatgtttccagaagcagcatcaaaaataattgtatttctaagtcacatacagcaaaccattatatatttgcatttcatatttttaaaagtactctataggaaatttttaatgtatcctacatacacatagctgtatgaaaatagtttattcatggaggaattttcctgtagaatacttatatatctgccttacaattaaaaccaaacatgtattactatttttgttacagaagctttatatagaaaatacaattaaattcatccaaataaaaaattttaatcttgagtctgggaaatgtatacaaaggacttcattgagccattctcttgacttttgaatatatttgaaaattttcgtatgaattttcagtaaccacatgtattcctttcagatcatactagaatgcagttcactttcctatttgataaactcatgctcatttttttgaatttgatacggtatttccaaaatattatctgattggaaataataaacatttgcttaaactgtaacgaaggccagatgcagtgggtcacgcctgtaatctcaacactttaggaggctgaggtgggaggattgcttgagcccaggaattcaagaccagcctgggcaacatagagaaaccccatctctacaaacattttttttttaaattaactaggtacagtggcttgtgtatgtgttcccggctactcgagaggctggggtgggaggaccacttgagcctgggaggttgaggctgcagtgagccatattactgccactatactccagcctgggcaacagagcaagctctgtctcaaaaaaaaaaaaaaatcgtgtatatatatgtatatatataaacaaacattttcttttaattccaaaacctgaaccaactaataattacagagtatcacttagaggcaattagaaaatctagatgatattctcactattattcttttggctgaatgttgtttttttcaaaactaaaagtaatttttttttttttgagacggagtctcgctgtgttgcccaggctggagtgcagtggcaccatctcggctcactgcaagctctgcctcccaggttcacgccattctcctgcctcagcctcccgagtagctgggaccacaggcacccgccaccacgcccggctaattttttgtatttttagtagagacagggtttcaccgtgttagccaggatggtctctatctcctgacctcgtgatccgcccacctgggcctcccaaagtgctgggattacaggcatgagccaccgcgccaggcccaaaactaaaagtaatttttatgttcaataccttattgaaacatcttgactctcataaataaacattgccaaattttaacatactgtctaaagttagcaatgaataagcatatgtttcttaatctgtggccggtgaaaaatttgttatattgtgtcagtcaataagattttagtagtaaatgtgggtagattcatgaaacgatcaaatttctggacaattaacattgcacaaaattaatggcataaaacatatttacaaagaactaaacatcaaatgtgaggtcatctgagcatatagtagaccttactctttctttcactttctataaaacatctgcttagggaaaacctagacttagaaataataaaaatgcagagaccaaagactggatttttttaaatgtaactttcttagaaaaaagattctgcaaaatgtcagtgattgaatgtatttttaacgtttgagcacagcatggcacaataaaacaaatgtcagccatctgacttgggttgtactttacaagtttatgactattgcaagaggacaaaatactgaggttgctgaaggtaaagtgttttgttctgtgggcctttagcctttctcgttttgatcttcctctttaatccataggtggtctgatgggtggagacctcacgtctggtgcaggcaccagtgcaggtaagcccagactccatactgcagtatgtatcattgttctgagttcttctactaggtgatttgcaggacaaagtcttttgaacaaataaagttaagagatctgtgagaggcatggaaaaatgacaccaagaatttttaaagcacttttctgaagcaggagtggttaaatagtaacttagaagaaaactatttattaactagaaccttccttaataaagcttcaactggtcagcagagaattaagggctctgatccaatcaacttaatcctggataccatccttggacacaagagtacctttagcaaaccatactttttgtgttctctgttaatcatttcacattaaatatgaatcattttccagccaaagaagtattgaacttctatgcatttctaaagaagagtacataaagaaaaggaggggttaagattttaattattcaacaatactgttaataaaataaaatcacattggcattaaaatgagctcttagacaacatgaatataatgcatccccaaaagaccctaaaatatatttcagctaagaacttcttacactgtgaccaataattgtctcagtcacatttctccaggtttccgtgttaatttgtaatattgagattattgagatatcgatgtcattttcaatgcagaggcaagatagcacaatactttcaaatgccaactgcagttcactattggcataacaagtaaccatggtaatttctgcagctggaacatgctatacatttaaaatagtaggaggcaggcatgaatgacacaaggttatgtttgaaatgtcaaaaaaaatcaagtttattgaaatagacatggatagcctaattaaaatattttgccagggtcaagtagaatagcctgctaattataagaaagaagataaagaaaattggtttacaaatacatttttataaatatatctatttgagggtagagtttctctgttctgatgctggctcttcactaattcactgaataatgaagaaaaagtattagacctacacagtgattagcaaacaagatgaataacactagcttcctattttatatatcttttgaaaattaggtcgagccaaattagtgtgtaaactcacgtagtattttgctggacatggaaatgaaattttttccctcaaaaaatactttgtggtttgtagcctcaaaatgagagaaccagatcaaatccagaccaatgtttcttggatccaagtctctaccaaacactatgattagaaagaatggtgaggactgagaattgggtggtcacaaagaccaagatataatataagaaaaatggtttagatgttatgatgttttacccaatatctcactgcaccgatttgcttgccattatggaaacagctagtagtggttctgaaagtcattaaaagtagtaaaaaagggccgggcggcggtggctcacgcctgtaatcccagcactttgggagcccgaggcgggcggatcacgaggtcaggagatcgagaccatcccggctaaaacggtgaaaccccgtctctactaaaaatacaaaaaaattagccgggcgtagtggcgggcgccgtagtcccagctacttgggaggctgaggcaggagaatggcgtgaaacccgggaggacagaagccttgcacagtagagcccgaagatccctgccactgcactccagcctgggcgacagagcgagactccgtctcaaaaaaaaaaaaaaaaaaaaaaaaaaaaaaaaagtagtaaaaaaaaaaaaaatgtggaggaaaacatggcctactcagctttgatggaagtggcttgttactgcttaatagctagaatgctttggaatcctatattgaaaataaaaagtgtttggttgttcaattattctgtcattgtcaattcccagacagttggctaagtttaatgatcctctagggatagagaagactctcaatcctgtaggcataaaagtttgacacacgtaggatatagtaacattgaactaacaaaatcttatgcacttagcaaattcatcctcttacctcaggacctctaccataggtatgagaatcttctaattcagaaatagaagaaaaccaaaagaaagatactgaattactccaccctggtgataataaatattatatcttgattgcatattatagctacgagcatgtagttttcacagtttctatatagctgtgaaagtgttacccatattttaaaaatagaggaagaagccctttctaactctggtcccaaggaacacctgttgcagatgccacttagtctcaagcttagctgtcatgtcctactcataaactcagccatcttccccttctttctcatgccaaccagtatcatatgtcaggctgaatatatccgtgctgatgtcagagaatcacataacaccagaggaaaacaaggccagccagaatgttgctacattttcagagaagaaaaccaaagcaaaaaggccaaaatatagcttccaaattttgcatattgtcattgaaattcaaggtttcagataaagtttgaaactcttgaggccaagtggcgagactgcaattacgttactttttagcagctgcagtttttttctgaatcaagtcatctcactttgtaaaaaaaaaaaaaagtgagagggagggagagtctcatgaggcaaggaagtaaattgaacatttattttgtgcctataaatactaaaagaccaaaaaggtaagcatgctttttttcagctcagttttatcataaagtgtagcatctttcccatccagtgcctgagccatccttttctcatcataccatcatccagtaagtttctagaacatcctaattcatctccctgctttatattgcatcctgcttcagtctccccaggactgcttgttctttcttaaaaccttaagctaactgtaggtcatcattcacatgccaaaaatccagccatggcttctctttcaaaattaacagtgaatatcttatccctaggcccattcctactctccagccttaaccttcttcccttctgccactgctatcaagaacccggccctccagctctactaacagtagacatctaaactgctcttactgtgcactctacaaaaagcatcattctcataatagtcgtttaaattaagtgttcacattatgccctttctacagattaggaaactgaggcacagggaaattaagtaattgcacaaggaagagcccaggtagtcaggtcccatactgtgtgtttgtatgtgtgtgttttgagacagtgtcttgctctgtcacccaggttggagtgcagtggcacgatctaggctcactgcagcctcaatctcctggtctcaagcagtccacctccctcagcctactgagtagctgggaccacaggcatgcaccaccatgcctggctaattttttaattttttttccttatagagatggggtcttgctatggttttcaggctggtcttgaactcctggattcaagcaatcctctctccttggcttcccaaagtgctaggattacaggcgtgagcctctgcacccggcctcagtgtgtgctcttaattgctacactgtgccgccacttggcaatgtcacggccgcttactcttacctatgcaatcctagcatgcctttccttcttctgcttcatgctattgagcactctttgtcatcccacagaattcagttcagccatttgagaaaagcctttcctgactctaacagacaagttatgcacctctttcctgtgcttacatagtagcctgtaccaacattacatttctcattgcattatgattgcaacatctgggcacatctctctaggacgctcagctctgtggaggcaaactctttctcattcagtttgtatgcccagtttaacacctaagcgttagcacacagcagatacttggtaaatgtttgttagctgagtaagggaaaaatagatcttctagccatgaagttttaatagtgttgatgtaaaccagaaggaacatttcaaataaattatgtaattttcaataaaaaaagatatacccttgatctgtaactcacaaaaataatgtattcttctgaaacagtatacaacgaatgtttaattaaccatttgattaaatggctgagtaccctgggccaataaagcaaagtttcattaactcctctaatattcttaacggaaaacctgaagagctgacatatagtagtaaatgaaatgtgggttggtatctcagaccatcacaaatcacctcttaatacaacttcttatcatcacttaacttgaaatactttcaaagatgaagacaaagggtaataaagaagtagcaggatggagttgtactcttggtataagagaaatatacagcaagtcattataatacattagttagtaacagtgacttttctaaggtttcagttgatggttattcatccactacttaattctttcctcttaacaacctaaatgaaaagtcactgcttttaaaataacattttgtcataactctataaaacttttttttttgagacggagtcttgttctgtcacccaggctggagtgcagtggtgtgatctcaggtcactgcaacctccgcctcctgggttcaagcaactctcctgcctcagcctcctgagtagctgggactacaggtgcacgctgccatgcccagctaatattctgtattttagtagagatggggtttcacccgttgtccaggctggtcacaaactcctgagctcaggcaatccgcccacctcggcctcccaaagtgctgggattacaggcgtgagccaccatgcctgaccacattaaagcttttaacatgctaatctgagtggttattgatgatggtaagatcaagttcggttgttttgtagtcattagatttaatggaaataaccattagcagagcaatgccttgtgttggattattcactatcccgttagtatcctttgttttcactttgataatacgattgccttttattgagtagaaaggaccagtatgctcaaggagttattgattcatagttgagatcaaaaaaagagaaaaaagaaatgaaaaacctttaggaattcctttgaacatttaagataattttacaatctacatagctatttgacagtaaggcaaaggagatttatgtatattggttaataattttaattggcatttattgtaaattagatataattttataaaaaagaaactaacatctgttttcttattttgaatgttaattgttgactattttatgcatttggttatcaagcattgtcacttctggaatgcttaatttatgtcagctaaatacatggagagttgatggtggcagtgtactgccgtggataaatattgagcagtgaataagagatctggtttccagactctggaaagactccatctagcaagaccttaggtcatgactcagcacctttgaacttagtacttactcagattggagataagaaacaaatatttttacaatccatttacacgcaatgttttatgataatataatcataaaattttgcttatgtttttgtaattcatctagcattgaaaaagaaaaaacttagcatattacaaaatagaactaagtggaaagaggaaaggtcagacaatgcttaatttttctgtaccagcaccattgttttgcaagtatttgttttcaagaatacttatcaaaaatttcttggctgactttcttattggccagaaagacttctctgcaattcttacttagtgacttaaaatatcagtgaagtggttaaaaatttagtttaaaaagttggctttaacaagtttgcattttttgttgcccaggaaaacataacttaagattgcaatattcaagaaagggagaaagatacttaattaccctcaaataagaaaactaattgttagtataaagatataatttttatattatttttaaaatattattaagcagcaaatgaaaaaaatctaggttaatagttgggttctgttttgaaagtattgttccattagtttgaattgttctgaattaaaaattctgaattcattagcagttttaccttgggagttcacccaaaacataagtaaataactaacggcattgctttattattattatttatgaaattaagtaacaatgatatttttaacccaaaccaagtttatcaagattaaagaaaaaaaaaaacctagtcctcaaattagatagctacagcatgtggtatgcagctactgccaagaaaatcagtgttcactttccatatacaaaaccaagcaaattatagataaaccattaccttgataccattctctaggggctcatgttgaagtgggaaaggcaggtcaaagacaagacaaatgaaaaatgttacaggttaagtcaggatgttgtaaaatatgccttcgacccctttggtttgacttcattcttaaggagtttgatttccagaggaaaaaaagaaaattttaggttataacttcctagagagtgttttagcagattttagagccctttgtttatcctgatttctgacttcacaaattgtatcctttttattctctatccttctatatctacagtaaagtactgtgaagattggtttctttactcatatcccattgatttaacctaatagtgtgaaggataagaaaaccttggttgtttttaatattaaattcaagccgttaatatttccccctgaaatactagttttattcagaatttgtctttttttctcaaagcagtcttttctctttatacacctattaggttcctcttccctatctttggcatcatgataagattttatttggagataacacagaaaggaaagcttttttcataatcatcagtgatgtgacattgtgcatcagtagagagcagatgctgaaggggggatttggttaaaaaccccctcttttggaaatcagttttttacttaccagggactttctcactcggtgcttcaaggctgtcagccaagagtataatctgctgtttttagacaaacctttgccaatcacttaaattttgcagttacacttacatagtatgtttcagttgaatttcaatccaaagaatatttagtcatgatacagtatcatatttgaaagatcattagctatgttaaacttaagtattataccaagaaccttggataaacagtttaaatttataaccaactgatacgtccaaaaggtgctaagtgttcactgtgtttatttattattgctccatttcaattgttttaactgaactcaaatttaagtttatctattttactagacattatgccttctttttacaatttcttgaccttagagtccacccaccacctccagttattataaagaaccgattatgttgtatttaaagtataaggaggaaaaagccctgctatactaatatagaacattataatatagtagtaagagaaaactaaatctatggccagtttacatattcaaacattataacattaatttacataacaatcaagaaaactgaatctttagttggctctaatattaagcaactcagtgaaaaccgtaaaaccatggaccaaaatttttgcccaaggagtagtttgggaaaagattccagaggcagatattcaaaaaaataaaacaaccaaggaaagtatgtgatatacaaattattttagggatggcactattgcccttgaaaagtctgttaaactcctctttttccggattgttgtaaaaattaaatgagataactgatgcaaggggtctagcacagtttctgccccagagtaagtgcttgttaataaatgtgagctatggttataatcatctacattcttgattttctagcctttctggttataatgtttagcttaatgcagttccagtagtatttatgaaatgtgtggtgaagggagcacaccagtaggcttcacagagatgtccagcacggggctcctatcctcaagggtggaagtaaagcggatgtattaataaatctgaagcagaatgtgagagcagtacagtacagtgcaacacatttcactttgaacgttatgaacttctgatgtgttcgcagcagttgtgtaaatgttaaaaccacaagtaattattctttctcttctgtcatgctctctctaatttatactgtctcaatatttttgtttataaaaatgactgaaagaatgagcgattgtgtcaataatgaagacaccccctcatttttagcaaagagacagccccaaaatctcaagaagtgaacaattaaatgagtcataaatctatcattcatagttaaatggaattttttaaagatagtgtggttcaatagcatttttatggtgcaattaaaaactatcccttcagtaaatcagtacccaaaggagaatgatatttgggttttttttttttttgtactggagacatcagattgtcaatttcttccttatttgcaaatacaaggatgcatgctaaatctcagacatctggcttttgtaatgtagtggtagcaacctgcattttggattcaaatcaaagcctcttccttgctgacagggtgatctcagtcaagtaacggaagcttcttaagcctcagtttcctcatctgtcaaaagctgggatggtgatgcctaaatccgcatgacagttaggacaaatgagaaaatgttcgccaacacaaacctacttgatggactctcaatctttggaaaaacaacttagtaataagtaaaatttctttacctctccctcacaatccagagcttacacagtatgtgctgtacgttaaaagctcattgtctcattgacagactgttaatttcacacacacacacacacacacacacacacacacacacacgcaaaatcgctgaacaaaacacagcccaagaaacgtcaaggacaaataggctagatatgaaattcctgaagctctggtccagcatcaggtgacatggtcaaagagaagagacagctctctttttagaacgtctgatgcccctgaactggtatggccaagaataattcttggctttggtatagtcttggggtatttctctaagaatataccacaaaatgcactgaggtttcagagaagtttcttcatagtttaacattatgcattattatataatttccctaagaaacccccagaaaaagtggagcctttattttgtgtgtaagaatccctaattaggagtctttagcaagataagaatcagaaatctgatttgccccctttctacattaagcatattgaaattttcatcatacccagatttctgacccctgaatgttttgtggttgccttttctcttagagctattcaatgtaaaatatctttttttctcaaaaaaataaaaataaaaacaaaactgattttgatacacaacagctgaataactcacagttcctagcatatgtaacaaggtttcaggcattcaggctaggactgcagtctagaagatcatatttttccactaatttttttttcaactgtcacttccagtagagtaggggattgtatgagcaagtttatgatacacaatttaaagtaattttctataaaaagatgtatgttcatttgaggcacaaaacaatatcctgatattggaaactaacttttaatcttaaaactttaaaaactaaaatataaaattaattgatgatagtgagcattattatgtatgtgacatttcctgtctaacaacccagtatgctgtaactgttttcaaaattgctttattttttttttaaagtgagtaaaacattttgttgaagtaaaagcagcaaattgatacttcagaggtccagctgtgtgttcagcttaatgttttcctgtggcaatttgcttcaaatccctcaaaatcagatactattaacaaattactaaacaaaattatttttatacatttatatattagaagttatttcccgggtaacaactaatcgcagatactaaaaaatactggacatttcactgtaacattgggtgtttctgatagaagctggtctcttaaattgacagtaagtaagtaagcatcgttaccatttaagtatattacaggggagaagattattgactaaaatattacaaaatctacttttaaaagcatatttaatcatccactcaaaatagcacactaaaagttaaacagctactctggtgttcagtgtagctaaactcagtatttcctacttgtaaatatttatttatccagaaagagaccagaaatatggtttgaacatcaccattctgtgcctctttatgagaattcagtgtcttctgaaccagaactactatttactatgcccaagttgaccttacaacatgtccctcaaacttgcacatcacctctggcttaggacaaccttgactgtcctgtccctagttgtgtcctctcttcatttgtatccccataatttgcaaatgagactcgacatagaaaggctttcactatctcagagcatgactggttctgaaggagcagtgtagtgttgtacttcagggcatggactctggacatactgcttgggttcaaatcatagcttcaccagttgatagctgtttgacattgagcaaattcctggacctctcttttcttcggttttctcatttctcatttttcatagggatactattagtatcccacagggttgttcttgtgaagattaaaagtgctttatatccatgtacaatatctagcacttacatagcagttacaagtgcctggtactcttctgagcagttaatgtgtatgcttaatgttgtgttgttggtaaataatactatacactgtgttagcgattgctaatattgttggatggtaagattgtcaatgactgcctcagatgagtacctgagagcctctcattcagattactttcatgcttctctcacactagggaaatacttctattgagaaaactaaggctctgtagggttgagagaactcttaacagaaacattttgagtagaacctagattactctgccttatcttttttttgtccccaactcctggatgcctgtaaacctttctctctgcgctgcctcattcagacatcatttctcatgtattctagagcaaggcgttctaactagcttctctaacagcagtccaacccccttttgtctctcctttccactgccatcattgttcctttcctaacacaaatttaataaagctaacaactaagaagctatcttaggcactcattttctagagtataaaatttggtaaaagcttagtataaagcctacagtgtaaagttaacataatcttagaggttcatgttagccaagccttctttttcaacttcggaaaactttctgctcttcaagatccattgtttcatcttcagaggaatgcccctccttctaaactctgagatctctctgtcctgcattccttctctccgcaaagcctctctctgaaccatctgataaattcctgttcactcttaatagccaccctgccaccattcttttccctaggataccatgcagcttatcttttggtgaaaagttctgtatgagtaaattagtattgagatttaccttgatataacgacaacctgtggcaacaaatactcgtcagtgtggaagaaaatatcagagacttcaacttttcattttcattagggaaaatgtctgacttgtttaattctaccacttgcagttagctaaggtaatgtgctgtgaaatgattaacaggtgcaacaggtagaaaagacgctttaattaactctctataaacaaatttagtaggtgggcacttacatgatttcctggctttcatatatatggt

SEQ ID NO: 1353 - DNA, 2161 bp, Homo sapiens
  misc_feature (244)..(244): "n" at position 244  can be any base
  misc_feature (249)..(249): "n" at position 249  can be any base
aagatgcatggtgaaatggtgagatcagaaaggggccctgcatttgataaaaatgcaaaaaacaaaataaaaatagcatgaaagaaactagtatatacaatggatgtcagttgacccaatagattgctaatgtattaaaaacaatttagggtgttgcaatgtgatatgttctaaccccacaggttatccttttgacagctgaccttaaacttataaaatgtaagcagagtaaaagaaaacaganagaanatagttactcaaatgtgcaactgcacaaatatacccccctcccgctattaagataacaaaacttctgctattaccataatattatatatattagaaagctatacacaagcatgttaatttcacagatttttttaaaagattcttaatattttatataattagaaatacacacatttcaaaaacaaacttctacaaagagaaaacagttatcttggttagcaaagcatggagttcttcatggcttagggtagtgctttctatacacaaagtcctttttggttttttacaggactgtttaaaatattagcgacgctatcaaggaaaaaatacataatttcagggacgagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttctcttgcagtgtgtgtgtgttataccttaatggggaaggggggtcgatatgcattatatgtgccgtgtgtgga

SEQ ID NO: 1354 - DNA, 1398 bp, Homo sapiens
atggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatga

SEQ ID NO: 1355 - DNA, 41637 bp, Mus musculus
  misc_feature (11290)..(11309): "n" at positions 11290 thru 11309  can be any base
gatctcatcagagtccctgctgtgctgctgtctgtctgtctgtctgtctgtctatgcccttactaaatcttctaataatcatcttgccccaaaggacagcatgtctcagtgtatctttcttgagtcccaaacccatagcattttggttaggaggcaagccaaggcaatttgacttgactcatcactttcttgtggaaacagaatatctgaagagcagctgaagagatatcaggtctacttcagctcacttggtagagtctatcacagcaggaaaaccatggagactggagtagcttggttggtggtggcaggcaccttttggtacaacttgttcacatcttggtggctcaaacagaagcatttctgttctaagtgggaaaaatgttctgccagatattaacaataaaattaaaatttttttaaaaaaagggttggttaagcactcaattttaaggactcaattttgtatctttccaaacctaggtaaatatcaggtggtattggtggttcacctctaatttcggtctctaagatccccaaaacaaactgactaacaagactagcaggctgtgcatttggttgagagaccctgcctcaatgaataaggtgcaagcagcagcaaaagaagattctcaccatcagccctgtgcctccacaactatgcaagcccacacacatgcactcactgcttgtagatgtatgtaaaagtgtgcattcaagcatctaacacacatgaacacgtgcacatacaaacatcctcatgtgcgtgcacacacattcatgcaagggatgtgggaaatggagggaacagatataagatctccctcctcctacttcagactccagaatgtggatggtgcttaccagagtttccagattcctgtgactctgaacaaaattgagacgtggaaagtcgcagaataaaaacagtttatcaagaaaggatgtgtgccgaagctgggcaagactgagaagccacagcaaatgtgcaaagcattgagactggtatgtgtgagagtgatagaaacacacacacacacacacacacacacctttattcctttgagacaaggtctttcactgaatctgtatctagattggcagccagcaagtccccaaacccttcctatctgcagccctcagttctgaagttgtaagcaggtgtggccatatttgggttttccatgggtgttggttgtttgaactcaggtctgcaggctttgtagtttgcaggttttgtagtttgaatgagaatgacctccatcactcacttgcttaactatatttggccctccgttgacagaatgctttgagaaggatcaagaggtgttggcttgttggaagaggtgagccactaggggaggggtttgaagtttgaaaacattagtgccactcgcagcatgtgtctctctttgcctcttggttgtaagttctcagcgactactccagtaacatgcctatttgtgtgcttgcctgctgccatgttccccaccaaataaactctgacactctgaaactgtgggcccctggtgtttgttcttgtttgttttaaacaaaatctcaatagttagattttttaccaatgaagactccagagccagatgctggggtgaaagtctgttaggggagagagaggcagaaaaagcacttcctcttcctcagcagacatcccagaaagaatgcccttcaaactgaatgtccctcccttctacttcctgtgcacctctctattagttttcctgactctcactctctatggtttttcttaataattctatgttcactccctgacaattgattgtttgatccacatttgacctatggttgactttatttgaatctgtttataatattcgagcagaaagcccttggattaaaggtgtgtgctaagactgagccacaccacaaataataacaggtttttattattaataatgggttttttattattaataacagtaaacacacaatctcgaggttcacagtgtcattaaattaaacagtttcttttctaagttgccttgattgtggtattttgttagaggaataggaaaatgacaaacacatatatcaaattctcttactcactaacccagtggctctcaaccttcttaaagctgctgtgaccctttaggacagatcttcatgttgtggtaaccaccaaccataaaattatttttattgctacttcatagctccaattttgctaccggtataaagaataacgtaaatatctgtgctttctgatggtcttaggtgatccctctgaaagggtcattcaacccccagaggggtctccacccacaggttgcgaaccactgcactaaagcacctccccagcagcaaggatttcaggtgtctgtttcccaggattacaggcttagctcttttgcacacactgtgccgtttctcccatgctctggtacatgagggcacagaggggaagatttccagccttccacttcactagctggatggctggtttttgttgtggttggtttttttttatttaaatattattattgtcattattattgtgtatatgtgtacacatgcatcatggccaaggtttagaggtcagagcacacttgagggagtctgtttttgctggaaggcaagtgcctttacccactgagacatcttgctggaccccaactcatttctctgacatgccaggcctgctttggcctagtcacatgcttcacgccatgtgaaagtgatagcggggggaggtttttagaagtgaagccttgaaggatcctcacaaggccttacaaatgtgatgggcaggcatcatgcagtgtttggcctgcttgtcgctcttccttcaccaagtgtggacacagccttaactccctccagcagtaggaaggctccaagttctgttacacttagtttgtttgtgtatgtgcatataccacaatgcaccagtagaagtggaggttagaggacagttttaggaattggttttctctttgtgaaccccagagattagagttaggctgacaggctgggtgacagggacccatcttgctatcttggaagcagataccaagccctcagctggtacagtacacacaccagaccctcagcaggcacaggacacacaccagaccctcagcaggcacaggacacacaccagaccctcagcaggtactggacacataccaaaccctcagcaggtacaggacccacatcttcagccactcaacacctccactgtgagaatatgaagctttttataaattactcactgtctagaattgtgatgcataggtacacatggtataggaaaggaaagatagaactctgggacaaggaactgaggtgcatattttacatatcaaagcagacctggtctccaggttctcccagcatccctcagtccttacctggcataccctgccccagggccagtgatctagccccagagtggcttcccaataaacttgcttttaatataatctaatctggcttgaattggttcatttcactggtggaaaaataacctatcaattttaattttaaatttcactctcttgatttaaaacaaagcacccagggctggagagatggctcagtgattctgagcactaggtatttctccagaggacctgaatttaattcttagaaactacagggctttttgtaaccatgtgttactctagttccaggatcccaatgtcttcggctggcctccctatgtgcacctcacatacatggtgcacagacatacatgaaagcaaaataccccatacataactttttaaaaagattactttttaaatcaacaccaaaaactgaaactcaaaaggctaaacaaaccaaactctggatctgttgaaataatcacaaaggtttactcttgtgttgcacataaagaatgccagtttggtaggggcttcctatgcaattggttttgcagggcagattcaggttgtgttgttgttttcccccttcaatgaacatttatgcttgcatatacagtaggatcaagttgtatagtcttttcttaaaaagttattccccatacccaatcacacatggacaataggtcccatgcatggccaacactattgtccatgtgccttagctgcaggtgctataagcagaaggtcagagaaggctgtgtggaaatgtaggcaaagaagaggggctaggcatacatgactgaagatgcagaatctccacaaatccaggaggggctgtgtgaggagacagaggttaggaggactatcaccaatgttttctaccctctcaaaacgtgactaatgaaagctaaattccagtctgaggatgaaccctccacagtcctgggaacagcctgccctctgtggtcattttagaaggccatgaataagaagtttgcatttgagagtttgaatgaagaagatacagcaatagttcccattttccagatgcggtacaaggagctcaaatttggggatgtctcaaaagtcgacttaaaatttaaaaagcttaagttttagctttagctgccaacaggtggtctctccacacccacaagcccagttcatggccagacaacagccatagctgagtacattcagaaacacccttccattcccatgcggcagtccctcaggacttcccttctaacctcaagactcaacagtctctgctgaggccctaagtcctctttccagtacttcttcctgctctgcacactgatggcaaaagctgacaggttcatgaaggaaaaggtaaaagtaggatggcagagggactgtccctttgggccttgtctgctcactgctatagtcagtcccaggcagagctgcagaggatgaggacaaagcctcacaggcttataactttgtcatatatatgttcccaaatagatttgttctttcatccccacaggtgggcaggtgagagcccaagctctagggtctttcattttccagtgacgtatgaagtcttagtgagctacaggggtggagcagaatctaacgatgctctctgtggtcccatgagtctgatggacatccttgatctatcctaagatgcagagtgtggctgaatggatgagtcaccaaccagcagctgcagaacacacttcttatggtgatgagaaggggcacagtgtgtgctaggggatgaaattaacatatttagtgccagaggaatatggtcaaaactaaggggtgggatacagagcagaaagccttgactcccatccatgggactgtgtgccttataagggtatgccaggctctgacaaacttatgtgttctgcatgtaaagagctttattatgttgaaacaccaaagaactccaaatagattggaccagaaaaaaaattcctcctgtcacaaatgcacgaaataaagaaaaaagtattaaaagcagtaagggaaaaaggtcaagcaacatacaaaggcagacctatcagaattattacagacttctcaccagagactatgaaagccagaagatcctggacagatgttatacagaccccaagagaacacaaatgccagcccaggctactatacccagcaaaactctcacttaccataggtggagaaaccaagatattccatgacaaagccaaatttacacactatctttccacaaattcagccctataaaggataatagaaggaaaactccaacaagaggagggaatctacaccttagaaaaaacaaaaaagtaatcttctttcaacaaactcaaaagaagatagtcacacaaacataattccacctctaacaaaaataacaggaaacaacagtcactattccttaatatctcttaacatcaatgggcttaatttcccaatgaaaagacatagactaacaaactgggtatgtaaacaggacccaacattttgctgcatacaggaaatgcacctcagtgacaaagacagacactatactacctcagagtaaaaagctgcacaatgttccaagtaaatggtcccaagaaacaagctggagtagccattctaataccgaataagattggctttcaaccaaaagttatcaaaaaagataaacatattcatcaaaggaaaatataccaagatgagctctcaattctgaacatctatgctccaaatgcaagggcagccacattcataaaagaaagtttactaaagttcaaagcacacattgtacctcacacactaagttagactccagagaaccaaataatcctatcaacagagaattctcaactgaggaaacttgaatggctgagaagcacctaaagaaatgttcaacatgcttagtcattagggaaatgcaaatcaaaacaactctgagattccacctcataccagtcagaatggctaaaatcaaaatctcaggtgacaaaagatgctgataaggatgtggagaaagaggaacactcctccattgctggtgggattgcaagcttgtacaaccactcctgaaatcagtctggtggttcctcagaaaattggacatagtactacatgaggatccagctatatcactcctgggcatatacccagaagatgctccaacatacaataaggacacatgctccactatgttcatagcagccttatttataatagccagaagctggaaacaacccagatgtccctcaacagaagaatggatacagaaaatgtggtacatttacacaatgtgatactacccagctattaaaaacaatgactttaccagtaactatttttaactggtaagctgtgcctctagcccttgacattgaacttttgatcttcctgcctcaacctccccatgctaggattacagatccttgccacctgtagtggttctaatagggttggcccccatagactcatgtatttgaatgcttggcccttaggaaatgacactattaagtgagtgtatccttgttaaaatggatgtggtcttgttggaggaagtatgtcactgtggggctgggatttgaggtcctacgctcaagctctgcccagtgcagaagacagtttccttttgtctgcctttggatcaagacagaactctcagctccttttccagcaccatgtctgcctgcatgttgccatgcttcctgctatgatgaaaatggactgaacctctgaaactataacccaggcccatttaaatgtttattttttataagagttgctaggtaatggtgtcttattcctggctatagtttggtacatacggagaagactggaaagcagtaccttatgaatatactaaactacagacatatttttaattcatagattagaggattgtcaggttagttgctaatcattttctttcctgaatgagtaaataaggaaacaatttctaacacattctaactacagagtctaagctcattgttgccccagctgagggaaaagttcctccagggaactgcagcagcagtctgcagcccagccaggttggaagtttgtgccctgtggagaccttcctaaagctgtaatcccagcatgtggcgggtggaaacagaagtacctcataggaatccaatgccaacctggctgcaatatcaagtcacaggctagcttgggctacagcatgagcctcagtctcaacacatacatgcatacggacatgcatgcataaaataaaacagactctcggagccttagccagtggatctccacacgcaggcttctcatctgcaaagtttaatagttatttagccctgtgtggttgtccacacctacagtcctagatatttgaagacccagctacacctccaccaccaccaccacaggtaaacacacactttgctagcatgggtctgaaaagaaatccaggaagagctagccagcttccttctttgcagttgtattctctttacagtctgtttgaggctggtaaattcattgttttgttagacttaaaaatgtctgaaagttgccaggtgtagtgatgtatatttttaacactagcacttgggaagcaagtttcttggttcatggctatcctaggctacagagtgagttctgagaccagacaaggtggcacaaaacaaaacaaaaaaaccaccctatctaaaaacaaaagcaaaatataaaatgtctaaaagtaaaattttaaattcaccccacaacataaaatcagcagctgcttaaagcaaaagcatctagtttattaaagtacagttgtactggggagcctcctgcagggaactcacaggctcacttcccaaaatatgtgtggtgtaatgagctcatccaagggggcagggcagggcgaggcgtggtttcatgattctatttttaaagtgtttataagcacatcctttattgcctaagtcagctgacaagggagaaatgaatctcacatagcaggtagaggcaaactccgtactaatctgggtttccttagaaagtctaaagggtagcagtgcttgagtttcaatgatcagctctccaaccagttctagaatccaagaaggaggccgcccaccccacccccccacccccacccccacccccagcctccccaacagcctagtgcagactgcttttgccaattcccaggctgcttggttggtgtgggctatgctagcttgctctctgtgagaacagaaaggtcaagtcctccacaaggtgagcaacagagattcctgtaaccatcaaaggacttcaaagccacacaaagctctcacatttataaagtaattgcagacagccaggcgactttcctcaccaagtaaatctagtcttgcttgttatgtaccttaaggttctataacctgggcgccgttcctcaccccagctttctgtcctacctctgccagaagttttcttaggatatccttgaagggcgattcattttccaccgagggatcgtggaaagatcattttaagggatgcgttggacctggtgaggatgatgagcaaagtgagcagcaacttagttacaggggcactggcttcacaactcagcctaggaccccaggtctgtcgttgggatggacattagacctcttttgttctctggggtctggtaaagtacctggcctttgatgcggagcatttggaggggggagcaggataatggtgactggagttcttggaggagctttcctcctagaactgtctttgggtctcaccttcagtaaactttctaacaaaaaagcaaacccctagaatattacctggagctaagggatcctagaagtcgctctaatagtggagctgtgccatcgaacaactaattcagtagactaaagatcaaaactagttgtgcgagcagagaataccgcaggcaatttttgccaaaacttaaaagtacagtatctgaactgaatcagggcgagaccatcctggctgcttgcaagcctcccgcagcaactgggagagctggtcctcttggcaggtcctggggaggatctaaaaccgcaaactccggccaggaagacgctctctggccacagattggggacacaagcccggggtggggtggattctcaccaccgctccgcccggttccgcctccatctccatcccgcgccccggggcccgagggtgggaggacggaatttcccagcgcgggggttcttgtgttccgggccagccgacaggctctttctgtttacggagagaaaagggaaatggaaaaggcggggaggaggttggcgtcggctgcgccaccccaatgctggttcaggcgcctagagtcagggttccgcagagccctggtcctcccgctgcctatcgcccggcctccagtccgccgtctgtcctcagaacgcccacacgcctgggtccggcaggctggccacccgctgcccaccgacacagaacactcaggttaacagggtttagggtgccctgagtgtgtttcaggggcagggatgcccgggggttcccactctgaaacggagcgtgcctcccaccggtgaacactcgagtggcctgctgcacgcaggtacagctggaaaacaccttgcgcaagaccgcggggcggtgtggactcgaggctcctcccaccttcctccttcttcccggatctcgggtgaccagtcagtgcaggcctgggctgtggcgcgggacgcgagcactggcgctcaccgcgcctcctgcgggggacactgcctggactgctgaactctgtttgctgagcctgggtgagtgcaacttggagcctaaaggacccctatggtcgctcagtttctgggcttttaccttaagcaaagcttgtttatcttaaggggccaagtgggtcgagagggagttgtgggaaacatatttggatcccaaaggaaaacagaatctttttttttttttttttggataaaatggatggggttgggaaagataaagccaacaaacttgcttagcattataagacatctgctgaggcacccaacttcaatggattgaggcttgtgtgttctggcccttaaagactttatcctgtaggagaataagagcagtagacttgattcatcttgaagttttgaacaagagtgaatttgattctacagggctagaaagcatgtttctggaactttttcaaaagaaaaatatattaagagatatgtcctaaggagcaatgggttgtttcaatgggggaaaatccctttttaaaatgggaactaacacaggcattatcccccactgcaaggcagaatatcaagactgtatatagtctgcgtttacttgctgggcaactcgaggttcgctgtctggatgttaacagccaagtcctgttttctattttcatagctattttctgaaataattctaagttattttatagttaatattttgaaatttaattacaaaaaaacccaccagtcttggactgcatttggaacaactgtctctaaaactgccctaactctccatcctgctaggacatatgggttttggagaggattttgacccgagtccaggatcaggcattttaagctgagcacatttgtcactaaactggagtggcttcatcatgcacagaaagggatgctggtctgtgtagctcagaaaccataagctaatgtgtggtctgcttagttgagccaggagggtgtaggatgctcctcaggctccagaggctgttggggcactggtttgctgggcagcagatctttgtggcaagagcctctcaggaattgagcaagctctgtagaaagtttcagaattaaacatccttccatctccctgtcctccccctctctgtcttgttcccatatagccgtgtgtgtgtgtgtgtgtgtgtgtgtgtgtgtgtgtgtgtgtgtgtgtgtgatagagagagagagagagaaagagagagagagagagagagagagagagagagagagagagagagnnnnnnnnnnnnnnnnnnnnttaggctttaagtatagccttattataagggcacacattctgttcaagcctttctgcaggtttgcaaacccaaattggtctttcctttcttgaacagtgctggatgcctcccccccacaccccttctttctagagtcgcaaactttactgttttgtcaggtcatttatttgctaattcagcttggagcctttaccaaggaagcttaaagccaaaggatttttaacttctgttttcctagtaaattctacagctgcagaaactgcaactaatggctatgctaaactgaggttaaaggttctctctcctatcagcttacacggcttcctgtgtagcttgacaagtcagggacttgaatcacagtcttcttcagcgatgtgtaagatgtctgggaaggcactgtgtggaccatgatctagatttaagtgtggcgataacaaacaccagcagacttttctgtctgggctcgccttccccctttgcttcaacatagacacaatctttaaaaacttaccagactgagaaataggcgtcaaatcggactcacagatgagaaaggaggccagcatggtgtctgttaacctaggtccacatcctagtgcttgttgacacagcttaacttactacacaccagacactggtagattgtgcgcaggagcttctgtgattggatgataggcgctattattatctccaccttgcagatgagggaaaccaaggtacagattgagatacttgtttaaccatctcataggcagaggttggtggtgagatttgggcatgaagacaggagtattttaatgtgggatggatgctagatgccttcttcatttgcacatcaggagcacatgacttgatcatgtgtgcaggtgtccctggtggaaatttccagaaactttgaactgaagctccacgttgacacaggtgcatggctttggcggagtaatactttgttacttggtgtgtgtgtgtgtattggtgtaatgcacgtgtacatgtgtgtgtgtgtgcgcgagtgtgtgtacatatatattacaggtgccacatgcatagtacatgtgtgtgctggtacatgtggaggctagaagtcaacattggctgtctttcccagcttactttttagggaggtctttcattaaacttcgagctcatgggttcagttaaagttgccagccagtgagctctagggagtcacctgcctgcacactcccggcactggcactgtagcacttgccgaggtcctgtgcttttatggacctgacatatcttccagagaggcttaagtcagacaggctttgaaatctgcttacatctagtaggtgctcttattttttctcacttgtaggggagcagagttatctcaggacccagagggacagtaccactttttattgtcactttttatcggcttgcttgacttctcttgtcatctacatttcctaagtgtagcacctgatcttgtgggactgaagtgtcactttggctggtgaagtcagttgaacttcacctgtggctcgcttatagcagatttggttttcctgggctcttttctccttctaaagcctctccagatataggtattaagttagctttctgggaccctcaagatgtgtgctttgtgctattttaaaaaagaaattcaggtgtcaggagggtgctatgactcacagatcaatgagtcacctttctgatacttgtttatctttggcacgtatagatcccagctcctgtccccttctatagagctgtttaatttcttcccaccagatttccccacacactgatcttcttactgtttcacaccctccctccgtttcacaccctccctccaagtaagctgttttacatgcttgcttctctcttgggacttagcttgcttacctagttagttcctgaatttcagtcaagtggttcattttctttcaaaccactttttctttaaagccacagccatcttgagctgtacaatgaagctgtacaaggtcagtaattataaaaagcagaaacctctgtcttcagagagacctggactgctctctgctgtgtttgggtttagtgaaagtttgttttcagtagctaaagcagatgccagagtcagtgcctcccaagcatctcaggttttccctgcaaagcaagctggactaaagattttctaaggtccctttgaacttggcactgtccacttgaattcacttgtgtgagtaaagaagaatccttgttatgaacagaggcacagaggagcagatctccaggccctttggtctccaatgcaaacacattatagtgaaggatatgtttgtgttttcttctgtagactcccagcaggcactacagtgatggagtacatgagcactggaagtgacgagaaagaagaaattgatttattaattaagcatttaaacgtgtcagaagtcatagacataatggagaacctttatgcaagtgaagagccaggagtgtatgagcccagtctgatgaccatgtatccagacagcaatcaaaatgaggaacgttcggagtcactgcttcggagtggccaggaggttccctggctgtcatctgtcagatatgggaccgtggaggatctgcttgcatttgcaaaccatgtctccaatatgacaaagcatttttatggacgtcgaccacaagaatgtggaattttattaaatatggtatgtttcttctcatcagttgagtgctgtgtgctctgctttgctggtagtgcttcattgaatgcacagtggcattgaacttggcttaagaatggctgccagacacaagttactgtatctggttactggtaagaatcacttctttcttaaaaacgggaagaagatcttcatgcaaattccattgtaggggcctgtaatttagtagtgaccctatgaagaagcaatgggaatatactttgtttactatagggcatgtaaggtaagcactgagccctgacctataccctcaacccttacagatttattttgacaattcactgaaaggctcattcattatatacatgaaagagagggtcttaattggagttcatcagtcaagagacatatgagtgctgtcttaatattttagaaaacagaattattttctcttatcacgttggttaaaaatggttcttatagaactgcagcttacaggtggcaaatagctacccacagattcactctctttaagtggtgatgacccacggtgatggagttgcttagtcatcccaagtatgcagataattcaaaaatattgtgacaagtctttgttaccacagtagttgctcaggtggagtgtttaggtgtggctggcattctgtcagatccttattgtgtcagaggtgaatatgtgggcgatggttaaaaggtgatctaattttgtaaaaaggacagttggcaaaagagtaggcggtaagttacaaacatgcctatttgtagagatggctctcttttgtttggtgtgtacaaatggcagtatgtcccgtgctgggggagctctttccaaagagcctgagttgggacaaaggacatcacaacaatagcaataataataataatcttaattgtctcatttatttaatgaaaaatagcacagtaatttaggtcagctatgaagtgagttgtttgtcaactgtgtttggctcagtaagaagcaagctcacattctacataggggtgtgacttcctttggtgtgggtctaccacactgcatttaacagtgggctaaatgctttgtctgtaggatgtgacttcattctataaatgggaatttatcatttgaagtagtagccataccagattttctcaggcagggtaaaattagagaagtatgcttcaaaataacacacttgggtgtgacaaattcagtgcagatgcatttctttcgtttttacacatatttgataaatgaatacaaatgagataaactaattgtccttgcttgtgaatatatagagacttaggtgtgcttgccctcaatgaggagagatggaccacagtccaggtacataaggaatactgggatattttagagactcttagaaagtggtttcttgcttctctttaagggtagaaccagaagagctaacacagaaagggccagaaaccacagtcattagacggatgtacaacctgaccagcaaaggtacaactgaatggttatcatttcttgctaaagaggccatgctcaacacatgagcaagtccaaactaaaaataaaattatgaatcaaagataccatgaaggcagggctcttaataatcttaaaaatacttgtattttcttttaatgtggaagaatataaaatataaggcaagaagaccagaaagaatgggatgataggaagtagtatagctcatgggcaagtatatccatcttcgttaggcctgggagctgggcctctcaggactgtgtttgactttcctgatactggcattaaaaatgaaactgttcccagtggcaatctgtcacagctgtgtgcctcataagtcattgcctatggagtcgtctctggtcagagctggtctggcgtaatggtcataggcatggcttttaaccccattgactctggcacggtgccttctgtggatccatctatcatctagtcgagctttcttttgtcatgcttcatctgcagacttagcagagctgtgtgctttgggctagctttgctgttccttatctctcttctttagagaattagctgccacctagaatgggtccagagtaaaatgtgtccataaaagcttcctacatagggagagaaacttttccttacctacgtgttcatttggtaggcatacctggacagccatggtgtatgtggctattccagatactagatagcattttgatagtctgtaccacagggagctcactgcctggtgctgcaggatgcaagtgcgcaggtaaaataacagcacacagtcagccacagaggacctacactctgacaagtgtgggaatgcttagacaagatttctaagggaaggaaaaaggagggtgtcagcacaggcttgcaagaaaaactggcacccatgccaaggtgtaaacatcaccttggagccagctaaatgaagtgaagagtgttttctgtgaagggacagtatgtgcaaaggctcgcaggcacagagacctgctgtgttctgactgccagcacacagagtgctgcaaacttcattagacaggatgtagagctacagatagaacaataacccaaagcatggcatgtaggctagttctccctgagtgtgtatttatatgtgtgctacttcccttaaaataacatatgttattaaagattgcactcatattcaacagaacccaagaaaagagcatcaggagactagcctagagactgctctgtgtcagagtgcaaagttatttataaccagttcatacttgacctggagtaaaatacaaatgagttcccaggcattcaaccctgggaattatatgtgaattcccccccccctcactactctccccccaaacacacctctccctggattcgttcactcaaagttactggtgtggcatttggaatgatgatcctcttggggttgaagagtccaaccctccacttggtgtttgagccaggcaggttcagtgccacatttgtcaagttcttatatataacgaaattcatctctgatcccccttaccttagattctactctgtggcccactcccactcctgtaaatatatatgatgaactgtggtggtagctgagagttctgaattaagaacctggtatgtagtttgcctttgaaatggaaattcttactacccgtcttactagccagacctgaacatcaggatccacttatgtccccaggagggtaggagagatgtagcttagcctttgtgttagctactctctttccatggatttagctgaagaccactcctactttgggtcacacagctaactcaataaaatacctaagaaatgttctcaggtattgcctgctgtgtggtttagtacagaaaacagcaatctggatgtgagactagatggcatgtgtcaagtgtctgtcctggaaagtgactttggtaagttgaagatctgacagaaatagaatcacagggttcttctgcaaggttgtttggatccctagaaagaggaaactaaagctaaacatccttgtcaaactcaagcaagagagacctggagttagggagaaaatcaggaacgctgtggattgctcactgcctggaacttgggcctcactggatgagtccaggcagctttgaagaactgagtctgcaccctagcatggctttaattacagccttctggaaccccaaaggcccttacacaaagagtgggcactctggctgtggggttaggcagaatcaagtgcaaaacctaattctggcactgactggaaagttgcttcaccccttggaaccagcctcagctatgcaatggaaagaaaaatagaacgaacatagctcaggctggctgtagactttaatgagataatgcaaaacagctaggtaagtacaggtccttgcttagctttcagactgcagtggccgatccttccctatgtccccctggaaagaataagggggtggtagtggaactggttcatagcacacttagtttggtacaaagccaaactttcatgaacaagggttaaacacggagataggtaactagaacattctctgaatgacaagaagcaaggggacccaaagaaagtcttgccagatgttagctctggctaaatgtggaagagaccaccactgcagtgtcctcagcagcaacaagagacaacacttgtttggagaggcagttatattttaaatgagacaataccatggtctctacttagttcctggaaggacctgtacagggttacaactcagcaaaagcaccctgtaaacattgttaaaatttagtgacttttgcatatccaagtattgggttattcttcgcttccttccctggctaacatcgagcacacatttgtggactgtggagctaaattagtaatgatagaggttaagtgagcagtcctttggtctgcctctaatggtgagtagacatctggttgcatttacagttgcatcaagtgcttgttcttcattcagggaataggcttaggggctccacattctcctcagctcttaaggcagctcaatactgtttcattcctaagtccgggagtgatatctcaggccataatatcatgagtcacactgaggagagagctggcattttaggagactatcctgcagaacagtttagatcagtggttctcaacctgtgggtcacaagcgcacaggggttacatatcagatgtcctgcagattaaatatttacaattcacaacagtagcaacaacagtcatgaagtagcaatgaagtaatttaatgtttgtaggtggggttggggaggggatcaccacaacatgaagagctgcattaaggagtcaaagccttaggaaggccgagaaccactgctgtagacatttttaaaacgtgttctaggccacgcttcccatggactaccattttacttgagttagggtatgtactcacttttcatttatttttctaatgttcttcctgtgtatctctgactgtcctagccctcaccactctcttgcctctgccttctcagtgctggtatttctggaatgtcccaccatggtggacttgggtggaatccgcatcccacattgctctcaggacatacctcttgatgtttggacaggactcgttttgttcttgttctttgcaccaaagcatgttttgtttgtggtttatgtatgcagtgctagatgtcagtcccaggaccttatgagaactaggcgggtgttttaccactgagcaacacccccagcccagatccacttgttctgaaaggcctgattctaacccttcaaggcctgggcccacctatctcttctcatggctgcctactcaacaccaagcccatcccatagtaggcacacattaaattaagcaaggaagtcaaagagaaacaactctgcccttccttatttatgtagcattgtcaactcatgactgatatcactggctccatagtcctccctgagcctcagttaatttccacgctctctctgtgtgcatcctgggtgagtaacagctaggcagacaaacaggttagcacatttaaatagaatcaagtcaacctccaggctgggtgcagccttcattttcagtctttgggtctctgtcatcagactccttagataaataatttttcaacttttatttagcagctaactactcacaagcatttagaaatatgagcaggttggaccaggaacttgtgtctgttacaagctttctctggcttgctcaagttctaaaaatagcctgtactgtcagaatcacacatggaaccactgcactgaagggctgtgtataagattgtttctaaaatagcctctattgagtgagcctcacctcagcatctgtatttcctaacaggtaatcagtccccagaatggccgctaccaaatcgattcggatgttctccttgttccttggaagctgacatacaggaacatcggctctggtttcgttcctcggggggcctttggaaaagtatacttagcccaagacatgaagacaaagaaaagaatggcgtgcaaactggtgtgtgcagccacactgtgtgtctgactccctggcttagggttatttaccctcacattgggtcttacctaaggttcctaccccaaagtgtctgtcatttctggagtggcttgtggcttgggaccattcagctcctacatctctacttagttgtcttgtagcttgtaatctaattaaatgaatgttttggtgtgtttgacaaaggcttggatcacaccatctcccttaaatgggagtagtggagcttgcctgagttggaagatattggctactgttccctggggaggggtccatggcaggcaacagaggctagaaagacagggtgttccttaggactgcggaattatagggctgaactcagttgtacaagtttctgatatgaccctatctcttattaagcaatgtctgtttaaaattaatgcattggtacttcagaggactgctgggcagactggcagctgagaatatacaaatctggaatgtcactgcttaatgacacccagcagaggtctgcccgtttgtgggacaattctgggctgttcacttaagcacagttttctgaagtagcattctgagaacttcataggtgccagacaggtggatatttatgctctggaacactagaacacaaagagaatgaatggcttacagctaaagtagtgtgaatgcatctcagaacccttaagttcagagagctggacaccaaataagatctagtgtatgaggttttatttgtattaggaacaaaaacaaccacaaattcatctgctaaatgctgtgatcatggagtacccttgggacatagtgactggaaagagtcaggggattcctggtggagtctggtatttttgttttagttggaaatcacttctgtagtgacagtcaacagttaactgggtttgacattattttacagtgtgataaagttaaatgttattttctactctttgtggtgcttggaatcgagcccaggacctcacttatccacagcaagtactccatcactaggctgcatccctggcccgtgtccactcttgatttaacaaaaaagcaaaataatgaatatttgtcagatgccatgtttcagtctcccaaactacccacaagacagcaatgtatagtctttaatttgttctttcattatgattcactagatacgcctttaatcccagtacttgtggggcagaggcaggtggatcataataaattaaaggacaacctggtgttcatagtgagttccaggccagccaaggctacatagtgcaatccccatctcaaaacaataaaaattctgactaagtgatcttttattaataggaaaacaagacttatagtaagctatttgaagtatctatccagagtttccaaactgtaattatctggagaccttttataaaaaatggcaacccagtatcataatttttaaattttgatagttcatggggaaatggctttgtgggattgttgttcctttagtatttgttatagtcacatattttagggcagtgctttcttagaatcaaaatacaattaaaaatcccagacaggctcaaaaggatggaggcttatgaataaggtagccttccataatgtgacaactttcaagaacttcttattttcccagatgtgtgcacagcatcatttaaaaacaatattggaaattttacaatttttcttttgcccctagcacaatattaggagacattttagaatatctctgctctgccaatactacttatcacagttcttagtgatgaagacctgagctttcacgggatgtaaagattggtgagcacttttcttaaaggcttgagtctgaagtggtcaagggaccagtgacttcatcttatcacacagtgaggtgaaattttggaacacagtgttctaggagccatggacatgaagagtatcaatcataggaaattcttagctcagtcagtattttgaaaccttgttcggattcctaaactctaaatgaagtgaggttttccctaccctgtttttcattgtctaaaaaatgttcatatctaaagatgtcatgatgtagaagtgagtctgtggtaaacatttcttgacaccacggtgctctgttatacacatcaaggtgtccttgtgttgttttggcttcctgttttctggttgctctgtattgtctggcatttgttttattgtcctgaggtttttagactcttgcccctgttttgtgttgctagatccctatagatcagtttaagccatcggatgtggaaatccaggcctgtttccggcatgagaacattgctgagttatatggtgccgtcctatggggcgatactgtccatctctttatggaagccggcgagggagggtctgttctggagaaactggagagttgtgggcccatgagagaatttgaaattatttgggtgacgaagcacattctcaagggacttgattttctgcactccaagaaagtgatccaccatgatattaaacgtgagtagtggggtctgccttattgctgtgagatggggctagtgagatgctttagcccaaaggcactcagcggcaggcagctccctgcagacacagcatccttttctgtgctccataaggggctcatagcaggaatattagcagtcagaagggaggctgaggactggagatcaatacaaggatgatgaccacgtgtttgttggatgtgctgcctctgtccttgtattgtgatttaaaaacaatcagtactgagtgggtagctcaaggatagaactcctgtttagcctatacgaggccctgggtttgatccccagcacgcgcgcgcgcacacacactcacacacacacacacacacacacacacacacacacacacacacacacacacaggattaaataatgcaagcacataggcatatatttttgagtaacaaataacctcttaattttgagccatgatttggcaacaattcattaaacaatctctttttaaaaaacccaaattaatacctaatgttgaattgcactctgtagaccaggctggcctagaaatcagaaatctgcctgcctctgcctcccaagtgctgggattagaggcgtgtgccaccaccgcctggcggacaacacagatttaatcagaagaaatccctatacatatatatttttaacaacagtggctcaatagtagatgtgtatatcttagattttgaagccaaaaccgtgagctttcctgctggctgtagctcctagctgcccacactaggtgggttcctgacaggcctcaggtgttttcacctgactgctcccctacttctctcttctggggtgaaccacctgagtcattatcagaagcgtttccttctgctctgcttggaacttgctgttctagatgattttcctgttgggttaggatgcattaactcacattaaaaacccctctcgttgcagctagcaacattgtattcatgtctacaaaagctgttttggtagattttggcctgagtgttaagatgactgaagatgtctatcttcccaaggacctccggggaacagaggtaattgattgattgtattggtgatggtctggaaatgctgtgacaatcagcaatgaaggggacaaaatggcaacattggatgatcgttgtcaccagaacaaattcattttacattttaccttttttactatttctatgataagactttaaatatgcatggttatatttatagatattttttattactgtttatatatacaacacaaagcacttacagacaattcagtgccaaaacagaggaccagttgagcattcctaatccaaacgtctaaaaagctagacaagacctagagagaggttgccaagtaaagtgcttgctacacaagcccagggacctgagttcaaatcctgagaacccaaataaagccatgtatggtagacctagtgtgactatgggtagatctaagtagacaggagtcttccccaacgctcacaggagagtagcctggaatacaggactatgaataagagatcccgcctcaaggtgggaagtgtcatatgtgcagtgtcgtatatattacacagacagacagacaaggtgaaaagaaaagcccataaaaatatcaaatattccaaacatgagcttctaaatctgatttttgattctaagtttctcaagtaagggatactcagaattcatctttaaaactgttagagaacaatagtcaacttatagttcacttagtaccttaaatgaattatttcttccttaaaattattgtgtgtaaatactggtataacaggcagatgactgctattatcctattttataagaagacaacggacagattgtaacatggtgcctgatattacccagtcaccagcagagccagagtttgaattcttgaagaataagcatttagttttgtattttctgtgaattcaggctctaaattctgagtaacatttaaaacagaactaccacattactacatatcaaattatgactactgcaactcctggttcagtagttttctcagctctggctgttagcatttactgaggagtggccaccgatgcctgcctgcctgcctttcaccccaggacagcataagcttggagtcctgagcacagatgcaccctgttggaatttggagtaatagaatgtaactagtctgccaatcgaagctcactgagaaagccctccctggggagaagtaagcttcggtgattcctcggttttgatttctgtgagacaggcctcagtatctaaccctggctgacctggaacccataatccccctgcttcagcctccctggtgctgaggtcatactagttcataagcctcttttaagttaaagaatgtttgtttcctgcttaagagagctttgtcacagtagaaagtctgagcagacttaatgctcaggacgttgtctttggaaggcgtctccacttttaggcattagtcaggagtgcagttccaggacattccacccttttccctggaaccagtttgagaaacaaaactatttatggtattagagagaaaaaaataccttttatttcctggcagtgcagtcaagttgaagattttgcaatgttggggaaaatcttaggtctgggattctcaaccaggatggttgggtgtagagtcacagatcttgatcttcaatagcttttcttcttatttgagtttagaatagctcaggctggccttagttgcactatatagcctaggctggacttgtattcaatatcctcttgaccctgcctctgtgtacttattagaattatggggcatatagcatactcatctagctcctgagtagtatttagatgaagtattttcagccaatgttaatttgcaggtattcagtacaaaactgatccggttgtctttttttgttgttttgtttgttttgtttttttgagacagggtttctctgtatagccctggctgtcctggaactcactctagaccaggatggcctcaaattcagaaatctgcctgcctttgcctcccaaatgctgggattagaggcgtgcaccaccaccgcccggcctgggtgtcttcttataccctgcccccatcaattgtctcccttgtactgtctgcacagtgctcacaaatggaggcctgattgtgatcagtgtgcaaaggacaatgaagtgctaatgcacttcagcaagtctgcttttactccttatatgaaagagcaaattagatattactaaccaggcaagcaggcaggttcacttcctttaggatatgtgatcgctttgctgctgggaaggcaatgtctgtttcagatttctgcagtatatttcacaactacagactgcacctctagatagtgcttgctctctctctccctctctccctccctctccctccctctctctctccctcgctccctctacccctttctccattcataatcagagtgttagacagtaacttgagtgttacactgtaacatgccatatacccaaagttaatctggtgtatatttactggtttttatatatcagaaggggaaaataggaaatataaataacacactagaattactttgttgtgttttttgtttgtttttgatttttatagttcttactttcttctgagtctagcatcagcttctgtaagttaacatataatgatcatgggcacatgtgttcatgcaggcattccgtggcagcctcttttccttgctacaaaagccttagctctgacttcaagttcccctgcacattactcattcctgggggttgaggggttagacaactccggggccagtgctgtctgttttgtcctaagccttccaggcagccagcccaaagatagacctttctgtcctgcctgctctggttctttccggagcttgaggaggaagaaacactgagctggaagctcctggctgtgtgccagaagtctgcaccatggcagacggatactggcagctccaatcataggctgggcatgagggcatagagagctgggatcccacccatgtgtccatttgcttcgttcccactctgtgtgacagagggagaggaggcaggcatcccccactgacagtaagcacacatcatttctttcttcactgtattcgattacggtaagtttcaacaggaagtcccctcttcttggcaaactacacgcgtaacttcttgttgatcgtggggtacaaagttgactaatttgtaattctgtgaatgagattgtgcttatttaaaaagtgaagagacatctgcagtgcattgtctgcagggaaagtggatgagcatggagctcggctacagccggcttgctggggaagaagaagaagtgtgttttaggaaggagttgagcctgctaggaaggggaaactgggcaatttccccgtttttgtaagttgattttctacttatttactcagaaatgaattctgagaacaccaaccctttccccatgttcacacaacagcataaaacctttttaaacttcatacctgaagggatttgaatcccgagtggttcatacttgtgagtcttcctctcctgacctctttcctccccaccctgtctcctcttttttctcatctcttccttcattattctgttttctttcctcccccatcccttcatttactctttttttcttgtttggtcttggagcatttgtgttagtggtgaggtgtcccaaggatgggacccaagtagaggcacagggttcattaacctgaaggacacttagcaggctattctcagagtggctgtgtcttactgtgaccagtcatatgagggcagatgtggaattttccacatgtggcatcatccaactcaaaagctttcgattttggaaggctttgtacttttaaattagagttatgcagcctatagtgttaattagaacactagtgttctgtgtctgtgacagccctacaggatttgtctgtgacagccttacactctgagtctgtgacagccctacactctatgtctgtgacagacctaactacagattattggtggccaggtctttcttttaccttttcatcttaaatttagaaaagcaaaatttacagaaactatccttatttactcagcatcagcttgggaaatcaaatgcaaatgatgctgtattttgttattttttgtatctattctttgggggcagaaaggcctctgtctgtagcctaagctatccttgagctagtggcagtccttttgcttcaggctcagaatgtgcacactcttgctgtctcagacatttgctatttagttgctgggatacttggcagatataaatgacttcctgggccattttcccagctttaccctttatttgtctaggttcttcccttctaagccactgttgtaaaaatcctgcaggattccgccaccgtttggcaattaaatgataaatgggagaaatataggtgtagtcttggctaagtctaaaagaattgctgtaatagtcaatcatgtgtacctgatgagcatctacagaactcagaccagcgggagtcagcaggttcagaaacctaatcctttgctgttagatctgttgtgtgttcagtccagggacagagctgctcttgtcatactgcagtgacgactccatccaagttgtcctgactctagagaacgtgctgggattttccttggcttgagggatactgcagtagcattccctctgaaagccagggcatgcagcaaataccacagaggcaaaggagccagcttctagaactggacatggagaagagaggcagataaatgaaactttcctcatctttttcagatatacatgagcccagaggtgatcctatgtcggggccattccacaaaagccgacatctacagccttggagccacactcatccacatgcagacaggcaccccaccctgggtgaagcgctaccctcgatcagcctatccctcctacctatacattgtaagtgagtgtcagctgggctttcccaagtgcatcccaccacctcataccaagacgatagggtaatgggagaactgcgacctaggagacgtggctcccaattctgttattgacatgaaaggctgttcgaatgcaaactgactgaaatgaggggacagaatttacatgctatcccactgtgtgataagacacacttagaaacatcagattcggacaactctgtcagttctttttaaaataagaaaatatagtagttttgttctctgttcccctcaacctccctttgctttgctgaataacctagcatagaacagagcttgggaggaagaagatgcaggtatttctctgctgcagtacccactgttggacccccataagaagctgtcacagctactttaaacccagctttaaaccaaaggtggtttaaccaaccctaggaagttggagagtatttgctagatcatgcagtaggcaataggtctctcccctagcctttcctgcagaagatatacctctactccatccatgcttacagagctggtttgttggcagatccacaagcaggcacctcccctggaagacatcgctggtgactgcagtccaggcatgagggagctgatagaagctgccctggagaggaaccccaaccaccgccccaaagcagcagacctactgaaacatgaagccctgaatcccccaagagaggaccagccacgatgtcagagtctggactctgccctctttgaacggaagaggctgctgagcaggaaggaactacaacttcctgagaacattgctggtaggacaccatgctgggtgtgtgggtgtatgcctgtgggtgtggagccactggcctccctcctgctgtctacagcaaagctctgatgtgggtcaagaaagcttgtgtgtgtgtgtgtgtgtgtgtgtattattggggagcaggggtggagcagggggcggaggtgaaggtcagccatgatacatgacagcacatgtctgtaataccaccttttggataaggcagatagaagttcaaggtcagcatcaattacttgagactttgtcttaaaaagagaagaagctgggcatggtggcacaggtaggagggccataagagcaaggcctgcctggattactgagtttgagttcaaggctaccctgggcagcttaatgaaatgttttgaaataaactgtaaaacagatgctggagctgtaacttggaggcagaacacttgcctgtcatgtacaagatttgagttccatcacttgcaacacacacacacacacacacacacacacacacacacgcacgcacgcacgcacgcgcgcgcgtgctcgctcactcgctcatacacaccaaccaggcacatctctagaatttaagacagaaagattgcccagatgatagcacaacatagtgaccccttacctaaatgaaacagaaaggggtgacttcctaagcatcatgcaatatcatctgagagacagaagaaaacattcaggcaacactgtggatcagctcacccatcaccagaattctagccattttcagtgtgaactgaggtaacacagtcattggatggtgcctccgatctgcgttacttgaaacagagtatcccttgactttagaaacagagagtggggcctgccatggctgggcaggcttctaattcagccttggctccgagtgctgagaaagtgctcagtctgatgacaccttgcttttctgtcttctgcttgaagtcgccgtgttggctatgaatcgttcccacctaggagggctggtgtattccacccctaccctctgagcctggagaaggcttctattcactcacgtagatcaaaagtcagaggtcaagcctaaagtgcctgcattttttatccctgtctaatttcactatatctcgtggggagggggaaatgaggttctgatgaatatgctagagtttctacttcattccttgtcttcattgacccccatttgacccctgtgatctgtgtatgctattccataagtagcccaggacgttcttaaagccatctgtgccagagccacagctggggactgtctcttgagcccctcaggggtcttccttaacagaagggacatggagttgttacttgctgggccatccaatcacttatgttatttcctccttgtttccatgttgcctctgcagattcatcatgcacaggcagcaccgaagagtctgaagtgctcaggagacagcgttccctctacattgacctcggagctctggctggctacttcaatattgttcgtgggccaccaaccctggaatacggctgatggatggctttgttggcaacaaaacaggatatttctctcctgaatgttggttttgcagaccctacacagcggccctggatagtgaattttacccaggtttttaggggtcaaggaggcctctagtgacacaggaacagctgtggcccttttttgaagctactctgacatgtcccagagcccaaggttctcatttctcaggtggtgggactagacagagggagtggcaagctcagggaaggatcatttctggtgataattccattcactttgcactttgatgggcattaaaaaaaatagccctcacaagatagtaacctcaaattcctgttcttggttcttatttaagcatgggtcttcattcaactcagaaggcctgatctgtgtatattctggtgtgtattgtatggtagctctttgagccttggttggtcgactctagtgtaagtttaattaattgtatattgtgtgaatagaacaacttaaatattacagcaatacactgggctagtgtctcacaaataactgatttactcagagccacctgacagcaggccactagtgacagtttctgttatgttcctatggaaacactgtactgtacatactatgcttaaaacatttaaaacacaatgttttaaatgtggacagaactgtgtaaaccacataatttctgtacatcccaaaggatgagaagtgtgaccttcaagaaaatggaaatatttgtaaattcttggtaatgcctccgttgtaattaatgaaactattttctttaaagtgtttctatgttaaaatagcatactgtgtatgttttatccaaattcattcatgaatctttcatatatatatgcatatatatacatatattgtagagtgtgaatattcttatttaaagtatatttttacattatgcaaatgaactttaacattttagtccaatgtgactagtcaaataaaccaaataaactgagtattttgtcttaatttttgggattgtatatttctcagctgggtcacaggtttgggataagaaactttgtcactggctggctcctctgctgttgccatggaatgccttcatgctgaactggtaaatgctttatccttggttggctgcactgacacagaaaaatacctgtgacttggggaaagtattccagtctgtgttgtatcttgtgtttatacagttataccaccttgagtgcagacttgtaagctgtttacttgtgaatgctaacactagtaactaacttgcttataaatcaaatcacattcaccaaattccagtggagacagtttaatgggaaggcacatgagaccgctaagtgatagaatggagcctttccatatgtgctggatacagtgtaccgtgtctctgtatggtaatcagcatcccagcactgtaaaaaaatgcctgagataagcagctttcaggaaggaaaggtttagtgaactttggttcaaggtttcagcagcttctctccatggctgcttgactctgttgcctttgggcctataatgaggcagcgtatcacagtggtggtatgcagtggacaagatgctcattccatggctcctgggagagagatggagagagaaaagcaaaaccggaacccagtattctcttcaagaacaccagcccaaactttactcccctaggctgctccgtctaaatagtaccatgggctgggagtgtatacacacacacacacacacacacacacacacacacacacacacacacacacacacagagagagagacacacgacatgcattcttcttaggaaacattttgagttttgttttttttttctcaagagctcaaagcaagtgaagagtagagacatgtttgagactagacctttctgactgcacaactcaagcccttcttcagtctgctgctcagggagagaccatcatctgtaagggaaagaccaccttgtaggagaggctcggcacaaactggaatgcaatgcctaagtaagggcagaggtgagattatcacaaaactgatggaacttcaggttcagaactcttcacttgtgtgagcccaggtgaggcctgaaagacttagttctgccctttacttaaaggttcatattaagggcatttgaatacggaggttccatggtatctcctgaccttgtcctctgcctgagaaacacagtaacttgatcttccattgatgatgtattcctgtgttcaagggaaaagcctgtgtttctactggagggcctgaggagatattctgtaggtctgaggacagattcatgccaagtttcactggcaaccaggtagaatgcgcccagttagatggcagatttgttaatggagaattgaagtctcatgggggagagggggagagggctgctccatgagcaaagaactgtggggcacacaagaaaaaaggatcctactcatttcatgaattcattatttttaatagctgagtagtactccattgtgtaaattttctgtatccattcctctgttgagggacatctgggttctttccagtttctggatattataaataaggttgctatgaacatagtggagcatgtgtccttattacatattggagcatcttctgggtaaatgcccaagagtatagctgtgtccccagtactctgtccaattttctgaggaactgccagactgatctccagggtggttgtacaagcttgcaatcctgccagcaatggaggagtgttcctctttctccacatccttgccagcatcttctgtcacctgagtttttgatcatagccattctgactggtgtgaggaggaatctcaggggttgttttgatttgcatttccttgatgactaaggatgatgaacatttctttaggtgcttctcagccattcagtactcttcagttgagaattctttgtttagctctgtaccccatttttaatagggttacttcttgagttctttgtatatgttggatattttccctctatttgatgtaggattggtaaacatcttttcccaatctgttggttgttgttttgttctcttgacagtgtcctttgccttacagaagctttgtaattttatgaggtcccatttgtcaattcttgatcttagagcataagcttttggtgttctgttaaaggaaacccaccccccccctcgcccacaagcttgaggctcttccccactttcttttctattagtttcagtgtatctggatttatgtggaggttcttgatacacttggacttgaactttgtacaaggagataattcacgaaattcgtaggcaaatgggtggaactagaaaatatcatcctgagtgaggtaacccaatcacaaaagaacacacatgatatacactcactgataagtggatattagcccagaagctcagaatacccaagatacaactcacaaagcatataaaactcaagaagaaagaagaccaaagtgtggatactttggtccttcttagaagagggaacaaattatccatggaaggagttacagagacaaagtgtggagcagagactgaaggaatgaccattcagagactgccccacctggggatccatcccatatacaatcaacctacctagatacttttgtggatgggaacaagtacttgctgacagaagcctgttatatctgtctcctgagaggcctgccagtgcctgacaaatacagaggtggatgctcacagccaaacactggactgagcacagagtccccaatggaggagctagagaaaggacccaaggagctgaaggggtttgcagccccattggaggaacaacaatatgaaccaaccagactcagcctctccccagagctccctgggactaaaccatcaaccaaagaaaacacatggtgggactcatgcatatgtagttgcatatgtagcagaggatggcctagttggtcatcaatcgggttttcagagggaaatcaggaaaggggagaacatttaaaatgtaaataaagaaaatatccaatattaaaaaaaaaaaaaaaagaacaaaggatcctggtgctctgagctgtctaattccagcagaaatgaatcacattccattctggaattattagacgattctcattttcaatttataacatctattttaaaaaagacacttctagtcaagtgtttaattgccattttaatttttacctaagagccaatttttattattattatttttagtataagaaatggaatccagggcctcacatgtgctaaacaattgtctcaactatagaaagccacttttaaaagccagtttcagcagtgatgcctagaacatgcccattagcagtaataggatcaggcacctacaccagcctctcacaccttgttctgggccacacaggaacagcatcaagccacacccatctgacttgtgtacttgtacagcaacacagcagggtttgtacctgcaactggggaggggagacaggtagatcagaatgaaaaaggatcacagtgctcctactctataggacacaacctctgaccaggagcaacagcagtctcttcaagagctggctcctgatatacacatttctacttcctaggtcagaaataagctgagctgaggcagctcataactatttcctggaagaagagagcatgtccttcattaatttttcatactaggatcaactctgatgacttgaccaaatcggagacttctgctccaccacatatcagagaaccagaagtgtgcacaacaggagacctgtttacccagaagtcagtgagggactccagaagaaggctgtctgaacatagaaattgatcttcagttgactgtgagcaaaacaatctcaacaatctctcactacaactctgcatggagatgtcatgggttgattctaagtggatcatgtggggaaaaaccttaagatggtaagagtagggaattgatactatcatctttaatgcatcagctagtaacaccttttgattcattaatttaaccattcaatgaaacttcatcttcccatatgaatgtgaaatttcttttttgggttgtgtgtgtgtgtgtgtgtgtgtgtgtgtgtgtgtgagagagagagagagagagagagagagagagagagagagagagagagagagatgtatatagacaatggtcatattccctgctccctttcacactccaccctatttttttgacagagagtcttcactgaatctaccactcattcatttggccatactggctggccagtgatatctaggaatctgcttgtgtctacaatctcagcactgtggatacactgttgcatctggccttaggtcctcaggcttacacagaaagccctttattgacagagccatttcattaaccccacaaatctaaaatttcatcaagcattttatttgaatatgtctttgtagcggtccatgtattcacaaatattcttgacattttttgcctaattaacatacatttgagagatcaaggtagttgaaaagaaagaatattttcagcacaaagaagattaatggacagcactgaagccttggatctaggagtggatttcacttctggctatcctccttcttgaagataccttctctgaacccgtaagattgagggtggaagaagagtgccttcaaatagcaacaagatggtcttctgaatatttgaagtttgaatgaaaagaaaagagcacacacatgcatacacacatacatatacacatatgtacatacacacacacacacacacacacgtcctctcctctctctgattaggtatttacactgttggaaaatccaggtcttgcctaagtttttatctctagaggatagacacagtctgaggagtgctatagaactgcttaagacatctttcaccttctttgtgtgtaatttaactgcaatagccagaaagagagagaataaaagaaaaattcattccaattttcttactgaaacccaagaagtatctttgttaggtctgtccagaaagcaggagggagcagaacatttggcacttgcctatccagcttctccccactacagttacatcccctaaccatcctaaaagtaactataagtaaatagccctaaaagtaactgcaggttattccactatacacagtttggtgattctataccagcaaacatgcacacagtaacataatttatacacgcctgtgtgtccttttggcagaacattttccaaatattacagagagaagtatttcactaagcttggcccttagcatgagtcttactttgtaggagaactatcctagtcattccttcagtatagtggaaggctctaattttccttgttcatttcttatgtcttctgaaaactggtgttaaagttgcatctggcccctgattctttttttttttttaaacaaaattgaatggcgaacaacttaccaatatgcctcaggtccatacttacttgttcagagagcagggtgggaaccagagccacttaattctaaccacaggattttactagcaggatgtagtattgttttctgcttactgcttctttcctagtgtcttttgcctgggaatcccagagcagaagtaaggcattacattatactaatgctaacgtcagggtatggggagttgataatagctctctggataaactgaccaagtttctcttgtaaggacagtgaaagactaaacctgtcaccactcaatatcaccaggagtaattgagaattggctggaggaaggagctaagaaagacaggccaaatccaaatgatattacagaaatgatagtgtttagggatagaaaactaagtcatggcttccccactgaaattagtgaaaagagatgagaaacgatggataccctagggtctaagatgctgtgtgtgacactttatagtcacactccatgaactaactcagtggcactcaaggaccttgtcttagggttacttttgttattatgaaacaccataactaaagcaacttggggagggaagggattatttggcttactcttccattatcactattcatcatttaaagaagttacaacaggaactcaaacagggcagaaaactggagacaggaactgaggccatagaggggtattgcttactagcttgctcagccttctttattataaagcccaagaccaccagtccagaggtagcaccacccacatggactgaaccctcccacatcaatcactaattaaaaatacaccctacaggggcttgcctgcagcctgatcttaagaaggcattttctcaattgaggtttccttctctaagatgactctagcttgtgtcaagttgatgtaagactagacagcacatacctttttgtggtagccataataatggggtattctagttctatttaggagaaaatgaatctcagaactccatgaatttggcagtctgaggtcctaatattcctaataatggaggaaagttcttccaaacttgctttgcattagagttagcaggtgtgttaggagtattggttttcatcctaaattgccttgattaccaaagccagagtgggattctattgcagagcctaggcccaggcaggggtttacaaaagcccatgtttgggcattacagagttggttcagagttggagaaacagtcaaaacatgacttcttgttctgtgaagttttccttttgcaaatctgggaaacaccctcgtagaaagcagacaggttctttatcaagtgcattattattatccttagcctagtggaagactgaagctacaagaggctggagaagcaggtaagacacttgctagtgcatggtaaacctgaggttgaggctcaagtctacctggcttcaaaatttgaggcccttccactaaatagtacaactctgtgaaatttctgaagaaaaagggagaaagaaattttttaccaaaacttattaaaataggaattcaagttaggcaaagatgacttgatctataattccagaacttggggtgtaaaagcagtaagatcatgaatttaagcccagcatggactatttagtgagactgtctcaaaaacagccaaataatgaataaatgaatggatggatgaatggatggacaaatgtatgaaagaataaataaataatgaaataggactctaagtatggtgacatagtatttaaattttagaagcaaagttattaacatattaaaacaaaatagctgtagaaagtgttcttcattcctaagtatcattttgttggaaagtgattacaggaatggtgagaacagcaggagcaggtaatgagaagaccaaacctaaggataataggtatagacaagaaggaagattgccaatttaaagggccagtaaatatcttcaacaaaattatagaagaaaacttccctaacctaaagaaagagattcacatgaacatacaagaagcctacagaactctaaatagtttggaccagaaaagaaattcctcctgtcacataattatcaaaacaccaaatgcacaaaacaaagacgactaacagcagtaagggaagaagttcaagtaacaaataaaggcagacctatcaaaactacacctgacttctccccagagactatgaaagctagaagatcctgggcagatgtcatatagaccataagaggacacaaatgccacctcaggttactatacccagcaaaactatcaattaccatagatggagaaaccaagctattccatgacaaaaccaaatttacaaaatatctttccacaaatccagcccttcaaaggataataaagggaaaacttcaacacaaggaggaaatctatgccctagaacaagcaagaaagtaatctttcagcaagctaaaagaagatagccacatgaacagaattccaactataacaacaaaaataacaggaagcaacaatgacttttccttaatatctcttaatatcaatggactcaataataatacatagactaaaagactggttacataaacaggacccaaaattttgctgcatacaacccacctcagtgacaaagacagaagctaccccagagcaaaaggatggaaaacaattttccaagcaaatggtcccaagaaacaagctggagtagccattctaataaataataaaattgaatttcaacctaaagttatcaaaaaaagataaggagggaaacttcatactcaaagataaaatctaccaagatgaactcaaatatctgaacatctatactccaaatgcaagggaatccacattcattaaagaaagtttactaaagctcaaaacacacatagcactgcacacaataatagtggtagacttcaatagcccactctcatcaatggacagatcatagaatgagaaactgaacagagacacagtgaaactaacagaagttatgaaacaaatggatttaacagatatctatagaacattttatcctaaaacaaaagggtataactccttctcagcacctcagggtaccttttgcaaaactgaccatataataggtcacaaaacaggcctcaacagatataagattgaaataatcccatgcattctatcatatcaccaaggactaaggctgatctctctaacaacataattaatagaaagctcacatacatgtggaaggtgaacaaacactctactcaatgataaattggtcaaggaaaaaataaagaaaaaaattaaagattctctagagtttaatgaaaatgaagccacaatgtacccaaacttatgggacacaacaaaatcagatctaagaggaaaactcatagttctgagtgcctccaaaaagaaatggagagagcatacactagcagcttaacagcacacctgaaagctctagaatgaaaagaagcaaattcacccaagaggagtagatggcaggaaataatcaaactcagggctgaaatcaaccaagtggaaacagaaagaaccatataaagaatcaaacaaatcaggagctggttctttgacaaaattaacaaaatagataaacacttagccagactaaccagagggcacagacacagcatcctaattaacaaaatcagaaacaaaaagggagacaaaaacaacagaaactgaggaaatccaaaaaatcatcaggtcatactacaaaagcctatactcaacaaaactagaaaacctgaatgaaatggacaacttcctagacagataccaggtaccaacgttaaatcaggatcagattaacgatctaaacattcccatatcccctaaagaagtagaaacagtcattaaaagtctaccaaccaaaaaaaaaaaaaaaaagcccaggatctgatgggtttagtgcagagttctatcagaccttcaaaaaacacctaatacaaatgctcctcaaactattgcacaaaatagaaacagaaggtactctacccaatttgttggaagccagcctgcagctaacatgaaccgggtttcacctgggaggcaacctggggctgaaaagagaggggaaactaggtggtcaagagaaagaatggagctaagtcaagtttcctgatcaaagctcaaatgtttaataaaagtctgcgcttataaagaggggaacccatcccttgccacactaagtttcttgatgtcatgatgccaagttgtcagcacagacttttagcagtaagtcgccaaatttacaggttgcagttaactccagaaaatcttggagaaccggtttggcctcaaggcaggtggtaggcagtgtcacatcaaaggaaactagctgagttggaggagctgcacagcaggtagcataatctgaatcagcctgcctaggctggaggaggttacatttcccccctgttatcaatattaaaaaaaaaaaaaaacggactgaggcataaaatttatttatgctctatagtcctgcctgggaattatggtggctggtggtcgtgcctgtcttaggaaatcttagatcttcccaaaccatccaattctgtcattgaggctatgtgcagctagtttgtgttatatttcacacaaaacatggctctgtt

SEQ ID NO: 1356 - DNA, 2507 bp, Mus musculus
agtgcaggcctgggctgtggcgcgggacgcgacgactggcgctcaccgcgcctcctgcgggggacactgcctggactgctgaactctgtttgctgagcctggactcccagcaggcactacagtgatggagtacatgagcactggaagtgacgagaaagaagaaattgatttattaattaagcatttaaacgtgtcagaagtcatagacataatggagaacctttatgcaagtgaagagccaggagtgtatgagcccagtctgatgaccatgtatccagacagcaatcaaaatgaggaacgttcggagtcactgcttcggagtggccaggaggttccctggctgtcatctgtcagatatgggaccgtggaggatctgcttgcatttgcaaaccatgtctccaatatgacaaagcatttttatggacgtcgaccacaagaatgtggaattttattaaatatggtaatcagtccccagaatggccgctaccaaatcgattcggatgttctccttgttccttggaagctgacatacaggaacatcggctctggtttcgttcctcggggggcctttggaaaagtatacttagcccaagacatgaagacaaagaaaagaatggcgtgcaaactgatccctatagatcagtttaagccatcggatgtggaaatccaggcctgtttccggcatgagaacattgctgagttatatggtgccgtcctatggggcgatactgtccatctctttatggaagccggcgagggagggtctgttctggagaaactggagagttgtgggcccatgagagaatttgaaattatttgggtgacgaagcacattctcaagggacttgattttctgcactccaagaaagtgatccaccatgatattaaacctagcaacattgtattcatgtctacaaaagctgttttggtagattttggcctgagtgttaagatgactgaagatgtctatcttcccaaggacctccggggaacagagatatacatgagcccagaggtgatcctatgtcggggccattccacaaaagccgacatctacagccttggagccacactcatccacatgcagacaggcaccccaccctgggtgaagcgctaccctcgatcagcctatccctcctacctatacattatccacaagcaggcacctcccctggaagacatcgctggtgactgcagtccaggcatgagggagctgatagaagctgccctggagaggaaccccaaccaccgccccaaagcagcagacctactgaaacatgaagccctgaatcccccaagagaggaccagccacgatgtcagagtctggactctgccctctttgaacggaagaggctgctgagcaggaaggaactacaacttcctgagaacattgctgattcatcatgcacaggcagcaccgaagagtctgaagtgctcaggagacagcgttccctctacattgacctcggagctctggctggctacttcaatattgttcgtgggccaccaaccctggaatacggctgatggatggctttgttggcaacaaaacaggatatttctctcctgaatgttggttttgcagaccctacacagcggccctggatagtgaattttacccaggtttttaggggtcaaggaggcctctagtgacacaggaacagctgtggcccttttttgaagctactctgacatgtcccagagcccaaggttctcatttctcaggtggtgggactagacagagggagtggcaagctcagggaaggatcatttctggtgataattccattcactttgcactttgatgggcattaaaaaaaatagccctcacaagatagtaacctcaaattcctgttcttggttcttatttaagcatgggtcttcattcaactcagaaggcctgatctgtgtatattctggtgtgtattgtatggtagctctttgagccttggttggtcgactctagtgtaagtttaattaattgtatattgtgtgaatagaacaacttaaatattacagcaatacactgggctagtgtctcacaaataactgatttactcagagccacctgacagcaggccactagtgacagtttctgttatgttcctatggaaacactgtactgtacatactatgcttaaaacatttaaaacacaatgttttaaatgtggacagaactgtgtaaaccacataatttctgtacatcccaaaggatgagaagtgtgaccttcaagaaaatggaaatatttgtaaattcttggtaatcgctccgtgtaattaatgaaactattttctttaaagtgtttctatgttaaaaatagcatactgtgtatgttttatccaaattcattcatgaatctttcatatatatatgcatatatatacatatattgtagagtgtgaatattcttatttaaagtatatttttacattatgcaaatgaactttaacattttagtccaatgtgactagtcaaataaaccaaataaactgagtattttgtctt

SEQ ID NO: 1357 - DNA, 1404 bp, Mus musculus
atggagtacatgagcactggaagtgacgagaaagaagaaattgatttattaattaagcatttaaacgtgtcagaagtcatagacataatggagaacctttatgcaagtgaagagccaggagtgtatgagcccagtctgatgaccatgtatccagacagcaatcaaaatgaggaacgttcggagtcactgcttcggagtggccaggaggttccctggctgtcatctgtcagatatgggaccgtggaggatctgcttgcatttgcaaaccatgtctccaatatgacaaagcatttttatggacgtcgaccacaagaatgtggaattttattaaatatggtaatcagtccccagaatggccgctaccaaatcgattcggatgttctccttgttccttggaagctgacatacaggaacatcggctctggtttcgttcctcggggggcctttggaaaagtatacttagcccaagacatgaagacaaagaaaagaatggcgtgcaaactgatccctatagatcagtttaagccatcggatgtggaaatccaggcctgtttccggcatgagaacattgctgagttatatggtgccgtcctatggggcgatactgtccatctctttatggaagccggcgagggagggtctgttctggagaaactggagagttgtgggcccatgagagaatttgaaattatttgggtgacgaagcacattctcaagggacttgattttctgcactccaagaaagtgatccaccatgatattaaacctagcaacattgtattcatgtctacaaaagctgttttggtagattttggcctgagtgttaagatgactgaagatgtctatcttcccaaggacctccggggaacagagatatacatgagcccagaggtgatcctatgtcggggccattccacaaaagccgacatctacagccttggagccacactcatccacatgcagacaggcaccccaccctgggtgaagcgctaccctcgatcagcctatccctcctacctatacattatccacaagcaggcacctcccctggaagacatcgctggtgactgcagtccaggcatgagggagctgatagaagctgccctggagaggaaccccaaccaccgccccaaagcagcagacctactgaaacatgaagccctgaatcccccaagagaggaccagccacgatgtcagagtctggactctgccctctttgaacggaagaggctgctgagcaggaaggaactacaacttcctgagaacattgctgattcatcatgcacaggcagcaccgaagagtctgaagtgctcaggagacagcgttccctctacattgacctcggagctctggctggctacttcaatattgttcgtgggccaccaaccctggaatacggctga

SEQ ID NO: 1358 - DNA, 47573 bp, Homo sapiens
  misc_feature (46686)..(46806): "n" at positions 46686 thru 46806  can be any base
atcaaagcatctaagtattaaggaaaaaatccttctgggctgagtgcgggtggctcatgcctgaaatctcagcattttgggaggccaagcaggaggattgccagaggctgggagttccagaccagcctagccaatataatgagacccctgtctttaaaaaaataataaaaatttaaaatattgttttaaaaaggaaaaaagttctgatgggcattactccatagatttaatttaaaaaggcaagcaatctcccctcaccacactaaagaaacttaatttgctggcaattgcttttagtactgcagcataactgctatggtttggatatgtcccctccaagattcaggtgttgccaatgtgatagtgttgctggaaagaggtcccagtccagaccccaaaagagggttgttggatctcatgcaagaaagaatttgggacaagttcatagagtaaagtgaaagcaagtttattaagaaagtaaaggggccggccatggtggctcacgtctgtaatcccagcactttgggaggtcgaggtggacggatcacctgaggtcaggagttcaagaccagcctggccaacatggtgaaacctgtctccactaaaaatacaaaaattagcctggcatggtgatgcatgcctgtaatcccagctactctggaggctgaggcatgagaatcgcttgaacctgggaggcagaggttgcagtgaattgagatcacgtcactgcaccccagcctggaggatgagactctgtctcaaaaaaaaaaaaaaaaagtaaaggaataaagaatggctactccataggcagggcaggggctcaacgaaggatacctatagttatttcttgattatatggtaaacaaggggtggattattcatgagttttcggggaaaggggtgggcaattccataactgagggtttctccgctttttagaccatataggataacttcctgccattgccatggcatctgtaaactgtcacggtgctggtcacatggtgctcttaacatgtgaatgcattgtaatttgcatataatgagcagtgaggacgactagaggtcacttttgtcaccatcttggttttggtggattttggtcagcttcattattgcaacctattttatcagcaaggtcttgtgccgacctcctatctcatcctggaacttagaatgcctaacctgtgaatgcagcccagtaggtctcagccttattttacccagctgtattcaagatggagtcactcttgttcaaaagcttctgacaacaggattaagaggtgggacctttaggaggtgatcaagccatgagggctcttcctttgggaataggattaaagcccttataaaagaggcttcagggagcagtggctccatagccctttgacaatccatcatgcaacaaggcatcatcgtggaaggggagagcagccctcaccagacaaccaaatatgcccaacctgccagtgccctgatcttgtacttccctgcctctagacctgttctttatacattctcctctttataaattacctaggctcaggtattttgttatagcagcacaaaaagggactaagaaaggaaaagtcaaggaacaaaatgtgtttagctcagcttaaaacaaagtctcacatgaagataagcacaccacatccttttaaatccgtttcccaaaccattgcatggggaaaacaccatttcaaaaagactaataaattatttttgaagggtataatattctagttttattttgttcatttttttttttttgatagagtcttattctgttgcccagactgaaatgcagtggtgtaatcttggctcactgcaacctctgcctcccaggttcaagcaattctcctgcctcagcctcccaagcagctgggattacaggtgcacgcccccacacccggctaatttttatattttcagtaaagacagggtttccatgttggccaggctggtctcaaactcctgacctcaagtgatctgcccgccccggtctcccaacgtgctgggattacaggtatgagccactgcacctggtcacgcatgttctttttttttttttaaagacagagtcctgctctgtcacccaagctggagtgcagtggcctgatcacagctcactgcagtctcgacctcctcagctcagtcgatcctctcacctcaacctcttgattagatgggagtacaggtacccccaccacataggctaattaaaaaacgaattttttttagagatggagtctcactatatcgcccaggctggtctcctgggctcaggtgattctcccagctcagcctcccaaactgtgggattacagggtgagccaccatgcccagcccttttttctgtttttatgcatttacacttgcatgtacaggatggggatcagattatatatatatatatttaaccaattcctccccctgcccaaacaatatgttgacagcagttccctcccttcacaggcagagccttcactgtgcagtattttcaggccctgcattgtactgaggggagacaggactgtgaggttaatatgtaaaggagtgagaggaggcacttaaggttgcatatgggaaatctccaccaactcaattggggctacaccatagcatttagccctaggcagtttaaggagatagggagttggagagagcatgattgctgagcctttctccccctttaaaagtttagcaagtgaggccgggtgttgtggctcatgcctgtaatcctaacactttgggaggccgaggcaggtggatcatttgaggtcaggagttcgagaccaacctggccaacttggtgaaaccctgtctctactaaaaatacaaaaaattagccaggcgtggtggcacaggcctgtaatctcagctactcgggaggctgaggcaggataatcgcttgaaccttgcaggggcagaggttgcagtgagctgagatcacaccactgcactccagcctgaatgacagagcaaggctccatctcaaaaaaaaaaaaaaaaaaagtgtggcaagtgaaagctactgcatgcgcatgaggacacagtcttgcacagttctgggtgctagcagtcctatgccatgtggtcatttcggaaggccatgatcaagaaaccctgcacaaggagtttccatttgggaggtggaacacaggagcacagaccaatagttctgtttttaaagtgcagttcgagaacctcaaatttggggaagccacaacactaagtaagtaataaaattcttaacatttagcatacagaataatgctatttaggccctttgagagacctacattttagttttctgcacatgagaacagatggtcttggttcatatacaggcccaatttacacccagccttcaagataaacaacagccacagctgagtgaatttaggaactccccttcccttcccagggttaccggggacttctctccccttcccccacgggaggacctcatctctgcctggggccccatttcccttgctcagttgctattttcactttacacaggaaaggcaaaagctggtgagctacctcccaaaggggaggagaaggaaaacggaaggaggaggatggagaagactgtccctttcaaccttgtctgcattcctcccccatagtcctaaggtggatgggaagggaagagggttgtaagagctgagggcatagtcttgcctattgctgtaccatgaatgcattatagatactcatctctattgcttaaggcaggcaggtgggcctgtggctctagggcctggtgtctttccaatctcacctgggttgtcttagagggctgctgggggacagcagaatctaatgaagcaccctgtggtccccacaggtctgatggatggctctgctccacctcaagatgctaagtgaggctgaacaggttctcatgactgcatggtcatgaatagagggcctagcctgtgttagaggaaggagtttatgttttaggtattggagcagatggccatagtccaaggagcagtcagtggcagaggtggggcatggggtggagctgttcgttcccacagtggaaaaggcaaccctaaatgtctacctccgttggatacttcattctttgggccgatgtgccttttcagtggtatccaaggtaactgctctaaggatgcatgcattttctgcatgttactttgtcattttgaaaatcccgcccctcttttttttttttttttttgagacagagtctcactctgtcacttaggctgcagcacagtgacatgatcatagctcactgcagcctcaacatcctgggctcaagaaactgaggaccagagagactgatatggagaacaggaggattgtttattttaggtatgcaccagctcagtggattcgcatccaaaaagctgagcattgaacaaagactgagtggggtttttataagcaaacctacaaaagccaaacaaaagcaattaatcatacagtaacaggtcacataatctatagcataactgttgacttagcataacttgtggccttgcctagctagtgaccttatagctgcgtcaaaagaaaaataagaactggctaaatacagagatttgtaaaacataatcatgcttaagaaaccagggaaaggagtaacagtaaaagaatttgtctttttcttctttttttttttttccttcaacctttctctggaggggggtgttgtctggagcccattcctttgtccttggctttctggacagcattatcttataactcttcttgaagtgagcttgctaggcagaggaaaacttgaaacttgttcttttctttttaacctttgccgtgcctgttacttttcttacagtgaatgaatgcatatttatttttaaatttctgcctcatctcagccttccgagtagcttggactacaggtgcgtgccaccatggccagttaatgttttaaatttttttttttttttttttgtagagagaggattttgccatgttgcccaacctggtcttgaactcctgggctcaagaaatcctcccctggcctccaaaagtgctgggattacaggtgtgagccaccatgtcctgcttgaaactcttaatataaaaaaaattgccagatgtggtggctcacacctgtaatctcagcactttgggaggctgacgtgggtggatcacatgaggtcaggagtttgagaccagcctggccaacacggcaaaaccccatctctactaaaaatacaaaaattagcctggcatggtggcatgcacccgtaatctcagctcctccggaggctgaggcaggagaatcgcttgaacccgggaggcagatcttgcagtgagctgagatcgtgccgctgcactccagcctgggcgacagagtgagactgtgtctggaaaaaaaaaaaaagaaagaaagaaaagggaaaaaaaaccagaaaaactttaattatttttattttattttttatttttgaaatggagtttcactcttgtcgcccaggctgaagtacaatgacacgatctcagctcactgcaacctctgtctcccaggttcaagtgagtctcctgcctcagcctcccaagtagctgggagtacaggcatgaggcaccacacccggctaatttttgtatttttagtagtgatggggtttcaccatgttggtcaggctggtctcaagctcccgacctcaggtgttcccacctgcctcgcctcccaaagtgttgggattacaggcatgagccaccacacccggccagaaaaacttcaattatatctgaaatccactcacattatcataagaaacttacacatatcaatgaaaaaaaaaagagatactgaatttttagaatccaatttcaaattgttcacaatttaagacaataataatagttgtaaatgtattacctacgtgtctgtacagcttctcagctgaaagttattatcaaaagtataaagaagttgttgttgaaactcttaatctgtatagctgtttcaacatgaaaccataaagaaaaagttatgatcatgaaatcaggctcaagttcctcttaactttaaaaatatctcatttaaagctttattcaaattatctactttcaatactttgtattttattgtttttttttaacaaaaaacaacatattttcgccaagtgacctatagctatgctcccaatttattgcagttattttattcacaaaattccatattttatgaatataaaaaactgagaaacaatgccccatatcatattaattagtctagagcacaattgtggttacatcggttaatgggccaacagggttacctacccattgttaataattttctttctgtgagtaaaataatttggatttccaaactacaaattacaaacccattaatgtcccaacctatgagatggagcaagcttcttcaggtaaactgcaatcggttacagccttatttgcaaatgcattttgcttgcttcaaacagcttctagagagctgtttcgtaatgtgctttaggatcacttccagaataaccccctatggttgtgtgcactgtggctcaagggacttctcattggtaggtttaaaactcacttagctcgcccctagaagagcaggattgtttttgtaagcctgcataaaaaacaaaaagccagaccagaaaaatgcaaggagtctaggcaaggtggctcacgcctgtaatcccagtactttgggaggctgaggcgggcagatcgcttgagctcagaaatttgagaccagcctgggcaacatggcaaaaccccgtctctaacgctacccaaaatacaaaaattagccgggtgtggtggcatgcgcctgtagttccagctatctgggaggctgaggtgggaggatcacttgagccagggaggtggaggttgcagtgagctgagatcgccccactgcagtccagccagggcgacagatccagaacctgtctcaaatacatcatacatacatacatacatacatacatacatacatacatacatacagggagtccacagactttttctttcttttcagttgctctctcccttttggcctccttgttaaaaactctacatacgttttcaagtaaaaccttctaatttaccccaacagatgaacctgctctggattaagccagaagcaagagagaaccctgctagaccagccatttcaccagctccctaaaatgcagctatatttgggagacttctgtgtaggaagtaaggctaataatgcagttcccagaagattaggtgtggttttaatgagctcacacaaggcgggtggggaggggagtggttccatggttctatttttaaaactcgtgtaaagatcatcctttgttgtctaaacacggcagtagagaaagagacgtctctgtttctcacgttacaatcagaggtaacaacctgtgctaacctggtttccagcgaaaaggccaaaagtgtactgataacttcggcttcagctgagactgggataacccgcttgagccagtgccaaattccacccatccggcgcgcaagcgagcggggcttctcctccccaaccccggcccaggctgcttctgccgggtcagtgctgccgggttggtggaagctgccttccctccctccaagatcagaaaggcggagggttcaggaaggggttctcctctaggtgcaagggactgcctggatatttggagggaatggcaaagccctgcttcatgaggtgaatgaatataaattaaatcgctctcgtatttaaaataacttgacggatgacagtgcccattcagtcaatcggccctcgacgttggatttgctacctgggcttgttgtctgcgagttaaggtcctgcaaaaagcccctggcttgtcacctcaactaacctatctcctccagcaattctctcaatacatcctcgggttgtattgtaattcattttccatagcagaaatgtggagggctctagagaaggtacaaggcaaattttttttttaaattttatttttggttggccgcggtggctcacgcctgtaatcccagccctttgggaggctgaggcggacgaatcacctgatatcgggagtttgagaccagcctgaccaacatggagaaaccccatctctactaaaaatacaaaattagccgggcgtggtggcgcatgcctgtaatcccagctactcgggaggctgaggcaggagaatcgcttgaaccagggaggcggaggttgtggtgagcccagatcgctccattgcaccccagcctgggcaacaagaacgaaactcagtctcaaaaatttttttgttttattttattttttaaatttgagacaaggcctcgctctgtcgcccaggctggagtgccatggcgcaatcatagctcacggcagactcgaactgctgggctcaagggatccccctacctcagcttccgaggagctaggatgacacgcgtgagccaccatgcctggctaatttttagattttttgtagagacggggtagctatgttgcccaggctggtctccaactcctgacctcaagtgatcctcccgcctcggcctccaaagcgctgggattacaggcgtgcgcaaccgcgcggaggcaatctagaaactgcagagggagcacggacctgggcactgggaagaatagggcgtggacttggagtgtgaccgcgtttgaatctgggttgtgcctgggacaccccacctcctgggccgtaggtggggggggagagagagagagagagagagagagagagaggatgtcgaccttacatggctcctagctctccgcgctctagccgaatgcctggttcctagtgggtgcttgatacgtgggaaatgtagggggagggggtggcggggcattgggaatgtcccgcagagtggatttcgggagagtggcgcttttctctagaactctcttccggttacacctggagtaaaagcttgacactctagaaggaaaaccccagatgagcagctaggactgagggttagcggtaggcgggagcggggagatagtacaagtacgcttcctaatgaggcggtgccgcaaaataaccaattttaataaagactgcagagaagaaaaccaggttctgctggcggagtgcacaggctcccagccgagcgcccaacaaccaggttccgggcccaccctgccgcagcctcttggaaatctctaagttggaatgtgtgcgtgcgcaccacgggtcactgccctctttgtgtgtgaatttgaagcgaaatctgggcgaggcggggccgtgctactagcaatcggacccacagtcgcggttccaagaagccccgaagcttccccggcttcccgcagcactgctgggagggcacacggcgcctctgtccccaccccagagcgtggggcgcgcggaaaaaggtctggtgactgccctccccgccgccccccgggagcgtgccctcccgccggaccctgggactccagagaagcgccgagggcgcgagtacactaagatatacgaccttccctggggaccgggaagggcacaaccacctcttgcaactccgccactaagacgccttgggtcaccaggcccgggggaaaactcgtccccgtcccaggctctcgattcgggccgcagctcacgtcccgcgctcctccctgcgcgccgctctgctcctccctagtcccgcctccagctccgcccgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcaggtaatccagggttgggggtctccggcgtgtctttcgggtcgcgtcccgcctgggtgccccggggattcccatgcagaaatggagggtgcccccagcagaggggaaaactctggcgtgggaagaggtgggggcgtgcccacagctgcgctcgcgggtcgccggctgcaccaggcacagctggaaagcaccttgcgcaagggtctcacggggtgcagactcgcgactcctcccccttcctcctccttcccgtatccgcagcgccagggcagtgctggtctgggcagtacgcggggaagcggggacccgctgtcactgcgcctcccgctgccgacgccgcctggacggccgcactctccctgcccgagacccggtgagtgcagctcggaggctggaggacccgatcctcccaaatgctgggtgctttgataatttataagccttttaggctcccttgacttagagaaccaggaggaaaggagtgggagtgtgggttggcggagcccagagacttgtgaatggctgggactaaattcaagtttgtaacccggactctatcccatgactaaagaggtcatagcagaacacgaaggctgggcttttggtctaagaaagaatactaggagaaaaaaaaagttattttcacggaagttgttttcgagcgatagtgcatgatcaggactctgaaatttttctagctctgggcggagaaggacgcctagggattgtctccatagttaacaggggaaggccaccggctgcctgtaagagagaaacgttgcgatgcttgtctatttcacttttgggaagacaagattaaaggctgctcttgataaaaaacagggacagaaaggctcttgcagttgctttacatacctgtggcctgagtcgtttgtgccaaggagagtgtaatccacttccagctgacgcccccagctctctgcgacggattgaggtttgtgtgcaggacgtctggcatacggcccatgaggactttgtcgtgtaaagcaaatgggaacgttgaggcatgtagaggttttgaagcagagtgtcggtccttccttccatacgcctgaaacgcataatccggggctttttgagagcaaaaacatagtcagaaatgtgccctgagggagaatgtactattttggcacacatatgtatatatgtatatataatttttaaattttttttgagagggggtttcactcttgtcgcccaggctggagcgcaatggcgcgatctcggctcactgcaacctccacctcccgggttcaagcgattctcttgcctcagcctcccgagtagctgggattacaggcgcccgccgccacgcccggctaatttttgtagagacagggtttcaccatgttggccaggctggtcttgaactcctgacctcaggtgatgcaccctccttggcctcccaaagtgctgagattacaggcatgagccactgtgcccggcctaaaaaaatattttaaatgagaaataacacaagtaatagtcattctttgttaggcagaagcatatgctgttatgctggccattttcattcacacttgccaggaaacactcacattttgtttctgtatatggaggcagccaagagtattatgttaatgtttaggaagagaatttcctcgtgattttattgctgatttctgaaataattcagtgtaactaattttgactgtatttgcacatctctccaattccaaaagctggcataattttctgtttggttaggaagtaggaattttatgaggacttttattgtaaactgtgtcaagggaaaaatcatcttatactaaacgtctttattgccaaactagaataccttcacaatctgaactttctctagatgggcacagatcatgaataactcagaaaccattagcatattgtgtgcttaattaaggctggaaagtgctgaggctttttgcaggcgcagttagcaggcgaactggtcagcagggtttctggggaacgtagatttgcgtgacaggggccctgtgttgctaaggaattaatgcaggcactgagaaaagtctcagcgtcagacactcctccacctcccgggtcctgcttccctccctctcccctttccaggcaactcacagtttaggggtgtggttgtgtgtgttcaagctcttgggttttacatataaatgcctgagacttttctgcagggtttaaaaactaacatcttgtcttacagctcttttaggatttgtcttttagaatctccagtcctcacaggaaaaccccccaattaaaaaaataaaagaataaagaataaaaagaataccactactactataaaaaaaaaaaaaatcctctaaaatttgtcttcccagatcagcagagtgaatttgaactgtgtggacttttttcctctttctttcttgagtcatgttagtactgagaacttttttttttttctgtcaaatcatctgtttgataaataagtccaggagacttggatcctttcaacccctgaggccctaaattaggctgttttttttttaacctctgtgtttccagtaaattcgacaagcagaaactgcaactaaacggctcagtaaaaccgaagtcaaatgttcctccattaatctaagaagttgctctcctaactcagcagactccaagaacctgaatcacaatctccctcgaagatgtacaagatctcaggaggggaagctgccccctcactctagatttcacggtggtgataacagccatgaaagcatttcataggtttctgccttttttttctctctctttatgtcttgttttagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgaggtaggtgctgttattacttccattttacagatggggaaaattgaggtcgagagaggttacgttacttgctcaacgtcatgcaagcagtaaatgggagtgtggggggaggcaatgagatttgactccaagcagtctgagaccagaggaatgttggattgcaggatgctaaactgctttcctcagacacaattcatacgtcagaaaatgaccatcaagtaagtgaatgatgacactaaattgcatggttcttttgtcaaatgaaattcactgagaggcagatggctgggtcatgcgtgcaggtggctctgcagtggagcatttcctggagctttgaaatgaagctccagattgatcagacgtgcgtggctttagccctgagtgtcctgtgtgttaaaggcttgtgcttctcagaacttgaaatacctttcagaaagaggctatgcttttgggagtgcaatcggtgatttaagtaaaccaatgtgccttgaaattctcttagatctcttaggaccttttgtcttttctccttcagaacagagttgttctaaaatcctgagtaacaacgtcagtttttacccttgctttactttctttttctcatctacagatctccaagtgtggcagctgatttgtatataagagctgaaatgcaattttggttaatatagtcacttggacttgcttatgataaatttgactttcctggcttctttctactactcacagcttctagaaggccatttatttatatattaatcttctgggaccctcaagatgtttgctttgcactattaaagaattctggtcctaagggaggacagctgaatcataggttaaatgtatcatcatctttctcatactcatcactgggagaacaaggtttcctgtcatccttccaattagctgtttaactcatttgcataagaatcattcctgaaacttgacctattgccatcaaatttgtgtagattgaaatccatttttccagcttctggctttcagggcctgagttttatttgccaagttagctcctgcatttagtgaagaggttatttttctttaaagtcaccagaggcataaaaaagccatagcgattcttgcagggagggtgccacttcgggggaatagctgggttgtgtaaggttggaagccctaaagagccggtagcctaaggtcttcaaagatttctgagctgctcttgattcgtgtgtatgtttagtgaaagtttgttttcagtgcctgtagctgataccactgactctgtgagtaagagtaagctctctggatctcaggtttccctctgcaaagtgagctggactaaaggttatcttaggtccctttcaactctgcactgtcaacttgaattcatacacacagttgacacagaaccctcgttttctgaacaaaagcatataaaatcctgttgccaatccttgtatgtcagtttcccatgggtcttgaatgcaaatacaaatatcgtaaactaaatatttgtgttttctttcctagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctgctgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattcttgatcatattttagtagtatttctacaaataggtaattaagaagaatgtattttggccgggtgcaggggctcacgcctgtaatccgtgcacttggagaggccgaggtgggtggatcacttgaggtcagcaattagagaccagtctggccaacatggtgaaaccccgtctctactaaaaatacaaaattagcctggcatggtggcgggcgcctgtaattccagctacctgggaggctgaggcacgagaatcccttgaacctgggaggtggaggttgtgatgagccgagatcacaccactgcactccagcctgtgtgactgagtgagactctgtctcaacaacaacaaagaagaatgtattttaatttaacagttcactaaaaagtttattcatcagttatgcagaaaagaaaggcttaatgagactccttcgtctgagaggggaataaacactttgtcactaattaatcttgaaggctgaattatttgttcctttcttgtcacatcttgaaatgttattaattcatttcttgcaaaaatgtagtatgtaggcagtaaatagctatccacagattcactctctttcattggcaaagtatgaatggcaagtgatatatttgcttaatcatcgcaagtatgcaaatcatgcaaaatattgtggcaacattttgttgccataatagtagatcaggtgatgtgtttaggtgtgcctgggattctgtcaggcttttagtatgtcagaggtgaacgtaggtgctggctaaaggtaacctaatatttttaaaaagaataatttgcaaaggagtaggtggtagcttgcaaaacatgcttattgatgaaagtgacgccctttcttttggtgtatctaaatggcaaaatggctaatgttgggggaaagtcggtgctgaatgagtgcggagtccagaaaaagtacttaattattttgtttttttgcataccacattcatttaattaaaaacaacagagtaatttaggtcaggtatgtagtgaattgttttgtcagaagccagtcatactcaaccatagctcacaatggagcaagataatattttgcattgttgtgtgactgctttggtctggctctatcaagctctatttaatagtcgactaagtactttaccttcagaatatttcttccttttataaatgagaaataatcatttgaactagaagccatatctgattttcccaaataaaggatagttggagaactcgggttcaaagttatatatatgtctataccgagaaatataattgtttgtgtatttctctcatttttaacgtatttatttgttaaaatgggaattaaattttttttaaaatcctgctccttctataaaaatgagtattttaaatgaaaatatgcagaaaaaaaaccaaagtattcttgcttgtaaatatgcaaagacttaggtatgtttgcttattccgtggcctatctgggaatgtacagaaagaaattcaggaaatttagaagaaatacaaagaaacaacattctgaagtcttttaggaatgggaccagaaaagttaatcctaaaaagaagagagactaagacattaagatgaggataaaattgtatcagcaaagggtttgagtaaaatgttgtcattacctgctgtgggtcctgtgctctttaaaagaacaagtacataattaaggagaattcttttttttttttttgagacagagtctcgctctgtcacccaggctggagtgccgtggcgcaatcttggctcactgcaatctccgcctcatgggttcaagcaattcctctgcctctgcctcccgagttgctgggattacaggcctctgccaccatacccggctaatttttgtatgtttagtagagatgggttttcaccatgttggccaggctggtttcgaactcctgacctcaggtgatccacctgccttggcctttcaaagtgtggggattataggcgtgagccaccgcacctggccaggaaaaattttaagaataaacaaatacataagtaaaggcagggatcttgaaaaactttaaaaagatttttattttaaaatgatcaagaatataacatataaaacaagaagactaaaaaacagaagagaataagaggaggaccttaaaatctattggatcttagatatggcctcgctaggcaaatcgacccagtggtcgatggctctggggggctgcggttgactttcctgccactcacattaaagatggactacattgctgtgcctgctaggtaacccatcagagctccatgcttcataaatgatagcctaggaattgggactgtcatctctgattgtagtcacttcaagacagtagtgagggaggcaaggcttgctttcggctccctttcatcctcacgtggaacattggaaccacccaatgttcaagatctttctattcccatcatcttccacccactaccctatcagaactttactcactgggcttcatttgctgctctctaactctcagctttaggaaaatagcagctgattggttcctaggtaaaatccatctatatgatgtatctacatagggatggggaaactttcattcaagtatttacctattcatttgctagacacagcttggacatctgcagtgcgtcgggtgctagagatagtatggaacagtctgtgcctctgggagcttgctgcctggtgcatgcaggatgcagttgaataggcagttatagcagagtatgctgcttcccagcacgtgtgcatgctgtttgctctggcagtgcacaggcaggatactttacatagccatgagtgtggtagaaggaaggagaatgtcagcacagccttccaagaaggatttatgcctaagccgaggtctgaagtgttgagttggagtcagctagatgaagtggacagggtccaggtggagaaaacagcatgtgcagaggtccagagacatggagacctgatgtattcaggcagccaacaaccacaacaccattgagttatttagacagggtagagaaccaggaattacaaaagcatcctgaagaacaggcatgttcagtgattgtgtgtgtgatttgactaaaaataatatctgttaaagatcccaccaacatccagcaagatctggggaagaagctttgggagactaacctgggaattgctttgggtaagagtgctgcatgttatttatcatctacgctgattcataacctggcccgggaacaaataatctaaaatgagttccaaacactcaactctttggtggttttatggggactgaaggaccccaaaaccttcaccccttttttacaactttatatctataagtgtgagagctgaagatgttccttagggcttagtcatggagtcatggcttctcagagttgaaaaagcctttaagatacttgagtccagccctccgtctagtactcaaatcaccctgttcatcatctccaataattggtagaacattttggtatgttcttgaaaatctcctgtgacaaggagctcattacacactgggacacaaagtttcctatttgtccagtcctgactgtaagaaagttctcttccttatatagaaccaaaattcatctctgaccgtttagtgcaagccctacttattggccattaaaaaaagtgcatatgatgagcagtggtgaagacgatgggtcctgaattaaagtacctgggttatgtagttcagctctgaaatggattggctgtgtgaccctgggctggtcatttcacctgtctgtgcctcagtttactcattcataaaatggataacatcatgacactccatagagttgatatttggagcaattaatgaatacatgtgacctggttacacatagtgagtgttaaatgaactcgaggcattgtgggagttactgttgtatacaattgttacaccccttccttatgacagtccttccaaaattttttaaattgcatgttccccagatcttgtctcttctttcacatgcatttccaactgtgtgcatgacttctcatgaattgtactattaactctctcatcatctgggcaggaccctgtgaactcaagcttgtattagtgtctatcttagagccatattttgaatgtgaggatccatttgttgtgatcagcagagtgggacagagctagcttggcctttgtgctagataatatgcctgcatgaatatagatcgataccatgtctgtttcatagtagcatatcacaccagtcacttgtggaatctattcttactataatacttaaagagttttctcaatatgctgcttcttggcccagtgttgtttcgtataaatgacagtgatctggatgaggagataggaagtgtgcttataatgcctgcccttacaggtgattttggtaagttgaagaactggcagagataagcagcatagagttccctaagatggtttgatagcgctgggtgtggtggctcatgcctgtaatcccagcactttgggaggctgaggccagaggatcacttgagcccgagtttgggaccagcctgggcaacatagtgagacccccatctccacaaaaaaataaaaaagtcagccaggtgaggtggcacacacgtgtagtcccagctacttgggaggccgagatgggaggatcacttgagtctgggaggttgaagctgcagtgagctgtgatggggccactgcactccagcctaggtgacagagcaagaccctgtcttaaaaaaaaaaaaaatttatacgggcccctagaaagaagaaaaatacccatctaaaatttaaatacagggttcgagaccagcctgaccaacatggagaaaccccatctctactaaaaatacaaaattagctgggcgtggtggcacatgcctgtaatcccagcaccttgggaggctgagacaggagaatcgcttgaactcaggaggcagaggttgcgatgagctgagatcgccccattgcactccagcctgggcaacaagaacgaaactccatcacaataaaataaaataaaattaaattaaattaaatacaggggatctggggctaggggaagaaccaggcatttgcagaactgcaaactggtcaggacttgcacgttacactagaaattcagggcccatcatgaaaagagcctaggagaactcataggcattgaaagctggtccccagaatctgggaagttataaaataggggtgaatgggggtgaaggaacttgcattatttgatctacagaggagaaggctaaggtatgctcagaaaatatgtaaacacataaataactgagttatttttataacccggcatttaataactgggttttcatcttagctcagctttaattatggccttctggaatatacaaggctcttacccagactaggaggtatgctttggagtcagacagatctgagttcaaatcctaatgccagcactaactagcatgttccttaacctcttgaagtcagtttcctcatctgtgaaatggagataaaaatagtagttaagctcagactattgtagacttcgatgagataatgtattgaagtactgagcacattgctgtacttagaactcaacaaatggctgaaattatcttttgtcctcttggacagaataagaggacactggttcgaggtgggttataggccaggcacaggtggctcacacctgtaatcccagcattttgggaggccgaggcgggtggatcacttgaggtcaggagtttcagaccagcctggccaacatggtgaaaccccatttctactaaaaatacaaaaattagctgggtgtggtagcacgtgcctgtaatcccagctacttgggaggctgaggcacaagaatggcttgagcctgggaggcagaggttgcagtgagccaagatctgccactccactccagccactgcactcaagcctgggtgacagggcgagactccgtctccaaataaaaacaaaaacaaacaaaaaaacctaaactgggttataacaaatttaggttggtaaaactttcatgaagatgagttaaacacagagatggttcactggagggtgaggtgaaatcaggcctgtaaatatttaatgacaagaaacggaaaatcagcaagtgctcttgagtgttgtgagtagggttctgtctaaatgtgaaaagggactaaatctatcatgttctcagcatgctgcaaaagaggcctccagcaaccagaggcgacatacaggttatctttcaaacaaggcaagaccgccatctgcacttattcatgttagctctagggccctgcacagggtctcacacagcagaaacactcagtaaatagtttctaaatttaatgacttcatatttctaagcattagagttagtctctgctttattccctgactaatagtgaacacatctgtttgtgggatgtgtagctaaaattagcagtggtggagctgactgaatggcccttacagttactagaactatttctgtagccgtgtccctagtaagaagtcccatgcatctgcagatgaatcaagagttcattctcttcccatgtggtagatctggggatttgtcacattcccttcagcagctgctgctgcctcttttaagttttaaacaaaatagaaatggagtctcactgtgtcacccagactggtcttgaactcctggcctcaagtagtcttcccaccttagcctcccaaagtgctgggattataggcgtgagccaccgcacctagttgttcagcttcttctgttacttgaaataagttaaggtcctttaatagtttcacaattcctgagccaggcgccgtggctcacgcctgtaatcccagaactataggaggctggggcaggtggctcacttgaggtcaggagtttgagaccagcctggccaacatggtaaaaccccatctctactaaaaatacaaaatttagccaggcgtggtggtgcgtacctataatcccagctactcaggaggctgagatgagagaatcccttgaacccaggaggcagaggttgcattgagccaagatcgtgccattgcactccagcctaggcaacagagcaagactccatctcaaaaaaaaaaaaaaaaagaagaagaagaagtttcataactcctgaattcagaatcagaagccataatattactgattacattgaggagaaactggtactgaggcgatttatcccttgaaagaacactctggacatgttacaggcacgcgttccagattgcatttcccatgaactaccatattattttgttttaattttaattattttctcttctaattttttcctctttaaaaattgaaatatattttatatatagtcaaatacacagatgttaaatgtccaattttacgagttttgacaaatgcatgtgcccttgaaacccacattgctgtcagaatagacctcttaattcttgttttattattttaaaatttatattgtgtttttatttttttctgtagaaatgaagtctcgctatgttgcctaggctggtcttgaactcctggcctcaagatatcctcctgcctcagtctcccagtatgctagtattacaggcgttatccactgctcccagctgtctctcaatttttgaatcaactagtttcaaaacttctagttctaagagttggcttgctcatgaaccctgggaggtcagggatcagccatctcgtttgtggctgcctccgcagcaccaaacacagtgcctagcacctattttgcaagcaatagataacaatgcatgcgatagatattaagtgagcaagtagatgcaaagtaattctgccctcacttaatttacatagcattgtcaactcatagctctgacatacgctgtggttttccaaaatcttccatgatcatcagttaattttgatgttctttctctgtatgcgtcatgtgtgagtaatagctatgtggactaacaggttcgcacattgtaatagaaacaagtcaacctgcaggcacggtttatatttacgcaatctttattttcagccttttggttgccgtagtcatgcttttttagataaataatttttaaagttctatttggcaattaattactcatgagtaggtggaaatatgaccaggtctgaccaggcacctgcatctgttacatgctctctctgacttcctcaagctctaaatatagtctctgtacagttggtaggattaagcacagtgacattaatttcataactgtgtatcagaatgctgctaaaataaccagcttcctaataggtgggtcttagaaaaagccagcttgactgaagttctcaccgtctcacatttttattttgttgtaggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactggtatgtgttttctacctagataacccacactgtgtgtttggcattctggcttttgtttttttgtccatttgcattaaccaaaggtttttatcgtttgattgggtcttatctgagggtgcactgcctcaaagcatttgtttttctgaatttattggctacttggggccattcagccctaaaatctctgtttaggtgcatagttgattttaatctagatgattaaaaggataagtgctggtttttaaagcactgatttggataaataacatcatcactcttggagagaagtagagaagagccatcctgcaaagtaggagcaattctctgtgcttctcctttcattccgcccactgcagagggggccaggcagaggcagaaactgggaaggaggtagccttttcaggaaggcagatttaaagggctgaatttaaatacatcaatgattgaaaagaccctatcccaaattttttattattattattattattattattattattattattatttgaaacagagtcttgctctgttgtccaggctggagtgcagtgtcggggtctcggctcactgcaacctctacctcctgggttcaaacgattctcctgcatcagcctcccaagtaactgggattacaggcacctgccaccatgcccagctaattttttgtattttcagtagagacgggtttcaccatgttggccaggctggtctcgaactcctgactacaagtgatccacctgcctagccttccaaagtgctgggattacaggcataagccaccgcgccctgcccttatcccttcttattaaacaataactgccaaggtgccactactttggaaaactgtatctacataaggtgagcattcacaccccctatgactcaacaattcctctcctgtaggtgcactcactccacagagacctgtccacgtggccaccaaaaactaaaagctatgtggtagcatgttcatatctgcactatttgtaagggtcccaaactagaaacttccaaaatgctgaaatgggatatatttacttagtgaaattctggatagtaaaaagaataaatgatttacaactataataatgtggattaatctcataaccattatgttgagcccaaatagccagacacgaaatgagatctactgtatgagattctatttatataaaggaccaaaacaggcaaaacaaaatctgtgctactggatgtcaggatggtgggtacccttggagagtagcgactggaaggggccaagaggggggcttcttgaatgctagtagacatctgtgtgttttttctggtttgtttttctttttgagacggagtctagctctgtcgcccaggctggagtgtagtggcgcaatcttggctcacctcaacctctgtctcccgggttcaagcgattcttctgcctcagcctcccaagtacctgggattacaggcactcacccccacgcctggcctgacatggtttttcattttgatttagatgggggttacatttgtacgttcagttgataattcattgagttggacccatcatttttacacttttttgtatgtctgttttactttaattaaattttcaaaagtataacaaaataaaatacactcacttttgatttaacaaaaaataaaataaataattgccaaatattatgtcttggtttctcttattgtaataagagagtagctgggattacaggcatgcacaaccaatgcctggcaaatttttgtattttttgtagtaacggggtttcgacatgttggccaggctggtctcgaactcctagcctcaagtgatctgcctgtgttggcctcccaaagtgttgggattacaggcatgagccaccgcccagcctcagtgcttattttaaatacattgctataatagagtatgaactgtggcaacaaacacttcatattatctcacaaccaactgaaatattgaaaatacaacctaaactcaaggtaccatagatactgttgtctaataggtgggaaattatctcttttttgattcattcataattttaaaactttggatagatttctgacttctaaatgaaaagagtaactcattattttgttttttattttcttgttctgaattttatacttaaagctgactaacatagttaaaggcagatctgaggtgaacattattgtaactgggcagtccattttcacacagggcagagtattcttgagggcatttatttgccttttgttttttgcattgacctatattttatatttttaagatgactttggggttatttagaatctcgcttgtatttttgtgttctagatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacgtaagtatctttggacatatacctttttggctcaaagagactagttattcaggagacaaacaagctccttcctgtaatctgaagaccctccatggagggtggaaagctccctcagagcaccgtccgtcttccttctccagagacatatcttagaatcatgcggggttactagagctttcaaagtcataaggaaagattactttcaacagttgttgaaaggttatagctacatacctattaggtactgctctgttaaaaaggcttttaaaattgcaatttaggctgggcacggtggctcacgcctgtaatctcagcactttgggatgctgtggcaagttgatcacctgaagtcaggaattggagaccagcctggccaatgtggtgaaaccccgtctctactaaaaatacaaaaaaaaaaaaaaaatagctgggcatggtggtgggtgctggtaatcccagctacttgggaggctgaggcaggggaatcatttgaatctgggaggcggaggttgcagtgagctgagatggcgccattgctctcccagcctgggtgacaagagcaaaactccgtctcaaaaaaaaaaaaaaaaagcaatttacttaaaaacatacaaacacagagacaagtatttttgagaaacaaatacctttttcattttttataccaatgtaacaataatccattaaacacacctttactaactgttttctaggagtctgatatgatgaggaaataggtaaacctttaatagccagtactaaattagagtggcacaactttcactgggaaaaaagatgggtattttacttttctgttttagaaaagtggcttgacaacagtatgcttatgtcttagagtttgaaattcaagttcttgaacattattaatggctacaatcattcatacccacattggctgtattcttgatggatccaaagtgattttcacctcaactctgaatttcattctcctcttttgaatataatacaaccatctcactagaggaagcatttcagtcttttctgattggagattcattattgttttagataatgttttcatttgacttatgggtatataaaaaattttatcttaaaaatatttcctctcattttagctagcaacattgttttcatgtccacaaaagctgttttggtggattttggcctaagtgttcaaatgaccgaagatgtctattttcctaaggacctccgaggaacagaggtaattatgttcacatgaaaagggttactattttattaagaataaaaaggaaaaaatgttctagaattattgtgggaacgaaggacaaagaaggggaagaaacccactgcattaaatcattattttccttggaacacatttaatgagcacttgctctgtgtcaagtactaagtttagcacttgattttttattgtattttttgctatgttatttataatacataatagtatttgtaatataatatacatgttgatatatataatatagaacatttgtacacaatgtcatgtcaaaatagatcacattggccaggtgtggtggctaatgcctgtaatcccagtgctttgggaggctggggtgggaggatcaattgagcccaggactttgagacaagcttaggcatcatagcaagaccccatctctataaaaaaaaactggtttaggctgggcacggtggctcaaacctgtcatcccagcactttgggaggctgagatgggcggatcacctgaggtcgggagtttgagacaagcctgaccaacatggagaaaccccgtctctactaaaaatacaaaattaaccaggcgtggtggcgggcacctgtaatcccagctactcgggaggctgagggaggagaatcatctgaactcaggaggcagaggttgaggtgagccgagatcgtgccattgcactccagcctgggcaacaagagtgaaactccatctcaaaaaaaaaaaaaattagctcagtgtggtggtacacgcctgtagtctcagctagttgggaggctgaggtaggaggattgcttgagcccaggagttcaaggctgcagtgagccatgggcattccagcctggatgacagaacgagatgttgcttcaaaaaaaaaaaaagccccccaaaatagatcatatccacagttcggctttattttgtgtgtttttgtttttgtttttgagacagagtcttgctccatcgcccaggctgtaggacagtggcgcatgatctcagctcactgtaatctccacctcctgggttcaagcgcttcttagtctcctgagtagttgagattacaggcatgtgccaccacatccagctaattttttttttttttcagtagagatgcaggtttcactatgttggccaggctggtcatgaactgttggcctcaagtgatcctcccacctcagcctcccaaagtgctgggactacaggtttgagcccccgtgtctggcccacagttcagctttaataataattatagaattagagttaactttataataagtttagcacttaaaaagcagtatgttatttaatccttacaacaacccagttgttgctattgttattcttattttacaatcaaggaaataagtttgcagagattaaaataaagtgtccagagtcactcagtgacagaccctggacttgaacccagttctttctaagtctaaccctaaggtctaactgctacataactttaaaaaattataatattacatacattattaaaatatattagtgatataactaatatcactgagttttggctcaatgacagtcttaactatggtcattaatatttatgaggactctaaaggcctctctttgagcctaggaattctataataaacctcaagtagtgagcataaatgtatcttatttaaagatgtaaaacagcactcatgtttaactcatctgtgaagcaaaaaatgacccagaaaagcctttctttcctgactctaaatgagattctgaaaaatgcgttcgcgggcttccaagtaatgtatttaacattcacatcattaggctgactgggtgattcaattagccagtgtccactgggcatctgctatgtggcaggttcttgtgagcaccaacgaggaagcatgacacaaggcagtgaggagcaagccttagtggtactccagcgatcctcactctttggtgggaggacttactttaaattacctgaattattaaaagagcaaccgtttagggatgggcgtggtgttctcacacctgtaatcccaaccgttcgaaaggccaaggaggtgggggtggtttgcttgagcctgggggttcgagaccagcctgagcaatagagtcagacctcatctcttttgaaaaaaaaaaagaaaaaaagaaggaagggagggagggagagagagaaggaaggaaggaaggaaggaaggaaggaaggaaggagaaagaaaaaggaaggaaggaaagaaaaagaaggaaagaaagaaagaaagcatgcacaacagtttagttcacagttgattgtgatgggcacaaggttggatgcaagcaggaaggtaaatgggtgtaaaagctgcctccttggcccctcaccactaccgggggaagctgcactgcctgagccactcagccccatgcccttctctttgctggaagtgcccataggaaatagagagagggtctttggctgcacctctatgtcaggattaccaggtcagtcttggtgttcaatcagatgacaacccttagtctaatctagctagtatacgtgttgcactgaactggattgcagccacaaaaaaattgtcttcctttcaaaccagattcttccagcctgggcaacatagtgagaccccatcgctacaaaaagtaaacaaacaaacaaaaactttactttttgtaaaaatggcatggtggtgcatgtctgtagtcccagctactcaagagactgaggtgggaggattgcttgagcccaggatgaggctgcagtgagctgtgattatgccactgcacccatagcctggaaaatagaacaagaccttgtcctaaaaaaaaaaaaacgccaagattctgtaagtcctttctcaactctctcaaagccagcactctcccgggcagcagaagaaatccttgcttttgtgaatattactgaagttattattgaaaatgctcgagcgaggattcttgacggttgtctttgagcagaacaatattcagaagggaagctgtaatttttttttttttttaagaatgcttagtccccagatcttaagaatactttaccaaagtgtgaggtctaataagacttaatgcttacgacatgttttctttggaaaatgtttcagcatatttggcattagtcaggagttcagatatgtaatattccaccaccctttttcctggaaccagtttgaaaaacaaactatttatggtattaaagatggaaaatacttttctcttcctggcaatgtggtgaagttgaacattttgcaacattggagaaagaagtgttctttctggggctgtctagcggaatgcatggatatgagataataacatattttactcctgagtagtatttggatcaggttttttttggcaaatgcaaattgctttttgtgaagtgcaaaactgagccttggtgtttataaatataaactctcttctaatcagcctgcatttaatatctgcctagtacacacgagttgaagtttgataatgaacaaagttgtgaagtgaccagtgaaacctttcaacaagcttgcttttacccttcctacttaaagagccaggagatctaattagtcaactgtgcagactggctgatgttagaatttgatcatgtggctactgcacagtcatagacaatttctgatttctgcagtatagctcccaaatgcaaaccctggttacccctgtttgattgctctctctaagcattggtattcagagcattctattgtaaccatgtaatacacatccagggttaatccagcatatacagaatagactgtttttgagttgcaaggtacagagagagaatacatagtgaatgcgaataacaaatcagaattacttttagaacttggtcctttttgaaaaatccttctaagtctgcttggttttacctttgtaagttaacatatagtcatcacatgcacatatacgcacacacacggtctctttccctttctaataaacatattgaaaggtgaagggttcgatcgctgacatcaaggttttctcttgctccagtgccctgccccgagggtgcagaactctcagagagccctgtgttggtcccaccagggctgtttcatgccttctaatcagccagagtgctcgaacattatgccctgctgctccctgatctaactggtagttggtagagcttgaggaacaagagctccgagccaggaagctctggggtttctacctgagtggcagcacccaggccaccaggcttacagatgttccatccccccaggctgcctaggcgtgcagtcacatagaacctgcagagccacctctgcacaacccctgtgggctacaccagcagtgggcactccgcccaatccttgctttattggcagggaggagggggtacaggagagaagataggcatcctctatggacagttaataatacccattgcatttctttttcttttttatttgattgtggtaagaacacttagcatgaactctaccctctcaacacatttttaagtatacaatacactattgttgactataggtacaatgttgtgcattaattttttaagtttgtgatatatttagtagcaaagtccttctggaaagtcctctggctctgctgcagggaaagcttgagaacgggagctcagtttcacctgtttgctgagagcaaaaggaagctggcccggaagtggcttgcaggaaggagttgagcagggttagggtggggagactgggcagtttctctggtttttgtaagctagttctctaattacttaccctgaaatgtgttccggaaacactgacctccattctcttattcacatggcagacagtgtacaagctgtttcaagcgaaatactgataatcaggatattaactactatatgtctgcaccagccatgaatacaaatcactggtcaccagtgtttgctctgttcctttttaaaaaaatgtttaattaaattaggtaactaattaatttgtaaagatggggggtctccatcttgtccagactagtctcaaactcctgggctcaagcaatcttcctgcctcggccttccaaagtgctgagattcagtggctcacgcctgtaatccccacactttgggaggccgaggcaggtggatcacgaggtcaggagttcgagaccagcctggccaacatggtgaaaccccatctctactaaaaatacaaaaattagccaggcgtggtagcacatgcctgtaatcccagctagttgggaggccgaagcaggagaatagcttgaacccgggaggcagaggttgcagtgaaccgagatcgcaccattgcattccagcctgggtgacagagggagaccccatctcgaaaaaaaaaaaaagccaaagtgctgagattatagacatgagccaccatgccccacctctctttgtttctttcttaagtttagaaataaatgctcgttagagaaactatttataaaaccagccctgtttattcagcatggactcatgagaccaaatataacttatacaatgttaatatggctgcatttaatatttagtcactgggctacatagtaggtaaaaataacagatagtttgtaaaaatgactctttagaatcacttctacaatattacactttattttttaagtttttccctttcaagaaatttgtgttaataccctatagacttctatcaccttttatcattgcagatatttagaaggttagcagtgtaatgacaaacagataaagaagtctgtttgtagttcatttaaatataaaaggaattggcgttttagttgaaaacttagctacacctgatcagtgtactgcagaactttgatgagtgggagtccctgatagattcctggttctaggctctttgccaccagatcaaccagaaaaaggtggtgttttgttttgttttgttttgttttttgagactgagtctcgctctgtctcccaggctggagtgcagtggtgcgatctcggctcacagcagcctccgccttccgagctcaagcgattctccttgcctcagcctcccaagtagatgggattacaggtgcccatcaccatgcccagctgatttttgtatttttagtagagaccaggctggttttgaactcctgatccgcccacctcagctgggattataggtgtgagccaccgcgcccggccaggtgttcttcatcagactgcagggacacctccagcaattgctgcatggttcctggggaatgcctgcattattctcctagtttaaggcaaatgagccaatttccagaactggattagggaaatggaaacccacacaaaggaggggaatgaagctgaatgtttcccacttctttttcagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacatagtaagtggggttcaaccagggctgggggcggcgggggggggggcgttgagttatgcatcccgcaggcttgggagggactgctctgccttctataccacccccatctgaatgaggcaatggtgaaatgacaggtagctacaagttcttcccatgtagaagcaagctccattcttgcaaagaaaacatagctattttagtgggagcttactaaaatgtgcattgggcataatttatgctattccattgtatgtgtaataatgcaacactacttagtagcatcagagtagcataaatatttcagcaaaggaagttgtatgtgttctttgaacagttaaaacattttttattattaatgttcacaccagtgtggcttgtagtggaatatgcaattcccattttactgttgataaattcaggagcagacacttccctgttactgcacagtgacttttgggacactgatttgaagctgtcactgacattcaaacctatcacttatcttttgtaacattaaatcagaagatgggtttaacctggtatcctttagaaattaaagtgggccaagcacggtggctcacgcctgtaatctcagcactttagaaagccaaaacaaaaggatctcttgagcccagaaattcaagaccagcctgggcaacaaagcaagaccccatcgctacaaaaaattaaaaaaattagctaggtgtggtggtgtatgccctgtggtcccagttgcatgggaggctgaggtgagaggatcacttgagcccaggagttcgaggctacggtgagttgtgttggtgccactgtactccagcctggatgacagagcaaagaccctgtctcaaaaggaaaagaaaaaagaaattaaagggaagcttgcttgcttaagggctgaactgcattcgttgcagggcatgtggtggaaaacggattactttctaggtcctggtactagcatgcttttgctgttgagggtgtatcaccatacctttgatgctaagagagctggtttgttgatagatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctggtagggacaccctgctgtgtgccgcacacttacttcccttctctttctgtccacatcaaacctctgatgtagttcatgaaagcacttggaaaaaaaggaaatgacttcttgagtaccataccttgcttgagaaatttcagcaagattagcagaagcatgtttttttttttaaattggctaatttagcaccaaattataacagattttcagtgcaagtgtaggtagcacagtcactggaaaatgcttctgacttgcttttttgcaacttgcttttttacaacttttgtctttgaaaacagattgagcatgacagctttgcagttggttcttcttaactcactttttttttctttttttttgagatggagtcttgctctgttgccgaggctggagtgcagtggcatgatcttgggtcactgcaacctctgcctcccggtttcaagtgattctcatgcctcagcctcctgagtagctgggattacaggtgcccaccaccacgtctggctaatttttgtatttttagtagagatggggtttcaccgtgttggccaggctggtctcgaactcctgacctcaggcaatccacctgccttggcctcccaaagtgtggggattacaggcgtgagcaaccatgcccagcctaactcatttatattaagccaccccagtccttggtgggggaacatcatggcactgccctgcacagataaaatactcagtttgaagtcaacttgcatttccatcttccttggcttaaaatcttgccagttgtaaatttttcccacttaggaaagtcagtatgctttccaggagcattgaatatgcataaagagggatttccatttttattaaaagtctgtggcattcttaatccatttaggtccaaaccgagatgtcaagcctggtgcgcttgtttatatttctttgctgcttgtctaacttttgtgtatttaaagagagcaatctggctgttggaaaaatatgccaggatttctaactaatttcttgtctccattgactcctgtttgaactttttgttctatgtcatattatgtgaacttagccatagtgttcaaagacccatctttcacgcttaagacactgttttattaggccccaaagatttatttcactgcagaaggaacaggtatttatcatttgacacgttttcttgttacttactttgtaatgttttccttttcagattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgccactggtttagggttatgtggttctattttgcaccctgtttttatatatttatactatccttgaatacacgcttgcatactctttgcccattgttatgtggcaagctaataactagccattgtagaaggtggctttaactcacatacatcaactctagtgaaaactgttgaatggaagtctgtcatctacatagcaaatagtattaaacacttttacatgtgttgtgtaaaacatgccatcccttgtaatccatgtaaacacacatgaaatatgcattgctacctcttttttctcagagaaggaaattgaggcatagtgagggtaagtaacgttatcctcaagaccgcaaagcaagtgaagaaacagctggtatttaaacccagtcctttctggctccagtacacatgttctccctcgtacgttgctgcttgtaagtgagagatcaacactgcagaggaaacaatttccttttctgcccctctggtaagggcagaggcagactgaccatgaagctaatgaagcttcagcctcagggctcctcacttgcatgggcccctccatagccctgtgcctgattttttttaatgtattttttatttcagtgacttttggagtagaaggggtttttggttacatgaatgagttatgtagtggtgaattataaaacttcaatggacccatcacctgagtagtgtatgttacactcaatgtgtagtttttcaccccacacacctccccccctttattttattttttttgagaaggagtctcactctgtcacccaggctagagtgcggtggcatgatcttggctcactgcaacctccgtctcccaggttcaagcaattatcatgcctcagcctcgataatcccagtagctgggattacaggcatgcaccaccatgcccagctaatttttgtacttttagtagagacggggtttcgccatgttggccaggctggtctggaactcctgacctcaaatgatctgcccaccttggcctcccaaagtgctgggattacaggtgtgagccactgtgctcagccccaccctcccccattatttcactctgtatgcctttgcgtattcatagcttagctgcctgtgcctaatttcatatcaccctagatcaggcccaacaaaacttggacctgctcttggttaaaggtatacagcttttgataattttcatgagatactcacatagtcaatatgaattgagttctagttaacaaattccatttggagaaaaccattctctcttttttttttttctttttcttttttttttttaagatagagcctcactctgtcgcccaggctgaagtgcagtggtgccgtctcggctcactgcaacttccgcctctggagttcaagcgattctcctgcctcagcctcccgagtagctgggactacaggcatccgccaccatgccaggctaatttttgtattttcagtagagatggggtttcaccatattggccaggctgggaaaaccattcttttgaaataaattggaactctaatggagagaaatggggatgattgctaagagctgatcaatagtgttggtggctgaggaagcggtcgtgagagagaactatgaggggaagttcggggctgagagctctgtgtgcactgaggacttgcagaactgttcacctgggaggccaaaagttgcaccctaggatgagtcaccagagaatcagctcaagaggagcaaggaagccccaagtgaattccaaaggaatgcactactcacccccttatgagaagatgggcagtggggctgtcaggcttgagtatagttagaatagaataatcatgtcctgaaagctcagcctgggcaacattgcaagacctcatctctaaaaacaaaaattagctggatgtgatgactcatgcctgcagtcccagctacttcaaagactgaggcaggtggattgcttgagcccaggattgcaagtctgcaatgagctatgatcatgtcattgcactccagcctgggcaacagagtgagaccctgtctctaaaacaaacaaacaaaaacaaagaaagcaacttccagccactttgataattcctgcttcgggaattggatggaagcactggaatgcactgcagaatgtatacagagcttttccagctcaagccttagagatgatcttatttaagcacctggcaagttagatgggtagatgaacgtgcttgctggaggtcccacaaccaatgctagtgcctcatcttctgattgtcaccacctcctttgtgttttccttgaggtctgtgaaatattcaaaagcagatgatggagatcgtaccaggaatttactggacctgatgggaatttgcctagccttggagagatgcttctcatctggggatcagccagtgccccttgagctaagtttctactgatgactgccatgtcaccgagcaccacagtgggacctggaagggattctgtcagtcccctgggttccttgctgatgcatgctcactgtctggcagacacaaggaatttggtcttttattgacagcaagtttctgtggtgtaactcaatatgaaagccagtgttttctggcgggcctgggggatatttttcataggtctgcaatgtgactagcagtaaagattgcttgatgccctgccccatgggcacccaggagggaatgtgcccagcaggagagcgggcctattaatggagagttgaagttttatgaggaccaactctgggcaagcaactgtgctgggccctgaaggagacataagtgagagaagattctagtctctcttacttatccactctctgctgaaaggaagcacgttccattttggaattgttagaaggttctttgatttaatgcatattcccatctgcctccaaaacggcttttttcatcaagtatttacttgcaattttaccttttgcctgtgagctggctttctaaatgtccattgaatcgccaatgcataagaagatgatgactaaaaggtttaggcatcagcatcaggtttcaaaagcttgctttgtgccgggcacagtggctcacacctgtaatcccagcactttgggaggccaaggcaggtgaatcacctgagatcaggggttcgagaccagcctggacaacattgtgaaaccccgtctctactaaaaatacaaaaaactagccaggcatggtggtgcacgcttgtaatcccagctacttgggaggctgaggcatgagaatcgtatcaacccgggaggtggaggttgcagtgagccgagatggcgccactgcagtcactgaacctgggcaacaagagcaaaactccatctcaagaaaaaaaaaaaaggtttgctttgggccagagagaggagaaatgcaaagcagtcatttaccaaacattttttttttatgtttttgttatatgttatatgtttttgtttttttatgcttttgtcaattttgtctaagatcagttggctatagatgtatagctttatttctgggttctcttttctgtgttccattaatctatgcaattgtttttataccagtaccatgctgttttggttactacagccttgtaatattatttgaggtcaggtaatatgatgccttcagctttgttctttttccttaggattgttttggctacttggtgatttcatatgaatattaggggtttttttttaattctgtgaaaaatgacattggcattttgaattgcactgaatctgtagattgcagattgcagattgttttgggcagtatggtcattttaacaatattgattcttccaatccattagcatgggatattttttcatttgtttgggtcatctctgatttctttcaggagtgttttgtagttttccttacagagatctttcacctctttggttaaatatatgcctaggtatttttttttttttggtagctattgtaaatgagattgttttcttaatttggttctcagcttgattgttactgatatgaataaatggtactgatttttgtatgtttattttgtatcctgaaactttcctgaattcatttatcaaatgtaggaatttttttggtggagtcttcagggttttctaggtataagaccttatcatcaagcatttttgtactcatctgtgaaacaccctcatccggatttgtgctcagctctctctaggcagggtgtgcagatacaagcgtggacaggagagagaatcacgttcctgttctgttggacaatggtcctcagccccgggagcaacagctgcattttcaacaactggaacttggagtatagattccttcccacattgcctatgtttaacccctttgtgggaaatctgttttgtcacacttcaaaatcacagtgagagatgaccagtcatagccagcacacctaagaacacagcatgcgctgcgtttattttcaaggctgggataaattctgagtacttaaccaatttcgagacatctgcttcaccacatattacagaaccaaaggtgataataattggctatctggctgcctggagcataattgctgattgaatgacatcttgttcatcctggtgactgtacaaggaggccaactggaaatacaaatcaatgcataatcagctaagagcatagcggtctctcattacggctctacaccaaggtaccctgagttggcctagcaattgtatcattatacaaataacattaaagattaggggagatatggaatttccctacaaatgttggctattattattgttttaattcattaatgctaaatgttctttctatgaagcttaatgaaattccgctttatctttcccatatgtatgtagaatttcagacagcatttcattggaacataccttcatactggtccatttataaatctgaataggcttgactcttttcagcctaattaacattcttccaaggcatcaagggagatgagaaggaagaagaatattttcagcaaaaagaggggtaataggcactactgaaagaaggcttggagcttgcagtggagttaacttttggttcattcttgctttttgcaaacgcaccagtgacggtgagcccatcggactgacgctaatggaaagagggctgagaatggtggctcttgcctataaccccagcactttggtaggctcaggcaggaggatcgcttgaggccgggagttcaagaccagcctgggcagcagaaagagaccctgtctctacagaaaataaaataaaaacttagccaggcatggtggcatgtgcctgtagtctgagctacttgggaggctgaggcagaagcttttagcacagaagttcaagggtgcagtgagacatgctcatgccactgcactccagcccgggcaacacagcaagatcctgtctcaaaaaaaaaaaaaaaaaaaaaaatggagagaggctacaggatggcaacagctggcactaggacagtcttttgtcaatgggcttgtgggaaaaggaaatggtgtcaacctcacatacacacacaactcacctcttgctgcctaggtctttcttcttattggaaatttgcatcttgctcaagttttgctcccaataggacagagggctgggagctgattccaagcctaggaggctcccagaatctctcacaacttccctatgtggattaatttgtgatcacttgccagggccagcgagcaataaggcaccaattgcttctatcttaattaagttacttagggaagaaagagaaagaacaaaggaattaattcagattttctcactgaaactgaaagttcttttttttggtctggccagtaagcaagagggaacagaaagatttggctcgtgccttcctcattcgcctcttcagcttgtccctcttcctctatacactcccccacattctatatgccccagttctgttctccagaagcaattgctgctagcaaagatagtctatgcatacacaaacatatgtgattatataatgattatataacactcttctttataagcaacaacaaatgtgcacatggtagcatactttatacatagctctctatattttttttgttttgttttgttttttgagatggagttttgctctttttgcccaggctggagtgcaacctccgccccccaggttaagtgattctcctgcctcagcctcccaagtagctgggattacaggtgcatgccaccatgcccagttaattttgtatttttcagtagagacaaggtttcacagtattggccaggctggtctcgaactcctgactttgtgatctgcctgcctgggcctcccaaagtgatgggattacaggcgtgagccagcatgcccagcccatcttgtttttttgacagactgtttcccaaaaattatgaggaagtatgtaatttaattagatgaattcattcattattatttttttctttttttctttgagacagagtcctgctctgtcgcccaagctggagtgcaatggcacgatctcggcttactgcaacctccacctcctggattcaagcaattctcctgcctcaccctcccaaatagctgggattacaggcgtgcaccaccatgcccagctaatttttgtaattttggtagagacggggtttcacggtgttggccaggctggtcttgaactcctgacctcaagtaatccgcctgccttggcctcccaaagtgctgtaattacaggcttgagccaccacgcctggcccagtttattgtttgagatagggtctcactctgtttcacaggttggcatgcagtgttgcaatcacggctcactgcagcctcaaactcctgggctcaagtgatcctcctgcctcagcttcctgagtagctgggactacaggcatgcacaaccatattcagctaactgttaatttttttgtaaagacagggtcagctgggtatggtggctcacgcttgtaatcccagcactttgggaggccgaggcaggctaatcatgaggccaggagtttgagaccagcctggcccatatggtgaagcctcgtctctactaaaaatacaaaaattagccgggcatggtggcatgctcctgtagtcccagttacccaggaggctgaggcagaagaatcgcttgaacctgggagatggaggttgcagtgagccgagtttgcaccactgcactctagcctaggcgacaaaatgagactctgtctcaaaaaaaaaaaaaaaaagagccttgctatgtggcccagggtggtctggtgtcaaactcctggcctcaagtgatcctcctgcctcggcctcccaaagtgttataaacatgagccaccatgactggcctggaactattttaataagagcaatcccctgatacaagtcttactttgtagacaaagccttttcccaatcatttctgccatgaggttggaagttttcgttaggcttccctcgtgcttcttctctttccttttctggaaaatgagacgtagaacaagatgacttttcaagttgcttccaatcattgattcatcttataggacaggaaattggatggcaacaaacttgttgatttcctgaaagtccaaatgtaattgtctgcagagcaagggtgggaaccaaagtccttgacttctaacctcagggttttgccaccagaccatactgccattgctgcttaccattcctcttctgatgcctacagcctgggaagtcccagagcaaaagtttatacttaggctagcttttgagtgtggggaagtggtaggaattattgggctggatggatcaaatttcctttctattgttaggaagaggctggatcctgtcttaagtcaatgtcatgagatctgatatgggtggatgagaataggctctggggtcaaggatggagggaagaagagactctaggccagatgcggtggctcacgcctgtaatcccagcactttgggaggccgaggcgggcagatcacgaggtcagcagttcgagaccagcctggccaacatggtgaaaccctgtctgtactaaaagtacaaaaattagccaggcgtggtggcagatgcctgtaatcccagctactcgggaagctgagccaggagaatcacttgaacccagaaggcagaggttgcagtgagccgagaccatgccattgcactccagcctgggcaacagagcgagacatcgtctcaaaaaaaaaaaaaaaaaaaaagaagaagaaactgtatgcatgaatgcaaaatcaaggtgatactaaaggagacgaatcaatgaggtttggcgcaagaaaataaagtcacgagctgctcattaaggttaacaatgacatagaatgttgccatacctgtaatgggctcaagaattgtgggatgcagccggacgtggtggctcactcctgtaatcccagcactttgggaggccaaggtgggtggatcacttgaggtcaggagttcaagaccagcctgaccaatatggtgaaaccccatttctactaaaaatacaatacttagctggtcgtggtgacacatgcctgtaattccatctactcaggaggctgaggcaggagaattgcttgaacctgggaggcagaggcttcagtgagccgagactctgccattgcactccggcctgggcgacagagtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagctgggactacaggcgcccaccaccatgcctggctaattttttgtattttttgtagagatggggtttcaccatgttagcctggatggtctcaatctcgtgacctcgtgatccgcctgcctcggcctcccaaagtgctgggattacaggggtgagccaccgcgcccggcccaaactcctttttttttttttgagacgaagtctcactctgtcacccaggctggagtgcaatggcaaaatcttggcttactgcaacctctgcttcccaggttcaagcgattctccacctcaacctactgagtagctaggactacaggcgcgggccactacgcgcagctaatttttgtatttttagtggaaatggggtttcaccttgttggtcagactggtctcgaactcctgacctcgtggtccgcccacctcagcctttcaaagtgctgggattataggtgtgagccaccatgcccagcctcaaactctttttttttttttttttttttgagacggagtttcactatttttgtctaggctggagtgcaatggcgcgatcttggctcactgcaacctccacctcccgggttcaagcaattctcctgcctcagcctatcaagtagctgggattacagtcatgtgccaccatgcccggctaatttttgtatttttagtagagatggggtttcaccatgttggccaggctggtctcgaactcccaacctcaggtgatccacccacagcctcccaaaatgttggaattacaggcgtgtgc

SEQ ID NO: 1359 - DNA, 2763 bp, Homo sapiens
ggatcccagtggcccggcgtgctcggctcccacaggcctgcagccagcatcgcaccgaaccttcggggggccgcggctggagcgctcggccggcgtgggagcgcaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaagcagctaaaaatgacacagcttatttaccatgcccctgacactgcactgagcactttatgagcttgaactctgttaatctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggctcaagatataaagacgaagaaaagaatggcgtgtaaactgatcccagtagatcaatttaagccatctgatgtggaaattcaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtacgagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgcctctaaattaagacagcattgatctcctggaggctggttctgctgcctctacacaggggcccgttacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagcctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagacggccactagtgacagtttcttttgtgttcctatggaaacattttatactgtacatgctatgctgaagacattcaaaacgtgatgttttgaatgtggataaaactgtgtaaaccacataattttgtacatccaaggatgaggtgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacatgtaaagtatgtgagtagtcttatgtaaagtatgtttttacattatgcaaataaaacccaatacttttgtccaatgtggttggtcaaatcaactgaataaattcagtattttgcctt

SEQ ID NO: 1360 - DNA, 1404 bp, Homo sapiens
atggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggctcaagatataaagacgaagaaaagaatggcgtgtaaactgatcccagtagatcaatttaagccatctgatgtggaaattcaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtacgagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctga

SEQ ID NO: 1361 - DNA, 33991 bp, Mus musculus
tctctctttgtttctggccagaggttccagggctgagggtagcctgaaggtggatgattgtcattacaatgatccatctgatgacctcagaagtcttcagtcccttagccctctcctcatcctatggtatacacttacttttgtccacattttatttatttttaaaaaagatttatttatttactttacagtacactgtagctgtatagatggttgtgagctttcatgtggttgttgagaattgaatttttaggacttctgctcactccggtccatcctgcttgctccggtcggccccgctcgctcagtccctgcttgctttggtccaaagatttatttactattatacataagtatactgtagctgtcttcagacacaccagaagagggcatcagatctcattacaggtgattgtgggccaccatgtggtggctgggatttgaactcaggacctttgaagagcagtcagtgtgcttacccactgagtcatctcgccagcccccacattttataaattatacttcagaataaacctgcccaagacttctcatgagctgaggccccaggcctaaccaacattgtttaataatgggaagggtaatcaagtggttgtctgctggtggccaagactgaaagctagtagggaccctatcagagcttgtcatcctgcatattagagatgttcaggagcctcccataaggagctggagcatatgacattcagagagccagagtagaggcctgatggggaggggaccctgatggcagggcaggaggtctaacctcaacactgagcacagacgaggcaggtggagttgtcttcaccctccctttcagaacaggaggttcagggcaggcctggagaagctgaatagagaagccttggggagtggcacccatcgagtctccacctgcccaacctgctggtttctggcactaccagttatgtgagcccaacagtagcatgcagtagaatcctttaagcccttaacaaggagaacatggagtgtgtgtgtgtgtgtgtgtgtgtgtgtgtgtgtgtagggaggttgctactctgggatccttaggtctgtgttgcaaggtaacacagggacatgtcattgagagcagatgtggggggtcagagtgataaggagcctcacccctgggcaggtacagcccatgtgtgaatgaagcaagggtcctgggcagagtttctctgccttaggccgggggtgggtaggttcttctatcactgataggtgggtggatgggtgatcatggtttgggaactttccccctctaatgaattcagcaagggggactggggccaacttcatctggtgaggtgtgaagacaggcaggcttaggaaaaccaggtctctgtgaggccagagtgtatcgcagggaaaggagtaggtaatggggaagggtcttgataggggtagctgcaaccctgctccactgcatcctgccttctgtgagccaagccaagttgtcccttgtacaactagaatgaacattgggcaaagagggaaacccctgggtaagactggccccatagctgtgggatagcccttaccgaccctggcatcttctttagggttgccatgggtgaaatgggttttcctgggtgtcccgaaagtccttggatgggaggatatgctatcctaggaggatgtgggatagcttttcctagggcaggcagaaggggtaattcttgatttgctttatgccttggggtaggaggctggctgcccttttaaagactttagattctgcaccaactacttatcttcatctcaaagagctccaggggtgcagagtctcagcagggagttctctcctgagagcagtgatcacttatgctgcccattatattcagattccccaactttttttccaacccggaaagtggaataccctggtctgatcaggctacagctataccaggctacggtaggtaggcacatgtagggctggaggaagcctagagttctagctgaggctcttgtggcttccagatgatcgcacgtgatggcatacaggacagggccaggtgtgctcagatgagtatgggtcccaggttgctgagtgagagttcctgtcttgctgtaggcatgtgttctttctgctgggtgagatgaggcggtgctggcataggggcctgcccagccttgctctgacccagttttccaggcccagcccagttctctgcacccaggcaggcatggagcagtgggagctcacaggactttttttcaggaataccaatgtcctggcccacagtcactttcccgtctggggcatttgactggctggccgtcagtacagttagtcccccaaggacacaggcatccctaggacttgagttgccaatgatcctaccagatcctgctttggaatcatctgttctgtgcctctgcctccagatgaactgatgcattgcccagagatagaccctgtagccctctaactaaagatccagtagtgtttcctgccctcctagaagccagttatggccttcccaaagatggggtcccttaggtgacaggtagcttcagaacaggccacagagtcacaagagtgggtataaagactcaggaaaacattccagggaaggggaggatgggaaggtccttgtggacacggagactggggcagcaaaggctacatgaggcctgttgggaagtggggagggggagggagggtggatgtgactgtgggaatccagctctggtagctgctgggtaagccgctttgatccacattgaggcaacacagaccccagtttaagataacttgggcttgggaacctgggctctggccccaactgcccttctgggtttcatccctgctctgcaccagagagacactagtctgggtggtgactgactctctgggcaggctctcctggatgctggggcatcgttcttttctgttttttttttttttttttggtttgtttgtttgtttgttttgtttttccccaagacaggtttcactgtgtggccctggctatcctggagctcactctgtagagcagactggcctccaactcacagagatccacctgcctctgtcttctgagtgctgggactaaaggtatgtgccatactgtggagctggggcacggttcttaagctgtgctggcaggacaacttgaggcccatcagtttccaaggagaggggtgtggagtgcccacctcaggaacagataggcctccccttgaccctgctcctctgagttaaactttctgtatccctttctaatccgctgttagcatctttgacttgggcttgagaggtcatgggatcctctactccctagctggggccagaaggacagcctagtttgagcagaggtcagcatggacacatatgtggactgttgggggtgtgtacactgcctgggaaccccatatcagactcctaacctttgcctcagccatggtcagtgccttcccaccccagagggctgactcaactcaccctcagtccctatgcaggccaggccagtggacaataaagctgtcagcagccagggcgaggggcaggcaatgggcgtggctaggaggagagggcctccagaagcacagacatctctattaggggatgtagaccctgcctgtccatcctactcaatgctgggaccttggaggctgggagcaagtggtggctcagagagaagaggatgaccagaatagttagcaaggtcaacaaggacttgggagtcatgtggagacaggtgtctaaggagcaactgcctgcccactcctcaggtctattaatgtacctgcaggacatgtgccctctgggtagaaacattccaggtgaacactctgtttagcctataaaaagaccctaagaaaagggtttctcagagaaaagagatagtcacagaacatgccttagctttcccgcctgtgatggggtagagacagacaccactgtgtacctaagcatcagtcagcctccagtggagtccagcagacagtagaagcactttcagatgtggaccgaagagactgaagagggaagtggcctctacctctgtcttcccccgcattcaactctcaggtccactatgcctgctttgtgaactggggcagagacccaggtgataggcacggctcgattctgctggagacttaggagctgagatttaggcctatgacccttagatcttagctgggacactcctggaaagtgaggctcctgaagtggctatgggtcgtgagttggcagcctctatctggtaagttcactgcaaacagctacctcttccaatcagctgtaagcagcctatgtgtttgcatctcctgcatcctccagggtcccccagcatccccagagtcttaccaggctttgtgggtgggctggtccctttcctcaggctaatgaggcacctagctcagggctgctgaggtctccactgctctgagagctccctaaccattgcactcttcccaagctcagttcaaacatctctggaagccatgtggtcacctctggtgactgagtaactgggacagtgcctccttattccccatctgtcaaatggagcttctgtgagggttctttcaggaaccaacaagactaccaacttcacgttctgaacacacaaggacctggattacccaacccaagtcatctgcgggaggactcagaacttaacagcatatgtgcaggtgtttgcgcgcgcacacacatgccgccccagctggctgctctaaacttagagaatagagctgaatgcttggctgaaggtcgcacagggatgatgagtgagagggccaaccagtagagggggacagagcaagactgccataggtgatgccaggaggggccagtgactgagaagggtgcagtgtaatagagagccactggggtggaggaagagggtgtggcaaaggctgctgggccctggggcctagattcctagttctgctggagcctgcagagttagaacttgtttattcttggcaggaaggctagtcctggggggtgggaggggggcaaggccttttcaaaaaaaaataaataaaacattcatttagaaggctcccaaggcatgctgaactgcaaaagggtcctggaaaaaatgccgagagggtttaagtgtaaatggacccaaaacaccataattaaatttcccttaaatttaccagagtttggggtcaaagaaaaaataaaacgtaaggaaaatacacttgaggtttcaggccaagagcttaggaaaatagattttctgaacggctcagcagctaccggcctggccctgccagtccctcgggttgtcgctgcctcacctcctctctgctaggcagtgccctgtgcacatgctgttcctaggggctttcgaggcaccctgattgtccctttgtcagctcttccagctttctgctgtgtagctcgtctttgtcagcttggtagccttgcccttaccccgcatctctccacagctctggtctctgatctttacttgtccaggcacattttccagaccaaaaaaagttaggacctgaggtctagtggtctgaatgaacccaggggcaaaaaggccagcaagtgtggtctggaatatcacagcacacccaggctcccaatgcatgattcatcttattgcccttctcactcaacctgccaggaaggtcacagctaaaattaaggatcttacatagtagctagtattggctgaaggcttttggaatattttctcttcttgttcatgttcttaaaaaatccagccaggcatggtggcgcatgcctttaatcccagcacttgggaggcagaggcaggtggatttctgagttcgaggccagcctggtctacaaagtgagctccaggacagccagggctatacagagaaaccctgtctcgaaaaaccaaaaaaaaaaaaaaaaaaaaaaaaaaaaaaagaatctttgggctggtgagatggctcagcggttaaaagcgctgactgctcttccaaaggtcctgagttcaaatcccagcaaccacatggtggctcacaaccatcgtaacgaaatctgatgccctcttctggagtgtagtgacagctacagtgtacttacatataaaataaataaatattaaaataaataaataaaaatccatttttttggttatattataatgggcaaatcaaatgtacttttattttaatcctcaaattatgagaatgaaattgaaaggcacaaattacccacacactttcacagttgcatcaccattcaaacctgctccctgtttcttctttggggaaagccggtcaggccggtcctctaagacagagttctgagccccttccccatggtgctgcactggctcctgagcctgtgggcacatagtaatggtgtttctcagtagctgaaggaatggggactcctaggaagagacagagcagctctagtctctgaaagtctttggcccttcaagtcaggccatggagtccattggtgctcagtttccctttatccctgcactcagcctcatgggcagctgcccctgttgaaccaggcactctccccgagtgtaaccttagcaggctcccatggctccctctgcctgggttccaggcccactgtggcctatagtagctgccacctgccagaaatcccgtgggtaagaggtaagttgtgatttcaggtctgaccaggagaaccacccccagctcctctctgctgacagtttctcacaaccatctcacagcctcagccctggtctggctgcggaggtcagggaagggcaaatctcagactacctactgccagcctgagggattccattccaggacaggcgcagctggtgcctcaccgcagtctctttccttgttgcttagcagcataggccccagaaagcggaagctactgagctctgagtccctgagctatctatccctagtacgcctgacttggcctctgctctcaactcatgttcactgaagaaggctccatttatgtgagccttggaaagctggtgggtcccctagcagtgggcaggaggtataggcatggaaggggacttgatcattaggaaatgcccagtcatcagcactagctgttggcaggctccaactcttgtcccctggaactctgtcatgggccaaagagaaccacctcctcagatcctcattataacaatagcctggagttcaactgaggggcttgggattaaatagtggccaagtgagaggcagcatcatggagatttaagggctggcaccatcctgcactgatgacagaatggtgggtgggctcagcctcatcttctgtaggtctcagagaagcaggtgaactcctgctgaacctactgacttgggaagaatcacttcatataagaaaatcccactgaaaacagaccatccttccaggaattacatcccggtatcaagggcaaggcaagtgagctgcggctactcgggctgaacacagggatcatgttgacattagctcctgcagaatcagtggagtcttagaaatgctatgcccctttgatgtaagggccaccagacagtggcagccatgttggaaagtctattaacacccaggccatatcaggatgtacatgatgtcaagggaccaggaactgccaggtgtgtagtgggcagaaggtagctcccccaaaggcaggtctctgtgctatctcccggatccacaaatgtgaccttatttggaaaaagagtcttgcaagcataacgatgggaagaggcttgaggtgagaccatcttcactttatgaacaactctaaatccaaccacaagtgtccttatgcaggacaggagacgtggggaggatagaaaaggcacagaagccatgggaagggagaggcagagactagactgagatgaccgtaagccatggatgcctgcaggccccagagttataacaggcaggaagaagcctactcagggcccacagccagcccaacttgacctcagacttctgttgtcctgaattgaaaaagtaaatttaagacaaccagattttaatctggaagtcggctcaatacaggaatacaagttgtagccgggcgtggtagcccacgcctttaatcccagcactcgggaggcagaggcaggcggatttctgagttcaaggtctgcctggtctacaaagtgagtttcaggacagccagggctacagagaaaccctgtctcgaaaaaccaaaaaaaaaaaaaaaaaaaaaaaaggaatacaagttgtgaatagttgtgaacaccacacagctcatttttaatgaagggggctgatttccccccccccccactgctgcagttgagcaggggtctacaagagctggccagtgtaaggccacagggttgggggaggatcagaggagtgggagtaccctgcttagagtcctctttcctgcatgtgtagcccattggaaaacaaggtagcttgaaagagatggtctgttgggccatggggttcaaagaacaaccaacactggcctgagattcctgactgggtatttctaacaaggaggtcatctcagaaataaagaagtattgctgtttggatggatgctcagctcccagttacagagtgtggagggttctggtaaatcctccagacgaagggcgtggaaataggggtcagagctcacattctggttcatttactgataactaatctgccaatagattaggggagaatgtctgctatgaccccctggggtggcatcctgggagaggacctgtgggcagctgcctgggggtgccatgggaacccaggactggattctagccagtctgcagggaggggtccttggccagagcaggagtaacagtaggcagagctgcccagctctagggtggacacacagggatgagagcatgagggttctggggccagggctttccctgctcagctatctgggaaagataagggtgatgagtaagccagtgaaaggtgttcgtaacccacgagccattcccccccccaccccccccatgagcagttttaagttcttcaagccacatacagccagactgggcagaagcactgagccaggtccccatgtatctggctcccataggcttcatcagaccttgtggaacttgtctgaaagtgagacaaggttccctgccttgtgagggtagagaggccatcagtcacagggtggttgctgttacagaagttctgccaggcaggacctacagcttgccagcatgatggggtgaccaggctgatcctccagggaccagctgtcattgtgacactccccagatggaatgtgtcccacatgatgggcgtgctgtgctaggacatccataggttggagttcaggcagccttagggtagggcaggctcccctgctttgtatccccagctcttctcgctattccgagaggctgggtaagtttcttccaaaacctgtgtgttcttggggaagtgtggacatcgttcctgagcaggatgcaggcagctggttagtttgataaatacagcagcgtgtccgtcttttctagggtgcaatccctgggtctttcatcatgtaaactctgctccatccttcactggaagacctgttcacacgtatttgtatttgtcttcctggaactgtcaggctttgtacctgaggatttagtgctctttgcacagggttcattcagctcagggggccagttcactgtgaagacgccctaacacctagacccccaccgaagtcaaccttctgagcccttgagcacagctttattggagggagaagcgtgctggtagacagtcctgagctcggcattgcttcaaggggtcgagcgtgcgacccttgcctcgcctgctccgccccagctgggctcccacgccctctgggaccgcccggcgcccccgcctgaccacgcctcttcggatctcccgccccctggccgccggggaaggggagtgttcggggcgtggcgggagcaccccccaacccccgcccgggctgctgcgcgccgggcagccccagttcagtgcactgtggcagcgggggtggcgggagcagctggcgccgtgcgatccactccggcggggggactcagtggtgggcggccggccactgggacagaggagaccctggaaaagcgggccgagagacggagccgcgcgtggtgagttgggctctagcggccgccaggttagtgtgaaggactcggctggcactcggaggttccgggcgggctcagaagcagtcagggggtgagatatgcgggaagtggagcggttcgtaagtgcggcgaggccggggcaaggcgcgggcttcccgctctggaaagtttgcggctactgcctccgtcctgggagggctctgcggcaaccagggagggaaggaggagggaggaaccgcggctgggaggaggcggccggcgccaggcagcccgggagagagctaggagtcggcgggcggggcggccgggggtcggggttcaggagcgaggccgcgcttccccgctgccctccggagtaactcagtgctctcctcctgtagtctccacagaggcgttctcccaccggcgccggagccgggcgtggggggttgcagcatgcccgcgcgcgctgcttgaggacgccgcggcccccgctctggagccatggtagtcccggcctgcgtgctagtgttctgcgtggcggtcgtggctggagctacttccgagcctcctggtccagagcagcgagttgtgcggagagcggcaggtaaggactgacccaaggtgttcttctgggggccggccctgaatcacaggggctttggcaatggtgaacagcccttgggtgaggaaggggcgtcgggttgattagcaccacaggggctagtgcgccgaggtttgtcccctgccccgcagatcgctgtcagctcggacgcggcagtttataggggtgtctgtaggctgggagccaccacccaagtgcgaggcgtcacgtggaccggtgcccgtgacggtggtcccaggcagaggggcgttgggaaggcgcgcgagctgacttcccacgattcctattgttgcttctcgaatttgagaggaggaaaaatgcctgttattgattcagccgttctcccggaacagttcttcctctgcttcagctaaaggaaggctggacgttgcggggtggatagtagtatcccagccaaagctcagcttcagggtttcgcatgacaaggtgacagcttcagtgcggctgctcccctcttatcctgtaggcggcctgaggggtcggttcccaggggcgcgcacagactgcccttcaggccgcacgctgggagatgaggggcggttgtcccaggatcttggcgccgcctaggtagtcccgctggccaccaaagtccgatgggacacttgaatgccctcaaacggggcccggaggccaaggatgcgaaagggagccacggtccgctctgcgtcccttggttgcccggaggtgcgacgcgcgcggcccccggctgtgcccggtggcagcgtggcaaagcagagcagcggtctggcgggaggccgcgcgaagggaggctttcgctcggtaagttgtcgccccacccgagctgaggcccgaacagccgctcctttgtacctcggcggccacaaaccgcgcattgatggcggcgcggcctctcggggaggtgcgagtgcggcgggcgcagcgggaggaggcagatggcggtgtgcccctcccggcgcccccgcgcccctctctccagcggctgcagcctcctggaacaatgtcattttctttctttctttctttctttctttttttttatgaatgaaagtgggccgggaacttgaatgtgcgtgtctttcagcggcgtgacagaggcggtcgggaggtcagcgcgcgcttttagcgcctgctaggactgccctgcttcccgggtgccgaatggcccgcgaggagaccacattagcatgtgtattcagatgaagatattacttcttgcgtcgggtgtcagtgagctcgggtaggggcggcggggcggagcgcacaccctctctgtgcctcaggcagtgacggtggcctcctggcacgaccctgctgcgggaaccgaagctgagccgggccgcccgggatcggtgggatcgcccgcccctcgcttctgcgtttgagcttgtgagacaggtagggaattgataggccaataaacttaatccggttccttaacgagatgggccgggctgtaaaaatacaaagacctggtgaagtttacagaggtccgggctggcgctttccctaggaacataaattaccaagcaggagctggctggggtcaagggctgtgcggcggggctaggtaccggcctaacctggccacccttggtgaggcaagccctgctggtgtgcttagtgtgggagacagtaacccttaggggatccagaagttgacccccaggccggcttgcagaagcagggccttccaccttccttgtctccccccaaccctaccttgcttgcaaggctggactttgagccctgctggccctcccagtggttcattaacctgggctgatcttagaccctgaagctttggctcctatgctgagcctagaatccccttgtcctccaggtctcaggttttacttgggacctggaactctccccccacccccttttgtagttgggcctagaaggaaaactagttacccagggtgtgttagggggtagatgatgtattggatagaggtggcctgcccggttgagaaattactgagctgtgaacaaagccacttggggttggggcctgcctcggcttgggtcctctcctagaacctaagtctcctcacctgtcctgctacagaggactggtaatggcagggttgttggggggattaaaccagataatccccggtaagccctcattagcccgcccagcctctggagttttctttcattcttcctttcttgacttttataataaactgtggaaactggaatgtctcaaggtgggatggtggggaatggggaggaggaaggcaggcaagagacccttggcttcaaggccccttggggcaggcaccctcctttctcttgggttattttcctcatacacctggccatacctcccacaccagctgtgttcactatcaaagcaggtgtcactcagatctgtgtcctggttttgctccaaagtccaagtcgagttctttagggtgaccaacctcagaccagggttggatttgatgctggttttgtagtgcgcacgtacgtctcaacaacagaacctaggctgtcagctcctccaggcagtggatgcagcccttcctccagctgggcagctgtggtctcactccattgtttgactcagggggcttctgcataggcacccctcattcctacaccccttttacagactttagacacttaaccagggctttctggaccttaggtctgcaagttgggatttgcactttgtgctgtagtggatgaaaccgagacaatctaggaggctctacgcccagcacaacttgattgggatacagtgtcccttagcctgcaacagtgagcctacagtacctaggtccatgttagtaccatatagcaatggggataggtgctatgggatccatgtggtagggacattgtcctcttaaagggcacaacagaagtaccagtgcttgcgtgctgcgtttggctcctttgttgatggggcctagggagttactggtgcacacctggaggctgatggtgtgggagttcctctgaccagggcattgcttctactgcctcagaatacaatattacatattctgcattgtctcaagcactgtccttcccttatccctacctgactcaggtcataatttcctctacgccctgtgaccctagaatggtggttgttggtagatgttgttacccaaggcccccaaagtccaggtgtctggtttcgcctagctcctaatggacaagatggatgggtggatcaaaggttagctctttgagctgactgaacatttcccctccagccatctgcttctccaagggtctggtttgggagctgccatgttcttttccagtccctctttggattcggttaaagcaaatacttgtgtgcatggcttgagcggttgtcttgcccagaccaaattggaaccaactggctgttgcctttgggccaaggcctggactgaggctcttgaccagcctgtccttgcccttctgtggagggagaactcaagtggcttccagcactgggtggtccccataggacatggtagcaggattggagaactggaagtcaagacagttaggcccctggctatgggacctccatagggcagcttaatactgtggggctctgaaggacatgagctttggggatattttagggatattccctctgtctgtcagaatcctggtggactttgagcctgtgggttgtctctgggatggacagaattgggcctaaggactggtgtggccagagtggacagctgggccttgaatctaggccatgcgtcggcggaatgacaagtgacattatagccagtccagctggatctgaggaaggaggtctgcttagcaggaccacccactcctgtcctgggccccaagcccagccgccctgtgatgggcattgtcaggttctggcagggaggcctggaggagatagcccagctggtggtacgtccctgagggtgaagtctttgagccaccgcatgagctgggcagcacctgggcaaggcagaggtgtattatctgtgtccgcctagtggaggagctatgttgcttcagttccttagccctcagggtgggtggctggctctacttggctcacatgcccactcagacagtccccctccccccagtcctcatttgtgaaatgggggtcccatgtcctcagccaacctgtgaactcaggagtctcatagcccactgactagaggcctaagagaccagaatggtgtccatgttttcctagctggctcatctgtgaaatgggtgttgcaaggcgtggactgtccaagcatcccctagctggtatactttggtctcaagaggtgcacaactcctatgaacagcagccctaggggtgtatgccagcaagggctgctcacccatgttcttgtatgacctcatgttgtcttctctctttccatttattttgattttgtttttaagacagtagccaggctggccttgagcttgtagcaattctcctgcttcagacttctgagtgcatgagccaccatacctagctttctcttcctgtttaaagtatgttctgttccctggctctctatccaaactggtttagaagccaagatgagggttgggtgcaaagagggttctgaaagggctccctattctttctctgagctttgagccaaagtccagggaaggacagcctgtctccaacctgcttttgtgcctccctgtgagcttagggctgattttacatttccaaatggtggaaggatcagaggaaggagaattggtgactttttcgtggtgtggggctgagctcagggcttcaggcattctgggtaggtgctgtaccacagagttgtctgaaacccttcttggcactttaaagatgattcaggtatcaggagggctgtgcctctttcagatcatcttgggaagacagcttcctcctgtagggcagagccagaagccttagcccatgattgacagagctgagatgctggggcccactggctcttacgaaaacagttttccacccctggtttgaacattgtctggcaggcccccaggctccaggagcacatccctcacctgcctacatacagcccttgcttgtgtgtttgcaaagtgaagtgctgggtctccagcatgcttctctggagaccctgtttcatagtgtcccatttactccacagaggttccagggcctgaacctagccagcaggagcaggtggccttcggcagtggggacaccgtggagctgagctgccatcctcctggaggtgcccccacagggcccacggtctgggctaaggatggtacaggtctggtggcctcccaccgcatcctggtggggcctcagaggctgcaagtgctaaatgcctcccacgaagatgcaggggtctacagctgccagcaccggctcactcggcgtgtgctgtgccacttcagtgtgcgtgtaacaggtaagtgcttggtgggtggtgctgcaacgtgtgtgaaacagctgtatagccaaggagatcaggacactcctgggctgggtggctgcagcatccctggcctaagatgttgatagctgttgatagaaaggagggggtacccctaagtaggtgccatctgaatgaatggccttgtaaaggcaggatcctaaaggtatgagagtggtggacctcagatatgggaagcagcaggtctttggatataggggtatcacagaacccccacttggaacttgcagatgctccatcctcaggagatgacgaagatggggaggacgtggctgaagacacaggtgagattagagtctatggccactgagctggtcagggccgggatgcctctctggtggttagaagggaacactgctacaggtgggtagaccagaggacagtgctccaggagcagggaggaggcagggctggtctgcagggacattgctattgactctagtaggacggggcaccacaggggtgaggatagccagggatgcagctcagattgttgctgaggaacaatagatccagggatgaagggcactggtggttgttggttcaggccggcaggaggggacagtgcttgtgtgtgctgaggtgtacattgtgaagaggacgtgtgtgtgtgtgtgtgtgtgtgtgtgtgtgtgtctatgcagactgagtacttgggccatttggagacttctggggaagagtggacaaggtgtcctccagtggaataaaaaaaaaattggtgggaaaacaggactgagtctctggtgtgtgggggcaaggagagtgggtacaggggcttgtgtgagattttagagtggaatcgacacaggaacctagcactgacgccaacagaggctcctgtcctggggagtcatttggcttctcatttccctttcccctttggctaccaggttgttgagagcaaaatttctaagccagttttcccctcccctggctcctgcaccagccatgttaccagtggccttgccctgagtttgtgtccacttctgcctccctggttttcccaggctgcatctagtgcttacacaccccacgtgggcttcggctctgaggtgactaaagggtcatcttctggaccttgcctgggcatgggaagcattggctcactgccgtcgctgagtgtgccaagctaatggccgccctgggagcctgggagggcagctcagcatggagggttccctcaccagcgtatgcagacggttctctccccctgtgctgtggctcctccacccacagatgcacatggtcctatggtagagtgtagtgaggtcactgcagaaggggcctgcctccctagtctgtcctggatccttgctctgtccctcagctgtttcaggagtcccagcagggtggcttcctccacccagcccagaggaaccagagcgctcagtggggggaaagcgcgacctaaaggaagcaggccaggccctgggtactgcagaggctggcttggggtttgcagactggtgggatgacctggcctaggccttctaggatctgcatcctactgggatctggggacctccacttgtgggcctgcacccaagggtgaggaggagataaattcagatctgagagtagggcaactggtaatgcagtgtccaggctcaggcaaagcaaaggactctgaatccagaagggtaaacaggctagaggcaggcaggggaggttctggaaggcactggttacagctgttatgggtacttctgccatcaggggctccttattggactcgcccggagcgaatggataagaaactgctggctgtgccagccgcaaacactgtccgcttccgctgcccagctgctggcaaccctaccccctccatctcctggctgaagaatggcaaagaattccgaggggagcatcgcattgggggcatcaaggtaggtctgggaaagaaaggggcctgggggcaggggctggagacaagggatagtctgcatctactcacagactaactacctgcagctccggcaccagcagtggagcttggtcatggaaagtgtggtaccctccgatcgtggcaactatacctgtgtagttgagaacaagtttggcagcatccggcagacatacacactggatgtgctgggtgagggccaggccgggtggctaaggcaaggggcatctctgggtcccttggccctactggccctgacctgactgcctcttgcagagcgctccccacaccggcccatcctgcaggctgggctgccggccaaccagacagccattctaggcagtgacgtggagttccactgcaaggtgtacagcgatgcacagccacacatccagtggctgaagcacgtggaagtgaacggcagcaaggtgggccctgacggcacgccctacgtcactgtactcaaggtaggctctatccccggctggtggctggcagggtgggtggatcagctgggtcagccctggccttggcccatatgtccctcttggctgaaggatatgttgggatttaccaaggtattggaacttctgagaaggggcagcttagttccagtgcatgtcacctgctctgagctctaggcaggctctgtgttacttgtgccctgctgtgggacttgtctgctccgaggactgagcctgcagaagttttctcttgggtaacagttatggtggctcagggcaggaggatgactgctgagttagtaccctctggaccccaggggactggctagacactctccagctggcccggattggctggtgtcatctgcttgcatttagcactggctctgtcctgcccctccctctgcctgtagcaagttccatacccgagttcaggactttgcgatactggaagcccaaagaaaacagctgttgagagacaaggaggtctggttggggaaaggaatagggattgtttggaacaggaaccctggctgttgagaaagaggccactggggtcctgtctgatgcgtctcacactgtgggcgtggatgttcacgagaataagctagttgccctaaaaagatccctggggtgagagtttagaggctgtgggttacaggttttctctctctctcttccccttcccccaacccccgcctcctccgttctctgtgtgtgcgtgtatgtaagcgtgtatgtgtacctgtggtgacagacatggagagaaggcctctttctgaaaccacgcccaccactgccatgacgtgcctcctctccaggcggctttccaggctttgctgcccagcccatctttgggaatctcccttgccctgcctcatcctcacatccttccgtccttccggagctggctcggggtgtgcctgagcccagtctcttgtccccgcagtcctggatcagtgagaatgtggaggcagacgcacgcctccgcctggccaatgtgtcggagcgggacgggggcgagtacctctgtcgagccaccaatttcataggcgtggctgagaaggccttttggctgcgtgttcacgggccccaagcaggtaacgactctgtcccatgcctgcctggcacgctgagctccagcttcaatgcccccagccgtgcacctgcctgcatgccctgcacgaactgccctgcttgaccctgcctgtgactccaactctacttgtgatgcctcaacaatactggtagcccccagttaccactgactgactgtttgcttcagcgccccctccccaaaggcctgtgctgttctcttgcatcccccacttgcatactcagaagatctgtagagcctattaggggccacgtcctgcgttgtgtgtgagcatcgaccttacacccatctccagctggctgatgccttctggcttcctgtccatccatctgtctggcccatcttttcgtctgcatctctcctgtttctgcactaattctgcatgctgcctttgtgtggcaccgtgctgcccacctgcctgttgctcaccttgggacagaggactcgccactggtggagggactggcttcaggctcggttgcctcagtgcaggaggcagagggccctgggcctctgtggctgtggcagggccatggtggtggccgaagatgtggtggtggcggcggcgttttccttgcagcctggctggatcatctccatgtgaactgctatggtacccaaagggaggtgctggcactcgcctatcgcgctctgttctctctttgtagactgcaggcgctaacaccaccgacaaggagctagaggttctgtccttgcacaatgtcacctttgaggacgcgggggagtacacctgcctggcgggcaattctattgggttttcccatcactctgcgtggctggtggtgctgccaggtactggcttctgctgctgctcatgccgcacctgtcctcttagggtgctgtctcaggacatgccaaagctgccagggacttcagggggcccatcctgtgaaactcacccaggctttgtgcttggtgtggaaacatgaatctgccctgcctgtcttggtcctgcaagggcctcttctctagcagggccccccatagtcctgatctgaggctctggcatttcctgggtgcctgggtagcggtgtgggtgcttctggctctgctgggtttctctcctgggcgtgtcccctgctggctctcagatgtgttttgattatactacaaggcgagtgggggggccatcagcccctcttctccaagtatcccaggtcccttccctcccccactggggcctgtggttccggccgggccgggggaaagcttgaaaaggctggatgaggccccaaaatttgtatctttgcagctgaggaggagctgatggaaactgatgaggctggcagcgtgtacgcaggcgtcctcagctacggggtggtcttcttcctcttcatcctggtggtggcagctgtgatactctgccgcctgcgcagtcccccaaagaagggcttgggctcgcccaccgtgcacaaggtctctcgcttcccgcttaagcgacaggtaacagaaagtagataccaggttttgagctccctgtcctgcctcgtgtctcctagagtcccagcagggcctggggcctgcccgggacatagtttctgtggttgggtgggctgatgcctccttatctccatatggagctcaggttttctctgaggtgcaaaacatttttaggagtcttaagtcaccactgtatagaagtccgagcagctagcccttttcttggctccacaccttgcctcataggcttgaccttgccatcctggaggctctaccaccccaccccttttacaatgcccagcccacccacgttgtatggtaccaatttgtcctgatgacccaagcaggtgtccttggaatctaactcctctatgaactccaacacaccccttgtccggattgcccggctgtcctcaggagaaggtcctgttctggccaatgtttctgaacttgagctgcctgctgaccccaagtgggagctatccaggacccggtcagtggtggtgagggacagtatgtacttggtggggtttagtatatacctggtgggggttctgcggttgggggctaggtagctactaggcagggccttgttggaggtatccccgagatactccagggtgaggtttgaggggtcattctttgtcttcatgagcaaatgcccctagggtttctgagatacagtggtacatgacccatgagggctgggggtgctgggcacacactcactgcctctgtttccatggtcaggctgacacttggtaagcctcttggagaaggctgctttggacaggtggtcatggcagaagctattggcatcgacaaggaccgtactgccaagcctgtcaccgtggccgtgaagatgctgaaaggtgaggagggagggaagtagaggggcctttgagggctgtggggctgtcagctgacacctctgttcccggcacagatgatgcgactgacaaggacctgtcggacctggtatctgagatggagatgatgaaaatgattggcaagcacaagaacatcattaacctgctgggggcgtgcacacagggtggtaggtcaggtggttggtgggcccactggtggatggcgctctggagattgacagcatctctaaggtgcctgtgcttccagggcccctgtatgtgctggtggagtacgcagccaagggcaatctccgggagttccttcgggcgcggcggcctccaggcatggactactcctttgatgcctgcaggctgccagaggaacagctcacctgcaaggatctagtgtcctgtgcctaccaggtggcacggggcatggaatacttggcttctcagaaggtgggcagagacagggaccaggccaggtggagcctctctgagtggaagaccgggtgatcgtttgcctgagctagggaatggtcatctcaggttccttttgtctcttcagtgtattcacagagacttggctgccagaaacgtcctggtgaccgaggacaatgtgatgaagattgcggactttggcctggctcgagatgtgcacaacctggactactacaagaagaccacaaatgtgagccctggtcctgcatggtgggggtgaagggtccctccaggaggccccacccgagagccaacacctctccctctgcccagggccggctacctgtgaagtggatggcaccagaggccctttttgaccgagtctacacccaccagagtgatgtgtatgtgtccctacataggatgggggtagggagatctgaagagagaagagatacaaattgcacttttgcagtcttcagggtcctggtccgctcattgggccaccagcacagccctggcttctctttatcctagtgccctgctttgcccatcagtggtatgtcctggtacagggctgctgcagtaacaggccaggggtaacaggccttctatcctcaattccctgcagttggtcttttggtgtcctcctctgggagatctttacgctggggggctcaccgtatcctggcatcccagtggaagagcttttcaagctgttgaaagagggccaccgcatggacaagccagccagctgcacacatgacctgtgagccttgttcattcctctacagtccagtccctggggtggcaggattcctaccagggcccttggaatgtgtaggagactggtggcctggagggaggttggggtgggcaggaggccagggagccatagctatacttgccgcaggtacatgatcatgcgggaatgttggcatgcggtgccttcacagaggcccaccttcaagcagttggtagaggatttagaccgcatcctcactgtgacatcaaccgacgtaagtgtccctcagtcctgccccctctgtggctgccttgcttattttaagtgttgctctttggagctccagtggcggggctggcctttagggggcatagcctgaacacagatggcgtgggataaaagggggtgaatgcaaagggacagtcctgacaaccatgtccaccaaacaggagtacttggacctctccgtgccgtttgagcagtactcgccaggtggccaggacacgcctagctccagctcgtccggagatgactcggtgttcacccatgacctgctacccccaggtccacccagtaacgggggacctcggacgtgaagggccaacagtcccacagaccaagccccaggcaatgtttacgcggaccctagcccgccctgctactgctggtgtgcagtggaccctagccagcccagtgcaatgggccaacagtagacaagacttcctgcgtgtttatccttggctcctgggtgcagaggccccttgggaacatgcactgctgtagagtaatctcctgactggccagggccaggagcaccaaacaagaatgtaagaggcccaccctgtgcaaccctggggttctggccctctcatttcccactgctaccttccagggaccattgtggagagggctagactccatgtccagagtgggccttggccttcttggtgccccaagctgagcctacagggaggctctgctctgtgtggcaaacctctctcctacatggcaccttgtgcctgggggtgtcatagctcgacatctccaggctgcctgctttccaccctgcccctcagagacaaattacgggtacctgaagggggggcataatgtctatcagaaaggtttattccagaggaaaatgtacatttatataaatagatgttgtgtatgatataaatatatacatacatatatataagaatatctatatggaaaaaggcaaagttgaggcccaagggagcaagatactccatgggtctcactaggaaactggcaagagcaggctgagaagcaaggggcttttctggcacggcagttttgtttgtactggacctgtatatttgtaaagctatttatcaacccccagagcgccagtccccgaccccaggttcatagcgtttagtcccagggtattgcagccatcttaagttgtaacttattaacagcggaagaggttcatgctggatttagggaattgctgagaacgtgcgtctggcctccaccaggctggccgtggccccttggcgcttgaatggctctcctagtcagagctggctccagggagcattttctgttgcctttggccctcttttgtgggggattagatttatataggaactttctttaggagatgtttaaaaattttaaggtgaactggtatttttcatacagattattctaattgctatgtattccaggcaggagcctgtgcccagggaagggctggccctgcaagaaggttcagatgttaatagttatctgttacaagtttatctatctataatttattgagtttttacaagttgttttgctgtaggcttaacacttcctatgcagtgcttctagacttttatagcctagactgctacctttcaaagcttgggagacagtggtgaatgcaattttgttacttttgtactgtcactgggccctaggcttgggtggctgtcccttgcctgtcaaccagcagggtcaggacagtggctcagggtgactttcttggggcctagcacatggtttgtcagcccacactggcagatgtggttttgttaacacaaccaacttactttccaaaaaataaagagataactggttccatgagtgcctcgatttctgttctgagacgggtacagctgtgtccttgttgcctgtggggacaggtggggaggtgggataatagcacctggggaatgagcagcctctggctggtccctggaagaaggtactggtcccaggctccaagggaccttgcttttctttctcagggcaaggacagctggactgcggggtgcctttctgtggcctaaagtggcagattggtccgggttatcagagtctagaggtgccaaggacaggattcaagcaagttgtgtccataggaggggactgtggatatgtatgtggaggaagtgttttgggtctcttcggtcccctggctgtcctgacagggaagggatctcatgaggacagaaggtgcttaattatatttgaaagttctctggggaaaaggcaggtagccaaaccccctggtttaagcaatctgcattgggccaggcaatctctgagtttaaggcaaagctggtctacacaatgagtcccaggacaacatagaacttagggtttctttcctatatccattttgtctgtcatactttctaaccttgggagatgacctggggactgaataaatgtccattctaggttcccttcttaggatcaggcccaccttataggtgagggcatttttttttttttttttagtaagtcaagatggctggagtcttggttctagactgaaataggagcttgaggatcttcaggtgaggtgtactgggttttaggggaaactataggccttggcactgttggctactcacaggaacttcttgaagggcaccagatagtttcagggactcagagccacacagacacatgatgatagtgaccaggcagaaggcagctaaaggatctgactaaagcctacagaacagcgtgtgtgcatatacgagcacgtgtgtgcaagtatgtgtaggggcgtggcaccaggaggatatattcttttttttaggaggatgcatttttatccctgaaacaagctcaattacccaagagagctgtgtgccagcctgtagcgccctctagtgccatgctgagcatagctttgtatggtaatctggacgcccttttcaagtccagggctcttgttagatctagggaaagctagcaccaaggggttggtccacagggacaggagtggtcctgagagagtcaggggccaggtcaggctgctgcaccaccagggtttcctgggcggccactgcatagggaggatatagtatgtgtggctctatgtcatcaaacacctgctgctgtctagtcttctctggaggactctgctccactgccttgccttttcaacatggttggtaatgatggtggatggtttcttggcctgctttggctagtaccaggaacaggctggctcccaggacactcctgtttactgccactggcctgtggctggctattattctgggttggggtagatcctagtgttcagaggaccagcaacaagaattatcttctgagtaggagagatgactcagtgatctatttagagtacttgctgcttttggagaggacctggctttattcccagcacccacataatggtcacaactatccataactccagttttaggggctatcaccttctggactgtgggcactggacatacacatgttacacatgcatactttcaggccaaacagataaaaaagagaattatcttcccaagaagggaagaaaccagttgtgtgtcaagtgtcctgttttttcagtgaaactcgggcacacaaagctttcctcaagagtgacttagggacagggcttgagtttattgtgtaagtctacctcatccgaacattagctttgttctcaatacagcaagtgggcgtgctgtgctcttttttttttttttttttttaagatttatttatttattatatgtaagtacactgtagctgtcttcagacgcaccagaagagggcatcagatctcattacaagtggttgtgagccaccatgtggttgctgggatttgaacttcggaccttcggaagagcagtcgggtgctcttacccactgagccatctcaccagcccccgtgctgtgccctttaaatggctgtccttcctcaccaacaagcagttcctacccttgccctgagacttgtacttcttgagcctggggacgaatgtgacctcaatcaagcattctagaaggcaccaagaatggctccaggaggccacacactacattctggtgtcctgggctgggcagcagtcactgatgagctcagaaggggatactgtgactttatcctaacacccagacccccctcccagctaaggtcccaaagcaagtaccatggcgggacctggggaattgctcccaccaggcacactgtcctcctcaagtcccatggctggatcctgtctctggactgaatagtagatgttgtgtgggcatagaccacatttccctgggattcctcagccaaggtcctagctcctgtccaccccgcacagctcctaaggaaaggttcggccctgaggtgatgttctgtggttgtctgagcgctggcaggccaagagagcctggttaggtgtgggaacacccaacctggacacaccactgtacagcagacaagtcatcagtggcactttattcagtcagttcttacatcaaggtgtttagaaaacatcatgctgcctgctagccccgcagggccctgggttagcctagggtctaagaagtccttccttgtcagcttctataaaacagggctgtagcacaggatgggggtacatgggcttcctcagataggtcccacaggtcatgagcctggaaccaaggcttgagcccccaaatgcgagctggcactcacctaggggctgaggggagagtcaagacccactaaaatccgaaaacacacctggtgaccacagcacaatcattagagctcaaggtggtctgagtttccactcaatgtcttgaatagattgctcagggctcagaagtatcactttgcgctgttacatgaacatgggagatgtctacacatgatctagctggaggcactgggacccctggaagacagaagagggtatagaacttgctcccctaccatggtactaggaggcgcagcctaagaccatgagaatggcttttaagaactgtatggtacccttcacatttgagatgttaataggccaaaaggagcctggaatttaggtgccagctctccagatcctggtgggaaggtggttcagagtggagagaggaaacgccaggctcctgggttgaacccttaatttaacaggtgcagacatgtcagctcctgaacgtacaccctgggcaagtgctgaggtacaggacagaatgacagttgaaatacagccagctttcaaatgctcagtctgagtacaggtctcagtcctggatcctccatttcttttttttaagggggtggtggtggtggtagtggtttgagacagggtttctctgtgtagccctgcttgtccacctgcctttgccttccaagtgctgggattaaaggcgcacactgctatcactgcctggtggatctgctatttctaaccctgacccaggtcagttaagcaaacagatgtgaggacaactccaaaaaccaagggaagcatccactggcagacctagcacgtgtgtttgctaaggtcctgcagtgaggtgatggcgtgacctgcaaggacagagtccagagtggagggtagaggtacagtagggaattcctgaggcagcagcagacagtacaggccactgacagtacccagtaatacactaaaggatgaagacgatgggcagacacaggacagctccagactgctggtcataggagataccctctactgtggggacacacctggcaaccataatcttgtcctcgtagggacaccaggattcagatttaaccacggagccactaggctccttctgctgttactatgcacaggtttacatgcaagaatcaccttattcctgcttagcataatgtttcctttaacagttaagaaagaagtttcaagaaactgagaatgtcccattctgctcactgcttctctgtacatgttccagatcctgtctggagtcaaggattttttttcccctggacagggacttgctaagtagcctaagctgaacttaagatcttcctcccgttgcgctccaaggatggggttacaatgtgaaggtggtggtgaggccacaggacacccagccctggcctgtccatggagccatttccaaatgagaaaggcaaagagctctagactgtccacttagaggggtgccagtgaactgttggcgggcagggaacaccattctgaaagctttgtggcatcacagtacaacttcctcacttcttggtggctggagcacagccatgaacatttgtgctaaagaagctggagccttgagcctacaacatacagagattcccttgtgaagccccatcttgcacattgccctgtgggttaggacttgaattttctgttacaagccacacaaagcctcaggtatattcaagttgcagatgtcagttctatccccaaggcctgctcagcaatgtgaatgcccaacagaaaagatttcattttcaaaggcttcttcaatgtatgtcacccactatttaggaattactcatgaattaggcagacggtcatgtatgaaaagtcagtactagtcagttaaagaattattaagtggtgaccaatggtgaactcaagagagcgctagtcaacatgtctcggaatccatacaggatacagacactgctgtcagggacctgcagttatgacaactgtgaaggcgtgagcagacacatctatgtacatgggcaatcgggaatctcaatcccttggactgacggcagtgtcctcagagcagagtggcctgcatctgtgttatctaactcctagcccaaggcctatgaggacacatagcagacacatgctctgggctccacacaggtgctgaggtccagctggttctccctcgcctctcacaggctggaggctcgctcagatcctgatccaggaaggacacatacagagaaatgccttcctactgagcctggccagagccatgtctgaagctagggatcagtgtagggctatgatcctattggcagctgtaccttaacccaaggcttagggccgttcagtaccacaccagagcatgagtccacagagccaccctctccggctccagccagactgaatcttcgtggaatgatgaaaattaaaaattgcttcattatggaagtttctgatttattccagacaaaatattagatttgccactaagaatcacctcaaagcaatcactcttgtgtgtcatgcccctgtggctggcacggcatgatgaaggcagacctgtgggccagaagctggcagctctaattcttcacttctgcggcctctttctcagccttctccttggccttctctttctcttctatcttttcttctttctctagtgtggccacaatttcagctacctgggtggtagagatctgaacatcttctttgttcaccaagtcgattacctacacacagaggagggagacttaggaggggctccaccaccgcagtcacctgctgtccctcaacagctccgggagactccccctctgagccatcctctaggttggacacttgccattttactgcatgctatgggtatctggttctttctgctgctcagacctccaagagttatagacttcacagcgagggtgcggcaccagttcccatagcacatgcatgtttgatagtgcctgttttaaaatggaactaaaggaaattaacctatagttctggctatataaagaaaaatcacaagctggccaggtgtactgagaaccaagatgacagtggcaaacttttttccctcaagaccataacatataatttcagtaggttcatgacagtttgcaggctggagcccaggcttcccttagaggctggatctggactcaggtcttctcggctgacatccctggagcttagctactattcctactaactctacctactcagtatctttcaggcagccccaaagggatcctggcagaggtgttgaccctgttcctcagatccaatagggatgcaaggtcccacagtacatgtggaaagattccaaggcggcatgcaggggcattttcttatctcaccggtatgtctggaactttagtaacttaattccagcgtgatttcaaatgagagcaaagggctaagacacttgggcttgcaaacttgacttcccaacagtcttccttttgaaaggatttgttgatttttactatgtacattgttgttttgccccttggcgtgtctgtgaaggtgtcagatcctctgcacctatagttacagactgttgtgagctgctctgtgggggtaggaattgaaccttattcctttggaagagcagctagtacctgtaaccaatgactaagccatttccccaggcccttcctgatcgccgtacagctctgaataagcagcccccccacaaacccctgggccctagaacaggaaagcagccgggctggcctggcgcagccgcactgactcaccttgacaaggtcatcgatgttgatattgccgtccttattatcatccagggctgaggtcaaactgatgagcttgtgctctggaatgtgcttgatttgcttcatggcgctgatgagctcagtgatgctgatgacactctccctggggagtgcaatctgcatgtgacattggccaggtacctgctctcatgccttacccacagctctttccataaggtctgacactggagccatgcatgaactggaaatatcagcatgacttctcccacagtgagatcctaagccgctttcccttcaagatgcaaggctagcatgggcgcttacagaaagcatccttggatgctggggaggttgcttagtggctgtcagtgttctactatgtgaggacctgagttcaaatcctcagaacccatgtaaaaacctggtagtgatcacacatgtgtctattaccacagtgctattgggtgggggcaggcataggaagatcatgggcttgaaggctgacggcctccatgtacacataagcatgtataccagcacacacacacacttataacatagcacatatgcaaataccacactcacacacatgctcatgcataccacacacacacacacacacacacacacacacacacacacctgaaaaaagttttgaggctggagaaatggctcaatcgtaaaaagcaattattgcacctgcagaggcttgagttcagttcccagaacccatgttgggtggctcacagttgtctataattccagctctaggggatctgacactttcttttggcctccatgggcaccacacacatgtgcatctccccacagtggggagcaccacgtcttccagtctgtcagcaaccaattccaggacttagagtagaagccacgctgtagccatctgcctcactgtggagtctatggtcaggacactgtttgctggtgtctgctcaggaaggcagactgtccacaatggtgttataccagggttagaaaagtggggaagcagctgggcagtggtggccagcacttgggaggcagaggcaagcagatttctgaattcgaggccagcctggtctacagagtgagttccaggacagccagggccacacagagaaaagtgatgaatcaggagaaggcctgacagtttgaagaaccaggaaccaagttcaaaaagctcaaaaggatgggaattcagggaagaggcaggtctgatctacctaggtaaaacaagcatggagatacagaaactgagctgtgaagggaggaaaaatgagagcagagatctcttgtaatcctggctgcccctggccctaagtgaggtgggcaggtagaggtcaaggagatacactttgggactagaggcccactcaccctgttggagtgctctggctggggcccagcttgccatcctgttgagtggtctccagctgtgtgatcaggccatcgatctgcccgatcatctgctgcactcgctttgacagcctcttgctcgctgcagattcttctatgtacttctcctcacccgtctttgaaagttccttcttgatctcctgtaagtcctaatttaaaaagtttaccccccaaaagagggagggctctacattaatttgaacttaaacattaagtcgttaatttgaactgggacggggctcagtggtacaaggtactatgcaccaggtcctgtgcttgacccccagctccacaaaacagaaagcaaccaaacagaagaattaaattcagcctcaggaactgcagagtcttatttctctcatgcaaacttattcttttttgttgttgtttgtttgtttgtttttcgagacagggtttctctgtgtagccctggctgtcctggaactcactttgtagatcaggctggcctccaactcagaaatccgcctgcctctgcctcccgagtgctgggattaaaggagtgtgccaccactgcccggcacaaacttattcttattaatttatttttgtaagttcaaacttttaaaatctattctgaatttcaacttcctttgtagttagcaatgaataaatacaaaggctcaaggatgcctaagcactgccttctttatatgggtcagaggtcacagggctaaaagcagggtgaggagcagagggaataaggcactgccttgtctggtgaaaaatgtggtttctggtggacaagtcacataacccag

SEQ ID NO: 1362 - DNA, 2887 bp, Mus musculus
ccggcggggggactcagtggtgggcggccggcactgggacagaggagaccctggaaaagcgggccgagagacggagccgcgcgtggtgagttgggctctagcggccgccagtctccacagaggcgttctcccaccggcgccggagccgcgtggggggttgcagcatgcccgcgcgcgctgcttgaggacgccgcggcccccgctctggagccatggtagtcccggcctgcgtgctagtgttctgcgtggcggtcgtggctggagctacttccgagcctcctggtccagagcagcgagttgtgcggagagcggcagaggttccagggcctgaacctagccagcaggagcaggtggccttcggcagtggggacaccgtggagctgagctgccatcctcctggaggtgcccccacagggcccacggtctgggctaaggatggtacaggtctggtggcctcccaccgcatcctggtggggcctcagaggctgcaagtgctaaatgcctcccacgaagatgcaggggtctacagctgccagcaccggctcactcggcgtgtgctgtgccacttcagtgtgcgtgtaacagatgctccatcctcaggagatgacgaagatggggaggacgtggctgaagacacaggggctccttattggactcgcccggagcgaatggataagaaactgctggctgtgccagccgcaaacactgtccgcttccgctgcccagctgctggcaaccctaccccctccatctcctggctgaagaatggcaaagaattccgagggcagcatcgcattgggggcatcaagctccggcaccagcagtggagcttggtcatggaaagtgtggtaccctccgatcgtggcaactatacctgtgtagttgagaacaagtttggcagcatccggcagacatacacactggatgtgctggagcgctccccacaccggcccatcctgcaggctgggctgccggccaaccagacagccattctaggcagtgacgtggagttccactgcaaggtgtacagcgatgcacagccacacatccagtggctgaagcacgtggaagtgaacggcagcaaggtgggccctgacggcacgccctacgacactgtactcaagactgcaggcgctaacaccaccgacaaggagctagaggttctgtccttgcacaatgtcacctttgaggacgcgggggagtacacctgcctggcgggcaattctattgggttttcccatcactctgcgtggctggtggtgctgccagctgaggaggagctgatggaaactgatgaggctggcagcgtgtacgcaggcgtcctcagctacggggtggtcttcttcctcttcatcctggtggtggcagctgtgatactctgccgcctgcgcagtcccccaaagaagggcttgggctcgcccaccgtgcacaaggtctctcgcttcccgcttaagcgacaggtgtccttggaatctaactcctctatgaactccaacacaccccttgtccggattgcccggctgtcctcaggagaaggtcctgttctggccaatgtttctgaacttgagctgcctgctgaccccaagtgggagctatccaggacccggctgacacttggtaagcctcttggagaaggctgctttggacaggtggtcatggcagaagctattggcatcgacaaggaccgtactgccaagcctgtcaccgtggccgtgaagatgctgaaagatgatgcgactgacaaggacctgtcggacctggtatctgagatggagatgatgaaaatgattggcaagcacaagaacatcattaacctgctgggggcgtgcacacagggtgggcccctgtatgtgctggtggagtacgcagccaagggcaatctccgggagttccttcgggcgcggcggcctccaggcatggactactcctttgatgcctgcaggctgccagaggaacagctcacctgcaaggatctagtgtcctgtgcctaccaggtggcacggggcatggaatacttggcttctcagaagtgtattcacagagacttggctgccagaaacgtcctggtgaccgaggacaatgtgatgaagattgcggactttggcctggctcgagatgtgcacaacctggactactacaagaagaccacaaatggccggctacctgtgaagtggatggcaccagaggccctttttgaccgagtctacacccaccagagtgatgtttggtcttttggtgtcctcctctgggagatctttacgctggggggctcaccgtaccctggcatcccagtggaagagcttttcaagctgttgaaagagggccaccgcatggacaagccagccagctgcacacatgacctgtacatgatcatgcgggaatgttggcatgcggtgccttcacagaggcccaccttcaagcagttggtagaggatttagaccgcatcctcactgtgacatcaaccgacgagtacttggacctctccgtgccgtttgagcagtactcgccaggtggccaggacacgcctagctccagctcgtccggagatgactcggtgttcacccatgacctgctacccccaggtccacccagtaacgggggacctcggacgtgaagggccaacagtcccacagaccaagccccaggcaatgtttaccggaccctagcccgccctgctactgctggtgtgcagtggaccctagccagcccagtgcaatgggccaacagtagacaagacttcctgcgtgtttatccttggctcctgggtgcagaggcccttgggaacatgcactgctgtagagtaatctcctgactggccagggccaggagcaccaaacaagaatgtaagaggcccaccctgtgcaaccctggggttctggcccctct

SEQ ID NO: 1363 - DNA, 2403 bp, Mus musculus
atggtagtcccggcctgcgtgctagtgttctgcgtggcggtcgtggctggagctacttccgagcctcctggtccagagcagcgagttgtgcggagagcggcagaggttccagggcctgaacctagccagcaggagcaggtggccttcggcagtggggacaccgtggagctgagctgccatcctcctggaggtgcccccacagggcccacggtctgggctaaggatggtacaggtctggtggcctcccaccgcatcctggtggggcctcagaggctgcaagtgctaaatgcctcccacgaagatgcaggggtctacagctgccagcaccggctcactcggcgtgtgctgtgccacttcagtgtgcgtgtaacagatgctccatcctcaggagatgacgaagatggggaggacgtggctgaagacacaggggctccttattggactcgcccggagcgaatggataagaaactgctggctgtgccagccgcaaacactgtccgcttccgctgcccagctgctggcaaccctaccccctccatctcctggctgaagaatggcaaagaattccgagggcagcatcgcattgggggcatcaagctccggcaccagcagtggagcttggtcatggaaagtgtggtaccctccgatcgtggcaactatacctgtgtagttgagaacaagtttggcagcatccggcagacatacacactggatgtgctggagcgctccccacaccggcccatcctgcaggctgggctgccggccaaccagacagccattctaggcagtgacgtggagttccactgcaaggtgtacagcgatgcacagccacacatccagtggctgaagcacgtggaagtgaacggcagcaaggtgggccctgacggcacgccctacgacactgtactcaagactgcaggcgctaacaccaccgacaaggagctagaggttctgtccttgcacaatgtcacctttgaggacgcgggggagtacacctgcctggcgggcaattctattgggttttcccatcactctgcgtggctggtggtgctgccagctgaggaggagctgatggaaactgatgaggctggcagcgtgtacgcaggcgtcctcagctacggggtggtcttcttcctcttcatcctggtggtggcagctgtgatactctgccgcctgcgcagtcccccaaagaagggcttgggctcgcccaccgtgcacaaggtctctcgcttcccgcttaagcgacaggtgtccttggaatctaactcctctatgaactccaacacaccccttgtccggattgcccggctgtcctcaggagaaggtcctgttctggccaatgtttctgaacttgagctgcctgctgaccccaagtgggagctatccaggacccggctgacacttggtaagcctcttggagaaggctgctttggacaggtggtcatggcagaagctattggcatcgacaaggaccgtactgccaagcctgtcaccgtggccgtgaagatgctgaaagatgatgcgactgacaaggacctgtcggacctggtatctgagatggagatgatgaaaatgattggcaagcacaagaacatcattaacctgctgggggcgtgcacacagggtgggcccctgtatgtgctggtggagtacgcagccaagggcaatctccgggagttccttcgggcgcggcggcctccaggcatggactactcctttgatgcctgcaggctgccagaggaacagctcacctgcaaggatctagtgtcctgtgcctaccaggtggcacggggcatggaatacttggcttctcagaagtgtattcacagagacttggctgccagaaacgtcctggtgaccgaggacaatgtgatgaagattgcggactttggcctggctcgagatgtgcacaacctggactactacaagaagaccacaaatggccggctacctgtgaagtggatggcaccagaggccctttttgaccgagtctacacccaccagagtgatgtttggtcttttggtgtcctcctctgggagatctttacgctggggggctcaccgtaccctggcatcccagtggaagagcttttcaagctgttgaaagagggccaccgcatggacaagccagccagctgcacacatgacctgtacatgatcatgcgggaatgttggcatgcggtgccttcacagaggcccaccttcaagcagttggtagaggatttagaccgcatcctcactgtgacatcaaccgacgagtacttggacctctccgtgccgtttgagcagtactcgccaggtggccaggacacgcctagctccagctcgtccggagatgactcggtgttcacccatgacctgctacccccaggtccacccagtaacgggggacctcggacgtga

SEQ ID NO: 1364 - DNA, 33352 bp, Homo sapiens
  misc_feature (8632)..(9859): "n" at positions 8632 thru 9859 can be any base
ccgaagctgagcttcttcacctgtcttctgactcacttatctccccgagccccggagatacaaggatcacaggcaggggccttctcctgagctggccagagctgggcaggacacttggggcacgcagcttttgtgggctagcctggaaactcggctatcctggacaccacactggcaacaggttgtctggagccaggtcggggcatgtggggcctgagccaaggctgtcagctgaagcctctgacattacttgtgtccctaggacaatcacacgtgagagcacatgcacacgtgaccatgtgagcacacaggcacgggttcgggccccaggctgtgctgccacctgaagcccctgccctggctgtggatgcccatttggctgggcacagcaaggcggcggccttggcacagggagcctgcccagccttgctctgacccagttttccatgcccaggcaggcgggtggcactggtgtagtggctcccagagcttctctttggcaacaccaatcccctgggcccaaagcagctccacaggggcacctggatggctccatgtgccctgggcatgtcctctgagagggtgggtgcccccctgggatgtggccacccagccccagcggtttcacaccctagaaccagtgccttctgcctgtggtccctaggcacacagctgccgctgcctgaatgcgctctgcctgccctgccttctgcctccagatgaacggacctgtcatccagggagcgatccctgtggccctccactctagacctgcaggctgcttccttgcccactcctgggggtcagtcatggcctggctgtagaccagatccttgaggggtgaatctggggataagcctcagagccacagggcctgggcaggcctcagaaggcatcccagagaagggagggtggaaggtccccatgggcagggaggcgcagggagcaaaggctgctgggagcagggaggggagctgggcgggcggaagggcggccgtgggaagccagccctggcctggctggcctgataagctgcccctttgatccacactgaggcaacacagacccccatcctgagataaccccgggcctgggacccaaggctctggtcaacccgccctcccgagtgtgcgctgccctgcccctccggccctgacagtgaccggtccttgctcagctgcaagctgggtgggtgcagtctgagcccaggcctggcgggcactccatgtgcccccaccccaggacctgctggtcctcaccctgccttcaaagcctccccagccccagcctctgtgtccagctctctgtcccctttggttgggaaggggcacctcccccgccccccagttcccatccccttcactgtgcccctgggaggcccctgaggccctcactccccagctggggctcagcaggtttgaggccctttgggcagccctgtctgaccagggctatagtgtggcacaggtgtgggcacaggtgtggcataggcgtgggcaccagctatgtgtggcttgggtgcacactgcgtaggcaccttctcccgggcgcctgcctctgcctggcgccggtcagcacccccatgccctcggtccctcccctgcccaggtcagtggacaatgaagctgtcagcagactggggccgggggaggcaggcaggcgtggcggggaagggaggcctcaggaggcgaagatgtctctattaggggctgcagaccttgcttccactgtcctgcccagccctggggactccgagagctggaggcagaggtggccccaagcttggggcagaaagggtcgtcttgtccatcagggccccagtcagccttgggactgggtccctggaaaggcaggcccatagatggaggagcccagagcgtggggctggccacaggtggtcagggagggtggaagcgtggctgggagctgcacagggatgaggtgtcgacggcgctgacatcccagccctgccagcctcctaaggcacccacggcccacatctccctgctgagcggaagcactgggggacgctctacccagtgcctcagcagaccctcagccaacggctgttagaatatacctcgtgtgaggtgcgtcacgatacccagctgtaaaatggggcaaccctgtggcttcaacagactccccttcccagtgcctgcggctgagctggagtggcaggagggcttctgtgggagcaggtggcaggaagcataagggctgggggacctgcagaagctccgtacccccgggaggctggggccagagcaggcttcttgcaggggcgctggtttcggccctcaccctgactgccctgccggatccgggcagacgaggccccacgcacaccgcagcaaggggcccaagacgccagccaggccctcaccttggcaagaggtggcttctgtttctgacaggtcaacagctgggctaggggaggtctccagggaccagccacgccccacttcctgagggctggagagggctggggagggtggcccaggtctgcgatcatcagggcctggccagggccttctttcccagattcccccagagctggagtccccagagccacgccccttccctggcatgccctggcgcccgggccatctcctcctgggcacttgcggaggttgcccctgctctccccactgccctctcagcaggcgtgaatagagtccctcatagcttgggagactgaggcccccagcaggtgcctcttacccaagaccttggaactgggtgaggtcctccgggcccaccaggacccgcctcagacatcaggctttgcacttgcagcccggagcctcccgaccccactcccaggccaagggcctctggccgcagcctccgccatcatctgccggcttctggggccgagcatcagggccctgtgcccctgctgagcgtgccgggtgggggccgggctgaaggctgcacctggaggcagggctcccgaggaagccgcccagggggtcagagccaaacagctgcctcctctagtcagccccatgcagccttacgggggcagcgccctgcagtggctgcgggtggggccgggtggggcagggctgccctccctcatgccgctgggcacctggcctggggcagggggctctggcccactctcgggtctccctaaatactgtggcgaacaccccacccttcccaagctcagctgaaacctccctggggcagggctgtcagatcaggccactgagcgcctcctgctgcctgtggctctgtgcctcagtttccccacctgtcaagtgggtgttggtgatgtggctggcatgaagtttctgtcaggagccaccagcactccgcaccttgccatccacaggttctcagccacacagggtgtggggttgccccaagccaacccatttgtgggggtggggccgccccacaccccggctgggctggacgggatctccatcctctcgtgggcagctgcctgctgggcccagttggccactctggactcttgggccctggccggaagcacgactgaggttgtccatggtttggggacgggcaggcagagggtggccaggcgaggccctgagaaggggctctggccgaggctggccaggtgacacccggagtggcgggcagggctgagaggaaggggcatcctgaagagggcggaggccgcggagggaggagggtgtgacgtggggttggaccggcggccccgaggcctggattcctaattcagccggagcctgtggagtcggggcttgtttattcttggcaggaaggctggtgctgggggggcagaagtggggagtgaagccttttcaaaaaataataataataaaaacgctcatttagaaggctcccaaggcgtgctgaactccaaaagggtcttggaaaaaatgctgagagggtttaagtgtaaatggacccaaaacaccataattaaatttcctttaaatttaccagagtttggggtcaaagaaaaaataaaacttagggaaaatacacttgaggtttcaggcaaatgccaagtgcttaggaaaatagattctgagctgctcagcggctaccggcctggcccccgccatcctgggagctgcccagccttaacccctccctggccagccctccactgcccgccccacccacccctgtgggggaccccaccaccacctcctgctgcttccgcacggttcgagccgccctcctgtgccagactccaggcagggagctgggcctcccccactcccaggctggggcaggagcccagggggagcctgaacattcacccccgcccccatctctacagctctctcttgtgtctgcagacagctctggtttcctttctttgctcatctgggagcagccacattttccaaaccaaagtcagaacttgaggtctagtggtctgagtgaaccaaacggtaaaaaggccagaatgtttgaactgggactgtcctgccatatccaagacgacaggctcccagcagctcatgactcacggtgttaccctttttcctcagcctgccaggaagctcagagctaaaattaagggtcttgctagctgcgttggcttagggattttggaatattttttcttcttcttcacgttctttaaaatttcatttctgttataatgagcaaatcaaggtttgtttttttattttaatacttttcaaattttgtgagaataaatttaaaaggcaaagtcaggcatggtggcacatgcctgtatttgggaggctgagacgggaagattgtttgagcccaggagttcaagaccagcctggacagcatagtaagaccctgtctcaaaaataaaatagaaggcagaaactacccataaactataatagctatagccccactaacagcccagtccagttcagcagggctacccaggggcccttcttcctccatcccatggtggcctgccctgatccctggcacccaaccctgtgccctgacagtgtggaagggcactagtggttcctggggaaggtggtaggagatggggagctccgaggggagatcgcatggctcccagggggtcccatgggcagaagggacttgatacccactccggacctccgtgtcccctgtccttccactcagcctcatggcagggccgagggaagctccccgcagcagccccagccctaggccaggttctgatcccagaggggagctgggcaggaggctctctctggcagctcgcctgccctgggttccaggtctccaagcctcggcctccctgcccacctccctgtcgggaaaggcggcagctgcctgcccggagtgctgtggggaacaggcggtgtggatctgagactgtgctgggaatgtcctctctgccgaaggcgcctctgccattttccgagtacctgcaagggagacgcaggagacgcgggtgtgagcggggccatgggcaacctgcggaggccctgcacccaggatgggcctccctcccaggcaccctctgccactcacccacacaggccccagcaagccaggctgcccagctctgagtcaccgccagggctgggctgggccgggccgtcagccgcacgcgccgcttgtctcggcccctgcctcccatactcaccttcaggggggacccctgggtatgggcctcaggaggtgggtgggggtgcagggggagtgggtagggaggtgtaaaccggagtccagcagatgggaagttcctgtccggccggcacctgcttggagcctcctgcacatgcggaccctcaacaggctccccgagtcctcgcctgccctccctgcctcaaaggccccagaagggcctacttcatcaggtgccacgaggatgaagccaggtaatattgcaaagggtctgtggaaacgcttgagcaagggcactgtgatgaaattgtggctactgacagctaatgtgcagagtcaccgaaattcaggagtcaagcagccggcctggcctcacctcagtgtcgggggaatgccatctgcacctgtgggcttggaagtgatccatttgaacaatacaattattcagacaatactaaaccgagctttcaggcaagacctcccgtggccctgacagtcctggggcagagtgggcagcaactccttgctggtggccgtggcggcactaggacccttttgaaaccaatttggcaaaattagcggcaccacggaaatgctcctgccctttgacctaactgctcccagacagtgccactggagaagccattcagaatgtggagggcgccagaggaggcagctgccacgcagtgcgtagtgggcagaacggcggcctccaaaagacatagtcatgtcctcaccccttgcagcctgtgaacgtgaccgtatttggaaaaggatctttgcaaatgtaattaaggtgagaatcttgagatgggggatcctcttggattatccaagtgggccctatatccaacgacaagtgtctgtataagagatggaagagaagatggcagagtgggaagcagaggctggagcaatgaggctgcgagccaagggacttggagccctgggacacttggagcccccaggagctggaaaaggcaggaaagatcttccctggagccttcagaggcagtgcagccctgcctacaccttgattccagacatctgctcttccagactatgagaaagtaaatttaagtcaattagtgtgcagtaatttgtgagggcaacctagaaatacaagatgctactgaactaaggaatccccggctgctactggagggagaggtggtgggcctgggccagggctgcggggacaaagggagggagtgggttgtgaaagtgcctggtccccagtccctcctcctgccagcactgcccactggtcaaacccacccagaagctggagagcaagggaccctcagagatagggtctgtaggatcaggctttcaaggacaaatgggagaggggctggggaagggacacatggggaccagacccctactgggcatttctgccaaggagaggatcctggtgaggaagaaagcagaaagctatgtgttcacagatgcacggatgctcccctcccagagacccgtggccgtgggtgcagagggagtcagtccttcttggaggtactgggaaaggagcctacagctccactgagcccttctgcctacaggaggggccccactcagcagctgttccctgagggagacctgtccacgcgtgagctccttcccacagtcccatccagtcccccaggggaaggggcaagacggtcaggtcaggacccacacgcatgctggtgctttcagaacctgatgacttagttggttaagagagctcacacctgcaatcccagcactttgggaggctgaggcaggtggatcagttgaggtcaggagttcaagaccagcctggccaacatggtgaagccccgtctctactaacaatacaaaaattagccgagtgtggtggtgcacacctgtaatcctagctacttgggaggctgagacaggagaatcacttcaatcagggaggcagagattgcttgagctgagactgtgccactgcactccagcctgggtgacagagcgagactccctctcaaaaaaaaaaaaaaaaaaaaaaaaagagcagggccaatgtgctgctgtgccttggggaacggtgtcctgggagcggacctggctggcagtgacctggggctgtgcactggagggggctggacagtgcacttggaggtgggtgagcctgggccccaagacggtctggggacatgggcttggccagagcaggaaatgagggtggccaaggacaggtgctgagccaccgagtcggcacagaggggtgggcatgagggcttcctgggagcagggcccttccaagtccctgaggtcagcccagggacaccctggcctctgggagattcatggtggagctgtgcatgggctgggtggggtcagcaggcagccagtcactgaggggctttcagcgcccattttcctgatgagcacctccagtcctggaagccacaagccaggcacgcagcccacccggccggccctcccggccagctcactggctcccatgggccccggacctccttgggctttgcctgaaggtgggagcagatggccttttccttgtgagggtggacacagaagccaacagtcatgtggggtgaggggacccaggcacctccagcgtcccccgcagggcagcaccttcccctcctgggaacccacccctcttcagctggactctgagcccaccccgtggagcccagaacctcgggccagctcaggctctgccaccagctctctgtcatcctccctcagagccgggctgtgctccccaagccaggggtatccagcccccgctcttcatcctaggccgggcaggcagccagccccaggcctgtgtcctccttggggggcggggggtagggacccctcgcgcggggctctcaggcggcttagctgcgtgcggccccaggtcagtcaacgcagcctctgcacctcgccggtcaggtacgcaggccgcgccgggctgccccagacctgcggcgcacacgggaggctcagcctggaatgccgtcctgccctcctccacctgaggaattgccgctcacaccacagggttcagctccgcggcatctcggcgaagcctcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgcagtctcccgacggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcaggtaagaagggacccactaggcacgggagaggccggcccgtgcgggcagaggcgttggggacgggaaccggccccgggtcggaggggccgccgggtgtgagtgacgccccggggttagagcccggattccgctgcctccttgccggagagcgcggccagagctagcgcggcgacttgtggtgcgcccggagccgcagctaccctccaagtgcgaggccaccacggggagccaggctgggggttggcgtccgcagccccgatcccctgcgactccctagccctggcctgtcgggagggcgcggggggccccatttccacgattcccgctgttgttattcgggttctgcgcagacggaaagttcccattgttggcgtccccctcccccgggccccagtttgtggccagcttcagccaaggcgagagaccggacttctaagggtgggtgtgcgcgtcagcgaagcccggcccctgcccgcccgaagaggcagcagcctccagcgtccccgctgccgaccctgcccctgcctgggggccgagggcgcttccccgtgggtgcgcgccgagctccaggcaagcgaggggcgcgtgtcccagcgtcgcgggccctagactgggctggcggtccaggtcccgcgggacgtcgagggtctgaagggaggtcccaaggggcgaggggaggggaaggggcgcccggccggacctgcacacgcgccgcggttcctcgtgggccgggccgagagctccggtgccgccgccgcgtacacccgctgccggctccggacgggcgaggggggcgcgcacagctcagcccggcggccgcgcggagggaggccttggcccggtgagctcgcgccccacccgggcccaggcccgaacagccgcttctttgtacctcgacgcggccacagaccgcgcattgatggcggctcggcggctcgcggggaggtgtgagcgaccgcgggcgcggcgggccggggagggcgcctggagggccgaggcagatggcgtccgccccgcccgcgcccccgcgcccctttctccgtcggcggctgcagcctcccggaacaatgtcattttttttatgaatgaaagtggcccggcgcttgaatgtgcgtgtcattcagcggcgtgacaggggccgtcgggaggtcagcgcgcgcttttagcgtctgctcgggcggccccgcttccaggggtgccggaggggcggccgcggggggagcttggctttcgcattctcattcagataaagatattactccctacggcccgggaatgtcagccagccccggggaagggcggcggccaggctgcggagcctctcctggaccccctgcgggcgcgcggggcctcccccagtcgctcctggaacgccccgcccacccctcccccggggcggcgcccccgcccgcactggagctggtgaaacaggtagtgagttgatcggtcaataaacttaatccggttccttaacaagatgggccgggcagtaaaaatacaaagacctcgtgaaatggactgaggtctaggctggcgcttgcccgggaacataaattatggagccttggctcgcaggggtcaagggcggtgggaaaggttttggccactggactgccctggccaccccaggccctgccaggacagcccccatctccccagggggccgtattcctggttgggacctggagtgaccccccagggtgcagggaggtacacaaggtcggctctcccacagtcccaccccacccagcaggggtctgggggtgcagggcctttcccgaaggtgctggctgcaacctcccccactcctcctctgcagggctggactttgagccgcgtgggcctctgggtggttcattaacctgggctgagcctggcctccaggtccttgtgtgagcctaggaaccccttgttacccaccccccagctccccagccctcaggtctcacttggggctagatctggggctgtggcaccccttgttacagctgagcttgagtgggagcccaggggcttggggtctcctggaggacggggatctaaagtcacctcatctagggaggcatgcagccctcacctgagtgattcaggagtgaatgagccaggagtggagccacctttggtggggtaggggtcagcctggacctctaggctgccagctcaggctcgggtgccctcttcgaacctcagtttccttacctgtccaagagaaccgataatggcaggctgtttgaaggattaggccagataaccctggcaagccctctttagcctgcccagcctccagatcccttttttccggactttattgtgaaactccaggtggggagacagggaggctggacttttgggggccccctcctcttaggctattttatagctcctacctggcaatacctcctgtaccccagagagctgcagagaacttcatgtgcatccgaaaccagaatgtgttgtttcctgaccccaggccctcatctcaccccaaaacccaaataaacccctggggcagccagctccggaagcgagtctggatttgatccttgttctctggggtcaacccgaggggcttatgatggagcaaggctcccccatcctctcagccatgctccctcacatgcactgggcctccactgcagagacccagagcctggagaaaggttccccaggccagagtttggccgtccccagcaccctgcctaatggacatcagtcttggggccagagacccagggcagggagcgcctctcacccctaccctcactcctgcagccatttcagggcctggtgccctccctgagctcctgggcctgtggggtgggatttttactttgtgccacagtgggggaaactgaggtacaggaccagtgagtggcagagttgtggagactctgggacacagcagagggctgtcgttggcatgtggagcccaagttgaggtcggcactgtgtggggttggggcgccggcaggagcacgtgttgtgggatccatagaagggtgggaggtgggacgcgttgcctcctaccccgccttgggtacagcaggagttttgtctccaacgtgtttgggcaccagtgtctgtgtggtgtcagtggggcctcccttttgtggatcaagaaagaaagaacccttcctagggctgctggggggctatagctctccccatgcctggcagctgggtggggtatgggggctccacccaactgctgacttcccagtgggagtcagaccctgaacttatagcacccactcatgccccgtgtcacactgtccttcacctggtgctcgccacccagcccctgctggggtaccctggcctctgctggcacctagcaggcaggcagtggggggggcagtcagggctgcaccctccccaccacacacgggcagatggccactggtgtggctggcctggggctgctgtgtcccccgtccccccgtgctggaccaggctgaagcaaatacttgtgtggatggcttgacctgttgtcgccactcagaccaaaccggaaccaaccggctgttgcccttgggccagggcctgcagctgaggctgccataaccagcctgttctcggccttctggggggcctcgagcagctcccagctctgggtggtccccacaagacactggccaggaccggagggctggaggtcaggccaggagcccccctgactgcggggtccctacaggggcagtccttgagctgtgggtcccggtggggcgagggctccttcggatgcttcaggggatgagtgtgggcccttctggctggcagggtcaccctgggcactaggcgtgtgtggctggatcaggtgggttgggcagaagagggcctggccgggcagccagggactggtgtggccagagtgggcagctgggcccccgaatctaggccacgcgtctgcagaatgacaagtgatggcgcaacccgcccagctgggtctgaagaaggaggctgcctgggggaccacccacccccgtcccggccccaagcccgggacgcctgcctgcatgcattgtctggccctggcagggaagcctaggggcgattgtccccccagccctgcccatggtgtgtccttgggtcacaggctttggtggctctggggagctgggcagctactggggagggacccaggggccacctgcacatctgcccctgtgggtgggcccccaccccagcttctcagcccccagggaggggccagggctgctgacctgccctggctctcacagcttcctgcccccagcctggtcgtcctctgtgagggggccccagtccccctgcaggcagcaggactccaccccccggcccccttgagggcccgcctgggcctccccactccccggcctgtgagacccacttggccggacccagcgccgtgtttgtactttgctcttctcggtatgttttccgtcatgaccgccgtgtggagcttccataggagctgcaggatacagaaccttgcccaccccaaggagcccccacccccgccccggccccctcgcgctgctccggcctgtgctctgaccggtgaacccgcgcatcgccccccagaccgtccacacggccacgtgaccctgcacctccttccttctcgcctgttctgttccctggctgtccatctgaactgcttttcaggctcatatggggtgcgggggctactgaggacggacccctcctggggtgaatctgcaccacgagggggctggctggccaaccctggcaccccctctgagctccatttcagtcagaggccagcaaagggcagcctgtcccctttgcccgcagcacctgcccgtcgtggtgccgcctgtgagacaagcatggattttatgtttccaagcaattgaacaaattaaaagaacgaagagtcacattttgtgacactttgagatttgaattctccgtgtccatgagtgaagcatcatggggccactgctgtggggttggctgcaggttgtgtggggaaggcggctgtcacaccgaggcagaccggagtccttgggacagactggttggcaaagctgaagatagagacctttggcccttttgggacacagtttccagcccctggtctggtgggaccctggatctgggtcagagccttcctcactcagggccgccgaggcttccactgctgtgtctgtaaacggtgccgggtttgggggtgcctgcctcatggttgcccatcttccccacagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacaggtgagctctggggccacgccagctacagaaaggagccgagtgccgggctccctgagtccctgcgtgggtcaggagcggctgggggtctctctggtcattggtggagaggagggcaccccagaagtgctgcccaaatgggggaccctgctccatctgggaggggcacctgggggctcctggggcaggttgggcattggttgcggccatctctgccttgcagacgctccatcctcgggagatgacgaagacggggaggacgaggctgaggacacaggtgtggacacaggtaggagcagggtccagggttcaggccagccggggtggggcccgctgccaccgccaagccctgcccttcacaggcagctgagggactaaggccccggaacaacctccctggggtcaccccgaaggtctggtcccctcaggatacaggaggggctgggtcactgacatggctctagatgccccaccctggtggcagggctggggtgcaaggggacaccgtgttgctgatggggagactgaggcacagggccctgggggttccaggagcaggaggaggccagggctggcctgtggggctctggtgttggctataggtgaggtggaccccgcagacattagcgcagcagggcagggcactcaggtggctgccgtggggtggatggacccggggtgagggcgccggggcacctgccacaaccagtggcgggcagggtggctggcaggagggtggctggtgggtgggctgcggctgtgagagagcagtcggggacgatgcctggcgtcccggcctggaacggtggcaggtggactttgccaagttgtagggtggggaggtggggcttctggttttggagggagctctgaggggagtgcgtgcaggtgagggtcatcgtggcacagacatggggggcagttacgacttgcggactgatggtgtgtgcgctgggtccctgggccagtggggtaagcaggtgaggaagggaggctgagtccatgagagaaacagctgggggaactcaccctgggggtctccaggaggcctgggagggagctcagcaccgtggggtgcctctttccagcctgtgtccacactgctgcttgctgggcctcagtgcccctgatgggcgtgtgcctggagggggctggcagtgagctcactgaggggagggctgcttccctcctggggaatgccagcccatccttgcctggagtcccggcaggaaggcagcaccagccctgaggaaggagaaaaaccagttgggctgtgagaggggtggtgggagccctggacatcgagatgggaggaggcagggcctccagggtgccaccgtctctgggtgcccgccagacttggagctctgcagagggtggtgtagggtcttgatttccgtgggcccatgctgcccagctgcctccaaggctcctggctctgcaggcgactgggctcctctcctggtaaactgctcccaggtcctggcttgtccactagatgggcctgccccctgggtcttcagtctccccgttggtgggcctggccctggcacgcctctctgggcaggtgggctcccctggacaatgccctgtgccctgtgacttcacaggtccgggcagagcaccctggaggggaggggaggggacacacggcccagctctgagaaagccccggggaggggacaagatgtggaggctcctgggaacctcatcccgccctcttcctacacaggacgggaaactgaggctggggatgggcaggggcagctctgggaagggggttgttcagaggggcctctgctcccactcgggtcatggccttcacacgcacctcggcccgcaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaaggtgggcgcggcggggtggctctgggcctggcaggcgcggtggttgctgcctccgctcactcacccgcccgcgtcccggtgcagctgcggcatcagcagtggagcctggtcatggaaagcgtggtgccctcggaccgcggcaactacacctgcgtcgtggagaacaagtttggcagcatccggcagacgtacacgctggacgtgctgggtgagggccctggggcggcgcgggggtgggggcggcagtggcggtggtggtgagggagggggtggcccctgagcgtcatctgcccccacagagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgggccaccgtgtgcacgtgggtgccgccgctggggctcctgggctggccccaagggtgccccttggctgcgggttgcgtgaggatttgggtctaggggttggagcttcgggggcagaagctgtgggggtgcttgtggggccaagtctcagccaccccacacctcagggccataggcagctgcgttgggacccgtttccgtgtctgcagagggccagcctcagccactgaagtccctgacatggagctgcccacgggcttcttgggggtgggtgcggcttgggcagcagtggtgccccaggacaggagggcagtgtggccaagccctccaggccccctctgggcctcagaggcggtggctgagccccgacctggccgattggctctcgtcagctgtgtgcagtggggcccgagctcactgtctgcccgcctcctgaagcccttagctttgttcccatggctgccgggtgggggccactgaattgggacggttgcgacactcaaagcccaaagagaaacatctattcagagagaagacggtctcttgggggcggggagcaggcgcagggcgagggtggagtccagaccccgcccagagaggccgcctcgggccctgtccagggtgcaggttctgcaagagcccgggggagggcaggccagtgaccagaggttgtctgagggtctgggctgggttgttggggtggaggcagagacgtgcatcctgtgaaaccacagccaccgtgaagtgcctccacgcctcctccaggcagcctttggggctgacgcagcccagcctcgatctgtaccttgggggtctcccacatcctgcctcgtgcccggcggggctgcctcgggggcgtgcctgagccgggtctcttgtccccgcagtcctggatcagtgagagtgtggaggccgacgtgcgcctccgcctggccaatgtgtcggagcgggacgggggcgagtacctctgtcgagccaccaatttcataggcgtggccgagaagccttttggctgagcgttcacgggccccgagcaggtaacgactctgtcccatgccggccggcacaagagctccagctccaaggccctggccgcgcgccctgcacgccccgcacgcccagccctgctcgctcccgccccggctcgcgctccactcggggccgcctcggcaaggctggcagctccagcctccacggtgaccgcccgcttcgagccctgtggcctgcgccgacccttcccgcacgcctgcgacccccacaggaggtgcccggtgcccaccgggccggctccgtgccgtctgtgagcacccctttgcgcctctctccacccctgcccgctgcctgctcgcttccgcagcctgtgtgtccctgtgtccatcctccacctgcacccgcccggctctgcgctaacccgcatgctgcctgcccgcctgccgctcacctgggacagaggactcgccggtggaggggcctggcttcgggctcagtaccggtgtaccaggcggagggccctcagccgcgtggcggtgaccaagttggcgatggctgaggagttggtggtggcggcgttttccttgcagcggctggatcctgccgtgtggactctgtgcggtgcccgcagggcggtgctggcgctcgcctatcgctctgctctctctttgtagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccaggtaccggcttctgctgctgctgctgctccgcactgtctgggggacgctggctcgggacacgccaaagctgccaggacggacgggaatcctgtgacttacggccgtcccgcttcttgagccctcactcctggccctgtgcccagtgtggggacaaagttggcctggcccggtcctggtcccagaggggccccctcagccccctcgagcccacttcccatctgggtccccaaaggcctctcctgtggctctggtgtctcccgggcgcctggtggcggtgtgggactggctggctctgctgggctccttctctccagggtctggccctctagactcactggcgttactgactgcgagaccctccagacaaggcgcgtgctgaggttctgagcccccttccgctcccagtggtgcctgcggctctgggccaggggcatccatgggagccccgtgggggggggggccaggccaggcctcaacgcccatgtctttgcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtaacagaaagtagataccaggttctgagctgcctgcccgccaggcctcctggagccccacctcggcccacgctggtcctgggctgtgtgagccctctctgcagccaggcgggctcccctctcctcgtctctgctcaccatgtagagcctagggtactttggggcacgaaacattctaaaaatcttcattcaatgctggtggaagtcagaacgcccccccttctggcccagcactgacccccggctgtacctccacgccctgtcgcccacgcggcgccaacctgcccctgctgacccaagcaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggtcagtggtgctgagggccagcgttggctgtagggggcttggtggtgggggtgaaacagccaccagtcagaggcccggctgggtttaggggccgtcagggatgtggcggatgttgggtgtggctggggttctgtggacatgctcctgggacgggtgtatggcagggactgcccctctcaaggtgccctgtctggaggggcagcaagggcgggaggctgtgggtgacactcttcgtccttacgagcaggctgtagggggagcatggagggcttcctggaggtggtggctctgggcctcaagggctgggccaggctggggtggggaccgtggtgggctgagagtgggcgagtttgcacactcatggtccctctgcctccactgccaggctgaccctgggcaagccccttggggagggctgcttcggccaggtggtcatggcggaggccatcggcattgacaaggaccgggccgccaagcctgtcaccgtagccgtgaagatgctgaaaggtgaggagggggcggccaggggtgcagagcagggctgggggcgccgccgccgcctgacacaggccccccgctccgtgcacagacgatgccactgacaaggacctgtcggacctggtgtctgagatggagatgatgaagatgatcgggaaacacaaaaacatcatcaacctgctgggcgcctgcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtggagtaggctgggccctgccctgagatgctgggagcagcggggagaggtggagaggcttcagccctgcctcccaccccttccccagtgcatccacagggacctggctgcccgcaatgtgctggtgaccgaggacaacgtgatgaagatcgcagacttcgggctggcccgggacgtgcacaacctcgactactacaagaagacaaccaacgtgagcccggccctggggtgcgggggtgggggtcatgccagtaggacgcctggcgccaacaccgccttcccacaccctcccagggccggctgcccgtgaagtggatggcgcctgaggccttgtttgaccgagtctacactcaccagagtgacgtgtacgtgtcctgcagagctcaggcttcaggggtggaggcgggaactgggcagagccaggaccccagctgcagtccccaggcctgtgccctggagctcctgggtgtggtttctacccctccctgggggcagcagcgcagccctggcctattcccctggtgcccgcccaggtgtctgtcctgggagtctcaggacagcctgacctcaccttcccctgcagctggtcctttggggtcctgctctgggagatcttcacgctggggggctccccgtaccccggcatccctgtggaggagctcttcaagctgctgaaggagggccaccgcatggacaagcccgccaactgcacacacgacctgtgagtggcatccctggccctccactgggtcctcaggggtgggggtccctccggggctgggcgggggagggactggcagcccttcaggctgttcccgaataaggcgggaagcggcggggctcactcctgagcgccctgcccgcaggtacatgatcatgcgggagtgctggcatgccgcgccctcccagaggcccaccttcaagcagctggtggaggacctggaccgtgtccttaccgtgacgtccaccgacgtgagtgctggctctggcctggtgccacccgcctatgcccctccccctgccgtccccggccatcctgccccccagagtgctgaggtgtggggcgggccttctggggcacagcctgggcacagaggtggctgtgcgaagaggggctcggtggcacagcgctcaccccgcctcccgccagcaggagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctggccctgtgctttctgtctccagttctgggataggggagggaggggtcactttgccaggtggtcccagttgcgcgggatggatgctggcagcagcaccgaaagtcactggtgggctgggagccccaagagcaaggaatgtttatgggaggggcctggcggaagggagcagggtgcctgggggtgcactgccctggctgctcccagcttgtgggttcctgaggtggtggtggtggtggggagggtcctttctcactagctctgaggcagaccttctctcatcaccccactcctggcatccgccttcccagtcagctggggagctttctgggcatccctctatggagccaaaagcaagcaaagccctcatggggccctgggggctacacaggcggtcactctcctccagatcagctctctgccctcccaggccgggcaaccagtgcccccactgccttgggctccatcagggtcccctacagtgataaagcacctttgggcagatgaggtgctgagaacccagagatggaaccaggcccttgcccaagttcatagccctagcagggtgggaggacaacatggtgagagcaagtctgggaaggcttcctggaggaggtgtgccgtctctcctgactccccaccaccctctttgctgtcctcccttctgctatcctccctctcttgtcctcccgtttttcccatctctgctgtccccacctctgtcgtcctccttctgctctcctccccccatcccctctgctctccctacctctgctgtcccctctgccgtcctccctctgctctcctcccctctgctggctcaagagcagggtttcccaaccatgagctgcatgaactctagcttctaaaatgctctggctacaaactcacctttcaggtcagggggtactgctggcccgtttcctgggcaggcaagggtttaactcaaccccattcagggaagcacgtgtgggcgcaggcctggtggaagtggccttacaagggactctgcatccctaatgcccccacttgcccagaaaccctatgctgggccccagaggcaggcctggccatgggacgcctggtgacagtggcaggatggggaggcccacatgggcctgaaggctgaggcctgcagggcagtggggggaccaggccaacaggcaggcagtgccagcatccacaccaaggcaggcagagcatggggctcgaagcgcgggccgggagcgccccctagcgctggctgggcagtgtccctgctacaaacccaaggcccctctcctgtcagggctctggtggacctctggtgggcacagtgggatcctgaatgggtgctggggaccaaagggctgggccaccgggagaacagtggcccatgaaggtgctggtgggccagccccctcctcctcagcgtgcttccttagcgaccccagatggcagggcacagtccctgaagctgccccaccaggggctccctggctgcctccccgtcccataaggtgagcccatgagagaccccagctgtcagcacaactgaacctccgccatcagggtgccctctagtggttgggtgtgctctaggctggcagggtccccgcccttgctgtctgctgatggctgagggggacatgtctcatgggaggcccagcttccaggacacaactggtggctcctggggtcaccaagggcacctggtttgttcacagctctttgggctgctgtccccatgagggagcacctcccaccccagctgtgggtccatcatttcctctgattaattagggcctaggggtcaagggaggccccgagggaggactctcagtgtgaacaaaccagcagccagggccgcagagaagcctgtgaggtgcccacagggcctggtcccagtgtgggcagagcacctaagggatggcttctgtccactgagaagggtcgggagccaagacaccacactgctatcctggcgctggaaccatccacgcactcctgcagccaggccacgctgaggcaggtaggcacccagaggtccgggctgggggctgctctccatggccccaggccatcacacatccctcagggcgtctgggccctgcctgtgggctggactgcaggctgaaggccctgcctcatccaggactccctagggcagtactcggtgctctttcccctcagcggcctgaggagtctttcagaagagctggccctcctgggtgacacctcggcgagggtcccagcccctaaccccaggactcccaagaagtcactgaggtccccagagcagggagagcatgaccaggtggcagggccactggcctggagaacgtcccacactgttccatgagcagctcacgctgtcacaggacctggggacgtgggtctcctgaccctgcaggcccatcctgcagagcaggaagcgtgaagccaagggctgaacccatggagggcagcccagcactcaaacccccagggatggtgaggctccttctggaactggcctcacagccacacgcgccccaaggcccagcccctgcagccacgtggacagctctgccggcttccactcgctcctgtgtgcccaacggttcagaaatattattactctgcactgttacaggaacacagatttgatgttttaataaaaatacgatttctacaaaaggtgcttaacacggcccaggacgggctgtccggtggagtcagccgtaggacccctgaaggatttacaaagacagagccggctcaccagcacactcctgccagcaccgggacccactgcgaacaaagacagagccggctccccagcacgctcctgctagccctgggacccactgtgagccactgcggggtgtccttcatttaaaaaaagtctggactgtgacactgcagaaggagtctgaaagcccaattcctgaatccctgcgttagaactgagagttcaggccgggcgcggtggctcatgcctgtaatcccagcactttgggaggctgaggcgggtggatcacctgaggtcaggagttgaagaccagcctgaccaacatgatgaaaccccatctctaataaaaacttgcccgtaatcccagcactttgggaggccgaggtgagtagatcacgaagtcaggagatcgagaccatcctggctaacacggtaaaacactgtctctaataaaaatacaaaaaaattagccaggtgtggtggcgggtgcttgtagtcctggctactcgggaggctgaggcaggagaatggcgtgaacccaggaagcggagctggcagtgagccgagatcacgccattgcactccagcctgggagacagagcaagactctgtctcaaaaaaaaaaaaaaaaaattagctgggcatggtggcgcatgcctgtaatcccaattactcaggaggctgaggcagaagaatcgcttgaacccgggaggtggagcttgcagtgagccgagatcgcaccactgcactccagcctgggtgacagagcgagactctgtatcaaaaaaaaaaaaaaaaaaaaaaaaagtgagtgcttagctggagtgaggaggaaacactgaattcctaaatcaggaattcgtttcattttcaccaggcgcagatatcctagctcctgaaaaaggccaagaccgagggtctggccctgggcaggtgtaagaaaggactgttttaagaagcttattacacaaagctcatatttctggatccaccactgcttacatttgcacccagacaccacttttaggtgcaagaagaaaggtcaggacatagagaaaaatgcacacagaacgatgagggagaatgacgagggagaatgacgagggagcaagcctgcatcagagcacggctgatgtcacggaagccaccaaaggcacccaccagagccttccccacctgcaaagcccctgcagcacccggagggcaagctggcttttggaggccatgcggagtccagggcagaggggacagtgggatgggctgcctgttgcagtggctgttcacgtcaacagtgctcagccaaggcagtgaggacgaggatgagagccggggcagctgactgggcccgcgatgccgctcacaggagaggcgtctgcacacacctggcaactgcaagacttgttctcaagggtaagtacacttggacaaacgaacaccaggctacttacacagggtgagagaattcataaatattagttaaggatctaaaacaaacttctcaaataactgaaagctgaaagcctctggaagccaactgtccctgcacaaaggtttacaattgagaaatatctcctgttcctattttgtcaagtttctttaatggctgaacagaaagaagcttcaagtaatggagaaggcattgtctgagtgcagctgctttcctggacgcctgtgccgttcctgtcttccaaatcctatgcttggaggcccctggaggtacatttttgccaggaaccaacctgaccttaaaaagatgagtgtgacacagccggctgggcaggaggatggaggtgccacaggacaccacctgcccacgccctggccagcctggccatgctgccgagtgcggggaggccaccccacccagagggcacagggcaaaccctaagcacgggggtattgcccttgaagccccaggggatgccctgtgccggatcctcatgcctcattgactagcctgcttgctgaaggagcccaggggcctgagcctgcaacactgcaaggggtgagaagggcatgctgctgtgggcgcactggactcaaacctcacattagaagctacaaagaaccccaaatgcgcttcagagccccaccaacccccaagccaggctcatccctgacacagtgaatccactgcagcccccgtgggaaactctgtgccaattgactgcttaaagaactgggggaaatagaaagccgagaaagagctccgatacacaagggaaaccgcacgtgagaaccagcactcccagcagggagacgtcactctccagaggccacagagatggcagacacctctgtctccacaatgacccacatccaactgaaagtgtgcaggaagacaggtctattgacactgaaatctagaaatcaaggtccacaggcgaatggaggcatcttcagccctgaggaggccaggctgtgtctcctgacgcccctgagggtgggcacagcagccagctctgtgtgggcggagtccacgtggtcctcattctcttccctggggacagggcagcacagtcagatgctgagactgaggccacacacatgggggcgccttcctgccttggcccggcccagctgcctctggagccaggaggccgtggcagccacaccacagtgtggatccagacacgattctgtggaggggttccgggattccagacagactgaatctccatggaatgatgaaaattaaaatttacttgattatggaagtctctgatttattccagccaaaatattagatgagccactgagaatcaccacaaagcaatcgccctcacggcccttgccagggtgacggcacagcaggaggacaggtgcccaggccagtggttctagctcttcacctctgcgacctccttctctgccttctctttggccttctccttctcctccaccttctcctctttttccagtgttgctacaatctcagccacctggctggtggagatgtgaacatcttctttgtccaccagctcaatcacctacacacgtgggaaagggagaggctcaggtggctgcgccctacagcacagtgaggcagaggcggggccagcgccgtcagtcgccccagctggggtggcagcagcatgcacgcaatcactgcctgcgggccccagggtcctcagagcaccaattcccccaaggggtgccacagaccctggggaaggggctcagagtgggaggacaaaggagccagggggctgccttgacaggtggcagacagcacaatggggctgccagggtcaagttcctgctctggccaggaacctgggccatggcttcccagggcagagtggggtgacatgcagggaccttgtccccactctgccacccagactagcagggaagggaagggcagctgtgcagtagacacatgatccttgcttccaaactgaactgcaagaaaccagccaacacttctgttagacgtctggaaaatcactaacctgatgcatgcaccgggagccacgaggcagcttcccctcagagatgtcagtgattgggaaaattggtgtgcgcactcaggctagagccctgccttccctccagagactggatcctgggccagggtctccggggctaccctggaacctgagtggctgcacttgggagctcagcccagcagtcacctctcagccttggggcggtgcccaagctgccccgcggctcccctgtgtagttgcctctcagctttgggggcccccggcaggtgtgaagtgcccccaggctccctgtgcagtcgcccctcagcgtcgggggcccctgagaggtgtttgctgcacccccccggctccccagtgccaccagctgggggcggggtccagggacatgcgtagccactaggtgcgttttctctctcaacacttgagttgtaacttcaataatttctcacttctgatgtttcaaatgagagcagcggcttaaaggagcagtcgcagtgacagacccaaacccctgacaggagggggtagctgcccaggagggtgccggacatgcaatgaacagtccccctgccccaccccactccagagcaggtggcggatggcctgcgtggtccccagcgaggcccaccttgacgaggtcgtcgatgttgaccttgccatccttgttttcatccagtgctgcggccaggctggtgagcttgctttcgggaatgtgcttgacttgcttcatggcgttgatgagctcagcgacactgatgacgttctccctgtggaagcacagcctgcatgtggccacgggcaggcgtcctgccacacagggcctcactgcccacacctgtggctgcaagtggtcagcactgacacaggcggctccgcgtgagccaggcaacctccagcacggacccccaaggtatgatcccatcctgcatacaatgccaagagctcccagggccagcgtggacacaaacacagaaacaccaccaggtccagggtttccacgggcatgtctgcccctcagtggctgcccctctggggccatggctgctgggctgttgtcctcaggcctgtggccacttggcaatacgttcacgatcatgggggctgtggtgccctgggcagatgagggcctccaagagcagggacgagagcatgagcagggtgccacgtgcagcccacctacaacactgtgggtgtggaggtggagatttgaacctgcagggcaccagcagtcacccaacagctgtttcattcgcccagaagggactcacaaaacggcagctccctcagccactgctgcgcaggaatctgggacatgtcgggcacagagaaggccgactgcccgagctggtgtcattactgagcgtgggtggggtcaggaagagggagaggcaagagagagcctggtaattagaggaaacagaagccaacagaggtggaggttggagcgggaggagagggggctgtgggaagaggaagaggggccaggaagggacgaactgctctcggagaggcagagactgacatgccagagggttcctggctgggactgctggtcaaaggtggagaggcagccaggcagaggctacaatgtgccctttggagccagaagggcccagctcggatccagcaaagggaccagcctccctatgtgagtctccgatccctctcccgcgcccaccaccccactcaccccgtgggcatgccgttggccggggccagcttgccagcctgctggtccatctccagctgcgagatcaagccatcgatctgcccgatcatttgctgcaccctttttgtcaatctcttgctggctttagattcttccacgtatttttcttcaccagtctttgaaagttccttcttgatctcctgcaagtcctaataaaattattttggttgtaaaaagtttgtcttaaaagaaaaagggggtcaggtgtagtggctcacgcctgtaatcccagtactttgcaaggccaaggcgggcggatcacctgaggttaggagttcgagaccagcctggccaatgtggtgaaaccccgcctctactaaaaatacaaaaattagctgggcatgatggcaggcacctgtaatccagttacttgggaggctgaggcaggagaatcgcttgaacccaggaggcagaggctgcagtgagccaagaccatgccaacgcactccagcctgggcaacagagcgagactctgtctccaaaaaaaaaaaaaaaaaaaaaagaatctggttgggcacagtgactcatgcctgtaatcccagaactttgggaggccaaggca

SEQ ID NO: 1365 - DNA, 4093 bp, Homo sapiens
cgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagccctccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggaccccgtggggcagggagctgggcccgacatggctcggcctctgcctttgcaccacgggacatcacagggtgcgctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccaggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttgctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaaaaaaaaaaaaaaaaaaaaaaaaaaaaaa

SEQ ID NO: 1366 - DNA, 2421 bp, Homo sapiens
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtga

SEQ ID NO: 1367 - DNA, 22478 bp, Mus musculus
tgagaggtagcagcaaccttgttgttttaggactccgagcttgggaccctttggctcagctttggaacgtacaggtgtgtgcatgaaaggtccagagttcctgtgattcaaagcacttatatccagatgtggaggaggcccatcccagcagcagtgggaaagagtctgctggtcttagaggtgggaacttgacccagtgaacctaagagcttcctggatcctgttgagctttgaaccccacaattaggaggggcccctaatctgcagagagtactctgggagagttctcgggctagcaggttgacttacagactcagagagatctcagtgacacactgacaggggtagaggaagtggcttcgtcttgctccccacctccacaacacacacacacacacacacacacacacacacactttggtgtcttttacttctgttatcaaagctaccactctttgtcctggaatctcatggcttgtctgtgagcccccatggctactggatgccccttctttccaagaaagagcaccttgaaagggcagccagatccagccactgccaacccttgtatgcgtttttcttctctgctggacatcgctggctgcagaccaaacttgagcagagttgagcacaaacttttctcctgacaggactccgggatttgtttttaacagtcctcggctgctaaaaagaaagcataccaacccaactgccttctttgggacctgcagagagaactggtgttgatgccttctagcccctagccccacagtacccttcagtggatcaatctttggtctccccacttcccaggtgcagtgctctttcttttccttggactggggtctgagttagctccttttcaggggcaaacaaaccccttgccctggtccttccaggttgggcagcacccacagacaaggacagggtcagtccttgggctcagcttgatagaggtagggaagatagttctggaagctctaggaacattcagctaagagaactaggttgtgtgctgatgtggtcctgcaccccgagagaagtttctggtgccctgcaaaactcttctgtctcccaactctgctgctaattctgcgtagtttcctctacaatgtggagacactgaagctgaaatcctgtagaccatctagttcactcagcacttttctgggtaggtcaagacttggtggtagcttggagttttacttccccaaggatactgctactctcaaggaaactgtggtaatgtgccttagtaatctctctctctctctctctctcctcctccctccctctctctctcctctaccccaccatacctaagctagggctttgccagccaagcaggcatcaagacgtcaccacaaagatgtcctaagctgtcagataccaggttggcagccccatttttttccttgggcttacttgctctgcatatgacctttgcacggtcccttctgccactcaaaaggctcatcctccccacgggcctcatgtcctctgcccacttccctcctgcctcccatctcaccctgcactgcttccctccttccaagaataatgtcctcggcttactcccaagaggaagttaagaattatctctgatttcttatttccaagcttgtgggcattcccttcattaaacagtagaagtaggggatcaggaggcaaaatgactcttcagctctttttcccttcccagtatttactgcaaaggggaagacagtgactgtgagggaacatgttccacaaaggggggaaaaatcccttggcgcctagaatcgtccaaagtggccctaattacaattctggtccaaattcatttaccagaatacagaataaattctgtatttatttacagatttcacctcctacccgtcttcatatttagaaagatcaagaagggttttaatgtgtaaaagatggttttttttcccataatgcccccatcatcgcccacacacccgtttactctgctttgagtctataaagttatgctgccacggggggggggcggggggggaagagttaaaggagtgttctgacccactgttcaaagactgggtagggaactgaactcggtccctacacaccgccttcatctttccctgaccggtgtcaggtccgtcccccacctccaccccccactaggccgtcttcatgctaagtgtctaattaggacacctcaacccacccacccatcgacaaagcagctaaccaggttttgggaccacaccaggattagaaacttccaccttagaaggggcgatgaacaggggtcataggcagctcttacagtggctccgcccttcaccgtttgtctccggagtaactgagcgttgtaaggtaaaaccttgaaaaatcctgaaccttgcttctaaacttctctttctggtcctaagaacccgacagaacccgacatcctctataaaatcagcctttctagccctaagcctggttccagaatctcacggatgagtcgaagaaaaaattaatttgcctgtttggtgtgttgttccagataagccattaatatgcaaatcagggagttgggctcacggagtgaatggaagcagtgcgggtaggcacgcaggacagccccagatgtttgcataattacttctgccccaacttcgggagtgcaaaatgtcaagggaggagtctgtgagcgtaaattcagtgttatcccctggatctgagcgtgtggaggaaccaggcttcctttgcttagagaagaagcgaggcatcggggcgtctctgcctatggcctcttgtcaagtgggatcttgtgggtctttctcggaggaacgaatcactgggagcggtcgggaaaggtgcggacgaagccatcgctggccccacgagtcctggcagccccggaacttgcttctgggcatgttccaagcagtagagcgcagacctcgacgcccgccagtgcccccttcttttaggacaatgcttggggccgaccaagggaaaccctgttcccaggtgcaggcaaggacgctaactagagtttcggatgctgaggttttgtgaagccctctgggggatcattggatttttttttttttcctgtggactccggcactgctgtctcgggggttgccgccagcagtgtacacccggagttgctgctccatgcgtcctcgggaaaaccgaacctgtgcttctccgagtgacgtgttccagcacctcggggttttctaaaacaggaaaccggactagggctgtctgcgcaaaccacttctggaggcagtgacacttgcctggaattaactggatggaggtctccgacgtctgggaagcggggcgtgtgtgtgtgtgtgtgtgtgtgtgtgtgtgtgtgtgtgtgtgtctgtgtgtctgtgtgtggtggtggtggtggtggtggtggagcccagggggcgggggtaagagaagtcacttcaattccttccgcttgggggcgggataggaagagagaaaacctgaagctgcagaccgccgcatccatctctgaagcttctgggactacacacagctcgtgtggggactgagagtggatgggggtggtatttgaactgcaccgtccagcgtagttagcgaccgaagtgtcaccctggccgaactccagctttagtaggttctgagggctaggagtcttgactgagctcaagctctgacggcgcccgccacccctttccaggcttccaactctgtttttcccatgggatggtagtgctttcctaccttccgaaggggcacagtcaccgggcataaagggcgcgcactggtcgtgacgcataccaggactttgcaactttacatttggggtgcctagagcaataggctgcggccaaagggttgtgcagtcccggacagcctaagagaccttatcttatcgcaggcagagaaagcggcttcgaatacatccctgatcttagatgggactcctaagcactatatttctactaggccacccatttatcacgaactgttttgtcacctcgcctcactgccccaccccctcctcgcttcacggttctgccctggacttggccctgcagtgccgcgtctaagcgtccttcctagcacgtgggtggtggtgcagccatttcactctcgggctcacagcccagccgcctccccttctaggccaagagagcctccgacgtcccagggacggctttcgcaaccacaccagccagccaggctgctttcccgggaaaaggctggggaagaggggagagggtccgccccacgtcgcgcatgcgtgctggtttagccgctgtgcgcgtgctccagccaccaggcactgggcgcgcgctgggcaggcactcgaggagagaagtttctctgggctagccaccagcccgggcgaatctaaaccacgtccaagaggtgcgcagacagatttccaggaaaggtgggtgcccctcattagcatctagctgctacactggccttagaaaagcagtaacagccacagttgtaacataaacatttctcattgtatttccctgctctcttcagtgtaatcctgcctttacattgcttgtaacccgtcccgtggactctgttcagcaagcatgctaatattccttttaaaaccttagtgaaaaccatgatgtattggcgcaggcctttaatctcagcacttgggagacagaagcaggaggatctctatgagttcgaggacagcctagtacatacatacaatgaggactataaaaggagacctcatctcaagaaacaaaactttagtgagagtctataaacagtgacacacacctgtaatccctgtatttgggaagctgaggcaggaggaccacaattttgattacagactgaacagtagcagagccctgtctccagaggtaactaactgttagaagttcaaacagatcaaataacttgcccatacaggcatacagctagcgagtgggctagtctcggagcccacaatagttgtaactatgaagatttccacccacatccagcttccaactccaaatggcttcctagaacctttcaactttcttgctgagggctctgtgaaggggtttgtgctaccagcctaggacccaaccccaagtcctttcttaccctcaattcttccttataagaccaaaggaaaactgaaatgtacccagagtttttaagcccctgctgtgaaaggcctgggaaccctgacttgggagttctcaggcagagcctttgctgtctgctttgcttgtccccagttttacctacagctagggactggatagttgaccttgcctggctgtccagagcaactgttgtacagatgagcttaatccggtgctttcttccatggaagtgtgtgtgtgtgtgtgtgtgtgtgtgtgtgcgtgtgtgtgtgtgtgtgtgtgtgtgtgtgtgtgtgtgtgcactcgtgtgctaagaggagatatcaaatgctatgtggcttctggtgtgtggaggtcccggtctacaggtggtcagcccttcttgtctgttactgcccattctttgtccctaggaaggagtgagaggaggccgtagaacggaaaagctgggaatgttctgagaacaactagatactacagtcagcctgcacaggccagaccttcggacttctgtccagagtattgcgtcgccgctaccactttccagcggcaggcggcaatccactcagcggactttcagtcctgctgtggagtcgcgaggcaggagtggatggtgcaggcagatccagctccaagacggcaggagattagccacgggccacaggccctgcagaggccatggtacacatggccacgcctcagaaccgctcacttaacagctccaaatcagcccgcgtgcgtggccaagattgggcaggtccgacgcccgccaagccgcgcagttgaaacgtacccaaagaactagccgaggcctggcctcagcctcaagctggaggacgcgctggggcttgctggtctggccggatatccaggatccaagcacccagctaggcgcgctcatcttccctggactgcgccagtctcaggctcctcctctcccaagaggttgagtccatgggcagcggacctatccaggcctaagtggcctcagactcaggcatgccgtgaaagtcgggctcccggacagtctaggcaccttcggctgtctggggcagaaggagggcaggcaggcgccctgctctaagtaagagctcttgtcagataagagcagtggggagccccatgccctggtcacctaaaccggccaggaatcggcccggggtgtggggaaaggtggggggttgcggtagcaggtgtcccccaggcaagagggtgcctgcatttccgtaaacaaagaaaccgggtagtttgtgtgtgtgggggggggggcggggggtgtttaggagaatcgcagacaatctccttcataaaaatgtgatctaagagcatttgatttccactttcactccccccacccacccgtgtacccctccccgcccctacacactcactgtctccaaagacactcaaattgcagccatatgggctaaagtaataggaagcagttaccttatttactgcagaggcggcgcaagcaaacctggcagcgtggctgctagaagtgggatgaacaaacagcctggggtcttgttcttggaaacttttgttttgtttagttttgggaggtgcacaagggaacagccgattatataacttcaaagtgggggaggtcttgtgtggaagaggtgtggagaactgagctggtgggcaggggaggtttcaaaaataaaggtgggctgtgggcaagcctcctttcattggtttcaaggactgagagctgaacagcccaaatccgctccagacttggttggaatgagggcagttgctagtgccccctcctggaacacacaggcatcttcccattctgacctaaccggaccccagctctgggcctgtgggactgcaaacccattcctcagatgtccactcccctctcaatgtgtctaacctgtccaggggagagaccactgggaggtctgagttaacacctctgcaacactgttctagtttctgtaagcttggtagcactttgggtatgtgcaaaggtaacatcccacctcctcccagccgatctactgaaggactaaactcttctgagacaggaaccaagttctggacctctgaacgttctgaatctcctgaatccagcttcaactttgcaatgggctccacgggaactcccggcctttgaaactcagagagcccccaagcactgatcttgtcttgagctagctattagagaagaattaccatcaggcacaaaggcaggaaaatacagctagaaagcagagactaccactaactaacggttccttcagaagtactaagcgcggggactgcctctctttacgtaaaacttctccagttaattgggcaaagaagtaaaatttaggaactgaacagaagaagagaaaaggaaggaaggaaagaaggaagggaggaaggaaggaaggaaggaagggaggaaggaaggaagggaggaaagaaaggacgatggtggggcaggagtggaagagagctggattttttcggtgaaattgaaaccagcagttgatgaccctcgtccaaaaccccctggtccatgaagacacacaacttagggacagagttctcctcaaaacccaagctgaagggaaaccaccatcttttacttgatcggcaaacttcccagggataagaaagagaggaagagctgatgcccaccaccaccaccaccagcagccactccacgcagttccctgccactggcttcaaggtggccctgaagccggcttgcagagccgcggcccccgctaagctccgggtggcccgacagccaacgcccgcggcgggcaacagattccaagcgcgggcaggcggagcaactagagcgacccgggcggagggctagggtgggctttctctgggcggggaaaccagacacttataggcggctgagaccgactttatttttactgcccaaactgttggaaagtatttaagcttaaacagaaacagctgtatcgctggcaccggccgacgaaactatttgttaccaggaatgactttttatgattaaggacccagccgtcggcggtctcttgaaggcggcgggcgaaggtcgccggggcgatgtgggcatcctggatccgctgttcgttgagaaccgagaggactcctcacctggagcacaccttactatgtctaggagtgaagccaaaaactggaacctgcgactgttgatgcaagaggaggcctggggagtaccggcgcagcgggcccaactcggagctagccccaaggccagcactggcgcgtgcagtgtgtagcgccttggacccgaggccagctttgcgctctgggcttcctgcctttcgaaacagactccttagctcgctgttttccgggcttcgtcgttttttctttttctctctccccttttcccagcctcttcttggccaagggaaacttttttcagccaagttgatatcgcgatttaaataaattgtgtgttccgaggtcgggctctgtgatctggagcttgggtagtaaaagggcaatgtggggatagctgctgttgaacccccccccccccgcgcctcaacaggggttaccacgaggggaggaaagagagcctaggagcaaaaggtcattgagtgtactcaggtgtgtaaaagggactgaggcatctctgcgcgaccctcgtcccctacctgggacttgccatcttcgcgtcgggggtgggggtgggggtgtctcttccaggccgcactagataccgccacacccctcaaagtccatactgatgtttgtcgggaatcccccgcttacgcttacgtcgtctagaagagcccgagacagaaagtgcactagctctgcacccaggtctggagcagagccgcggcgcctccagagctagccaggctctaggctctgcctcgatggtcataggctccttaaacccacccaggccgggacagatgtggtcagggttgacttctctcaggactgaggagtggattggacggaaactgcaggctgggtcaggaatagaggctggggcagggcagctgagacttggggacaatgagggtgggaagaggaggctcgcgacccctcctgcagggtctcgcttcaggatggattcaggcggtaaacactggcttgtgccagtctgctttgggcttctgagcccggagaagcgcccacgccagctcgcaggacccggagggtggacgcgggcagcgctatgcgactggagaccaagagcaggctcattgatttgttagctggatgggactggtgaagaagggaggagggggcgttgccatggagacccagggtgcgcggccgcaagggaggggtcagggaattagtaggttcggcgcaagcgacgtaggtccgggggttcgggcgcggctcgatgcgccccagcacctgtgcattgtgcatcaacggcggctggcgaccaggatggcgccagctagggcatgggcaggtggggagggcctgggtctgcagaggggcagcgcctggctggcacctacgcagggagccctaatagctcggcggggcaagccacgcacccggggaaacgctgggcaatcaggcaggggggccaggggcgggagcctagggcagcggcccccctgtccagccgtgcagactgacagcagccgggcccgccccgcttggcgtcacttccgctgacggctcgctccccctccctctgggtctctggagtggacagagaccccgcctcctggctattggaacgcgggtcacgtagcaacgcaggggagacggggagaggggcgtggccgggcgctagtccaatcagcgcccgcagaacgggcccaggacgcttggctttagcaacgtcgttagcaacacgtggggcgggaggaagcgctgggagggggtggagggagggagagtgcgcgggggagggaggagaactgacgtcagcgggagagtattatgggctgtcgagggctggctgctgcttttctgctcctggaagcggctgaggggggaagcggcgagtcaacatggagctctcggcggtgggggagcgggtgttcgcggccgaagccctcctgaagcggcgcattcgcaaagtaggtgaaggggaaggcgggcggcgacgcgaactctccctcaccagggcccaggctccctccccttgctgcagcccagcctcccttcccccaggtcccagcagcggccgcggccgtggcggcggcggcggcggctcagccccagcgctctccttagacttgcagccctgcacagattgcatggatggggggtggggtgggggatgaatgccggtgcatgcactttgtgcagcgtttctgcaggggtgctgcagtggactggttcctttggcggtagtgtttggagcattcatttggtgcatgcattttcgtgtgtatttcttgtgtcctcgtcatgcatttctccccacgcacacacatacacaagcattttcccttttgcatctgcagggacgcatggaatatctcgtgaaatggaagggctggtcgcagaagtaagtaggttatatgcaatcgctaccccacactgatatcgaggagggttctttcttcctcttttccccttcacattgaaatacaacacaaggcagccggaaaagttgcacacacatacacgccctccactctgtcctctctctcctgctccagggactgatgctccattcttcctggtttcctttaggtacagcacgtgggagcccgaagaaaatattctggatgctcgcctccttgcagcctttgaggaaaggtacagacccttagcctagccactcactagaacccatacacgctgacttcggtgcagccaggacacacccccttctctctcttttctttctttagggaacgggagatggagctctatggccccaaaaagcgaggacccaagcctaaaaccttccttctcaaggtatgttgcgatctccagaggtggagtgtgccgttcagggaggatctgcagggcttgtaaatcaatgggtgcccttgccttgtgtgtatttgtaatctggacttctgtcagaggccccatcacggagttctagaggcaggacttagctgcaccagaaggccttcattcccaccccccctccagccatcccaagtagacctctgttacacaaggagtctgttggttgcaaatggcttcttccagacaaaccctcattcccctcccccagactattactaagagcccacctccccactcaattagaatttcccaggcatccagggaaagttgggcagtcaaggctagaggtcgtgggggggtggggtgggcgggggcggggcttttttctcctcacaacaacttccttctgcaggcccaggccaaggcaaaggccaaaacctatgaattcagaagtgactctaccagaggcatccggatcccttacccaggccgctcaccccaggatttggcgtctacttccagggcccgagagggcctgcggaacacggggctacccccaccagggagcagcaccagtacctgcagggcagacccacctcgggaccgggaccgagagagggacaggggtaccagccgtgtagacgacaagcccagctcaccgggggacagctccaagaaacgaggaccgaaacccaggaaggagcccctggacccttcacagagacctttgggagagcccagtgccggccttggagagtacctgaaaggcaggaagctggatgagacctcttctgggacaggaaagttcccagctggccacagtgtgatccagcttgctcgaaggcaggactcagacctggtgcaatatggtgtgaccagtcctagctcagcagaggcctcgagcaagttggctgtggacacctttccagccagggtaataaagcacagggctgctttcctggaggccaaaggccaaggtgccctggaccctggtggtgccagggttcgacatagttcaggcaccccagcctcagtgggaagcctgtatcgggacatgggggcgcaagggggaaggccctccctcatcgccaggatcccagtggccaggatcctgggggacccagaggaagagtcctggagcccctctctgactaacctggagaaagtggtcgttacagatgtgacctcaaactttttgaccgtcaccattaaggagagcaacacggaccaaggattctttaaggaaaaaagatgaattgccggggtgggagcccaggaccagtgcaggggagagtgagctcaaatggcttagtgctttttatttctgggtgactgtggcctctggctggtcctgtccttcttcacacccctcttccctttcattcctccgtcctcagttctggctggaaaattatctctagagttctattttctattagatgtaaatatgttatttaagagaaaaatatctaaatatatatatttcaactcttgaagttcttttatttaaacgaggagagagagagagagaaagagagagagactgtggtttggtaggggagatagactgagctggcacaggaggggcccctgtccctgcagggcaccagcaaagttgggggcctgggccctgggattttggagggtgtgtggagggactcagccggcccacctcctccctccaccgccggattcccaaccctcctggcaccgcagaagatttttgctctcctccccattggccagctaggccaacaaaaggttggcttcccaatcagaaaaaggggggtggggtcagaccagttttcttttttctattttctttctgtctttttttttttttcttaagatgaggagggttactagggggggaaagtaacaactcgaataactttctcacgtgtgttgttaaaggtagaaaaaggtcgcgagtgagtgggccgcagttctccccgaccacagcaggagggtgcactttatggaggtgtgagtgccgtacacgcggactgtgtgtgcgtgtcctgtggacaaaaatctccccgttacctcgattccttcccttacttttgcaaagagaaaagaaatccagcgaatttgtttacattcccgaaatgccaggataaattgggaggattgcgtgtcagtgcccagagcgccagacagttgttttacaagaaaaatattcgggtggactttttctttttgcgtcctctagattcgccagaagacagggcggccccacctcccaggaagactcggacaagcctggctcgacggggggagggtgggtcctgcttttagaggagcgagcggccgccaagccaccctgcggggcgggcagcgggctgcgcaccaggccggtcgggctgggcacgggggtcgcagcccgagttggaacttggtcaggtggagctcatggccgaaggggctcggcagggtttccatccaagaatgcgcagtagaactttagtgttttccttcttccccctttcttaaaagcaaaagctgtaatttatagtccttttcgattctgggagtgctctccacgtgaactcgacgttcagactccgccgcagggggcgggggagcgcgaggtggagcgggagcggccggggaccagtgtgccccgagaccatctgcgtccctggtcccggcccactccggaccgcgccgcgcgcagctcggactcaaaagcacaaatctgtccccgagcctacagtcgccgcttccagcagggatcctgcggcctctccaccctccccgcccttaaagggccagcagacgctctaacttccagggcttttggagggaggggctctaagctctgctcgcgggacaaagcacagacttcaggggctctgggctgggctgaaggagcttggtgatggggagggactgagagggacgtcagcctcgtcatctgcactcccggcttcccatctccagactctcggtctctctttcctccagacaattttttttttttttttgcctttaaagagagggagaaagggaaaacggtgtattctacgtgtttttattatttttttattttttggagaatcaaactgcgcctaaagagaagcccctagaatggggatttttatctgctcatatttgtaaaactagtattttcgactttgtataaagaagctctgttgcctgtgtctgtctagatgtcgaccctattttcagatgaacctgttttgaagggtgcatctgtgaccgagtggatgtaactccggaacaggagctccctatctggctaccgactccctttctcttctctccttcctcgtttgtatcttccttccctccaaccttcctgattctgccctcactgccctcgtcgtcctgccgtctgtccatggccgtcgtgtgtgtctccttagctcgctcttgagaggctgacttgggggtgggggtgggggtgggcaggggtcgggggccacgcggctcagagtctgtggagcctgggtgttgggtttatgagttctcagctatgtataaatctccaactgatctctgcctcggctcaagagtgaacccttggtacctatcttgggttgtgaatgtgtctgtatccagtatcactttttacgtgtttaaatatatgctttgtaaatagacacgtgtcttggcttcattattttatttatttcccagaacagggaagaggtagcctggaaaggcaggatacttgcctttctgacttgatgtccctcactccactctcatactctcaaaaaggtctggattcccgacaaaggccggttcccaactaggacacccctcagtgagagtgaggggagctgggttggggagggagcgagtcgtgacctttctgagcttttccgcgagctgtcttcattgccggcttaacttctttgggatgccggcagaattggagactcctgagatgaagtgtgcgcgacctctgggctctactcactctgagggaggattccccccagcgctaaacacccttccataccaaacttccatagctcctgacaaccaggagccatgctgactccctcactgcccttgacccgagcctgctcctcaatgctgtcacaggacttgtgccccagacccctccaacctcaccagtgctccccgaaatgcagagtctccgtctattgattgaggaattgaattcgcggctattgctaggcaactgcctgcttggagccggcgcagagcgcgctgatgtgattagtgagctgggagccgccgaccctcagccccgcgctcccaccaccagtccctacggcttcttggaccctagtgttctttcgggtagataccacaaggttggatgaggggctgccgatggagaacatagcatggggtgatgatggtgggtgttctcagtcttctaggctgcagacttctcagcagagaggcggggtcctgaggctgcaaaggcgacccatactccggattcccaaagaggaccttaccagtactgaacctagttccacctccatattcctgggtagacgtcgctcccttgcagaaaaagctgtaatccgtgcgaacacgcagagcccaaggggagggaggggggaatacggaccaggtcacatcttttgcccttggccccaccttcctcctccagctcagtgacctgcgtgggaggctgtgggtcaacgtctgtggtccggggttgccagagcaggtcattgagtgtccagttgagcggtcagcttgtctcagtcgccaagaggtccaaggtctgtttcttaggccacctcaaggtgctctgggtcgagcaagctctttactgggccctctggagggcgatggccatcagggagacaagaaggcactgtgactgtgcctggtgacttcagcagtagcccctccctcaaatataggttggaatcccgcaccgacccttagggatttctccgcttctttggtcaccaccaacttcaacctgggttcagggcttcctcagagaattttctgggtgtattctccttaagagcaaagcacgggtgtgaggacccctggctccagacagccttcgttcagacagatctccctccgtccgttctctttggcaggacgtgttagagccgctgtcggagctgagccttgcccaacacaaacacggattgaatggaatacttatggctctacttagagccggttttttttttttttttttttttttttccctgactcttggatgctcacagcgcgcggctctgacgaaggcccggtgctgtgcccaggacgacagtggtatgcaagcctgctccactctctgcggatgcatccacggcttttttcttttcaccaaaaagtccttcaagccaggggcggctcggattcaacgggatcccaaggtaggagcgaataggatcacgaacgggtgccatcaaggatggaaatttagctgacagcagggagaagcagtaggcagaggcctggactttctttctgcggccgcagacggttcggcgggtggttactctgagcagcaggggtgtagacagtgcaactgagtttaccacagcacgggacagcgggggattccgccctcctccccatcatcatttaaagtccagcgacacgaacttcgtggggagcgcgcgccctctacaggcaacggcgtcagcccctgtcccaagtacacccctccccctctctggttcacgtctgatagacgtgaagaaaagccttctttcctcttaaccggcttctcccagcatcacctttgtgcctttgtgaatcggcctcgacccacgcaggctggacaggagggaggtggtgttcactggcctagaacccagctgcaccaatcgtaccaggtgccctccacttggtgtcagtggtgcctactctaggatggaggtggattgattaggtggtcagactaggaacacagaaattaataaacatcaatgtaggccagccccgccccctcaactttggtctggagaccttgtccctgtagacatagattttcagagagcctagctggccaatggggccagcacttgttcctgtcctgacctgaggtctatgatctaactgcccctatccaccttttcaaaaagaaaagaaacaaaaggcactgaagacaacaaaagggaaatcaaatcgtcagctgcctgctttgcaagaaacaaggaatgggtttccctggctggagagatggctcagatggctcagctattaagacctgcgttcgatccacaacatccacctggaagctcaaaacccgtaactccagtcccagaggattcaccatcctcacagacattcatgcagggaaaacaccaatgcacaaaaataaaaagacatacgttttttttaaagtcgtatctctgcaacaaggtgtttctatctgtagtgttgacgcctccccacagcctgacatccaggcctgagtcccaagcagcctttctgccaggagtggcccatcttcccctacacttcagaggaactctattctcctgggaggccaaaggaaatttatgaataaaattaatgttgaagagagtaacacaagtcttgggctggggaaggttgtgtaacagcctgtcttcccttcatcagttgtggggggagagtcaaggtggcccctgaccagatgtttcctgcccttctcagagcttcccaacatggtactgtggaggtgagagtgttggttttacttttatgtactctgtaaggggggaaaagtgagttactgtgtatctcagaagctcggtggtggctggaggcctgtaaacatcccacttgcccagtaattagccatcattgtcccataatgaaggttactaccagcatctaacaactgcttctcactgctgtcagacaaatataaacatccttgatgggagtgtgtgtgtgtatatgtatgtatatgtgtatatatgtgtgtgtgtgtatatatatacatctacatgtacatatacatatatatgtgtgtgtatatacacacacatgtatacacacatatatgtatatgtcaaatatatatcttgatggatatatatatttgatggatattcttgatgtgtatatatatgtatcagatatatatgagtatatatctgactatgaacatgaatatattatattatatatgtatatatatatatataatatatatctttcccattaagccagtttttctcaaacttggcttcttggatattctgggatggtggacttttgtatggtggactgccttgtgtggttctgtggcactcttggtctctgctacatgctggtagtaaccttcatcatgagacaaccttctccagacactctttatgcctcccactcatcagcactctctctctctctctctctctctctcagctacttccaatgttcccccccaccttgtttggtgctgcagctaggcccatgtccacagagtgctgtgccccatgacaggggaagtgaaaactattttgtttatatgtattagttacaatgcacaccaagctaacaagtttaaaaatacatttgatactgagagtagcaaaaagaaaagtgtcccccctgcagatttactgcctttcccctgcaacacaaagtaacaccagtctaaaggtcctgcactctaggctagtgtcactagaaacccctgaactgtgagattcatgtgtgtaaacacagctgtcgctgtcttattctaaacctttccccagtccaacatgggcttcctgggcagtcattcccctgagagctggactgttctgttccaacagattctaagcttttctggggtggtaacatgcccactcttgctaaccctctatgagggcaaaagtttccagtttaaagaggtatacatcaccgggtagtggtggcacatgcctttaatacctgcacttgggaggcagaggcaggtggatttctgagttcgaggccacccttggtctacagagtgaaatccaggacagccagggctgcagagagaaaccagtctcaaagaagggggtggggcatacatcagtgactggcttaaaaacagataaaccaagccaaatgactgatgctggctcaaagttgaacatttccttctggataaaaccttggggtcagagctctctaatcaaggtcaggatttgtagtatacccaaacaaggggcactctttttggcaccaaagattttttttttttaaagtcaatgcttctgaggaaaagtacataatggtcgcttttcctattagttgttgaagcagacaaaagggggcttgtaattgtaatactaggaaagctgaggcaggacggccagaagttcaaggctagaagacacccttatcctgaaatccacttggcatgaaaatgtaacacctaacacctggaacccttatgaaacgaacctagtcaggtgcctaactacccatgtgtgtgtgtttgtgtgctcgcatatgcgcatgcacacccacctacccacccaagaaaatggggaagaggggctggtgagatggctcagtgggtaagagcacccgactgctcttccgaaggttcggagttcaaatcccagcaaccacatggtggctcacaactatccgtaacgagatctgactccctcttctggagtgtctgaagacagctacagtgtacttacatataataaataaataaatctttaaaaaaaaaaaggggaagagaacagcaaacataaaaaccaactactttatttatcggtaaacacgagaacttgactcagagcgaatggcgctgctccagtggggctcgcgctggcgcactacacacatgtgctttgtgacatagaccactggggtcacagcaccaggaaaaacacacaagaaggcaaagtggctgagaggaaaggatttgtagatttcaactttgggactgacgtaaccagtaaaataaaaggcaccaaattgggatttggagactggcagcaggggacaaaggccagtcaacccagatccccaaacagggtcacttctccaacagctcatgggaccccaaagagacggggaggtgtttgtaaaggcagtgtctggtacaaaggttgcagaccctggctgagggcagggagggacattgataatgcagtaggcaaccctttcccctttgttacccacttcctggccctgaattcttcccagtacgtagctcctgctgccagtaacatggtcccctggcacatcacaggcatctctcaggagctgtggatatgggtctgccccaaaaggcacagcattgaggttggtttggttacacaaagaccatcttatttggtgtgcagggtgagctactggggtgggggtggggtgcactttgaaagtgtggcaggtcccagacacctcagcccactgtctgactggttttagaaggggaaacatttcccttcaaggcaactggagtgaagagcccacacctgctggctgatcagtcaatggcagaagcagaaccagggtttcatagcacccctactttttggcatcacagactcactgaccagattgtcacggcccaccgtgatatcccaggacagaaaatcctgtcatcggccagcaatctgacaaggtagtttcaagacagttacccgggatgggggacaggggagaaggcatttagaaaggggctcagcactagacttatctcctaggatgggaaagaaattaggggccccctgccaggtgggctcctaaacgaccccaccacacaaatggcatagggctattgcttctcagcgagggaggaaacacaagctcccaaatgtgggagaggattgtcagggaatatgggacccaagagtggcccactcaccaggcggagctctgcaccaagactgactatagaaaatgcttccacagtagtttagagatgtctagacaggcagcagggtgacaggcccccacaaaacacctgcattcccacactggtgccaccatggtgacttatggggtcctagtaataaaagtccaacatgaaggaagattgcttgcccaggactccaagtgcctacatcagcttgctctgggtgtctagcctgctccttccccaagcccaggagtgtcagacctcagaactagggtgcaatttagtgggccaaagcaggggtatgggtccagacccagagaggaacagggtcacttctcactggggcttgagcctgcttgaaggaggcaataaggacatggctctctctattcccaagtccagaagcacccaggtacaccttagtgccaggactccaaaccctgactgggctttgggactacaattgcaactagaggggacaccacaccacggatagagactgaagatttccgcagggtccctgagcccaaccacacaactaattagccttttaaaactgaagttatagccttacttgcaaagcatagagtgtctccctcaccagaaagaccctgccgtggctggatgtgggagaaggccctaccagccccacccctctcctcaacggcctggggagggagctgtatcagtgcccccccctccccaatccacctcacagtagttggccagggaggggagggtctcactaggttaaggagggatgtgtagaaaggatgctatgtccaagcaggtagcttttaagtcagtggccacccggctttcctgagatgacaggacagactgaagtggaggcccagagaggtagaatcagcaggaagccatttcccagccctgagtctcaggacagggcagagttggcccccaggtcaggcatcaaagcaaaaccagagactggaaggcaggtctggctcgggcaatggtctcaataatgcctcaagttgaagaagcccacgctggtgggcgactccttcacggtgacagtgatgaggttggctgtgacatccgtgacaaagacgtgttcgatgagactgcgggtaggtttccagtcctggctggtctggatagctacagataggttctgcgcagcactgggaagcgaggtcgagtcagggtccgagtcagagctactattctcctctcccgtgctcagctcagacagcgcaggtggctttcggccttctcccggggctgtgtggccctcctgcccgccggaggcagcgacgcttttaacggtgtcccgcttgacggaaggggcaggcagagccgttgccttgcaagtcagcttttcccctttgttgttgtctgtgggagcgttggtcatgtttgctcctgtggggccgctcccaggacctttccctgtggctgggttggtagcaggaatagccttggctggggcatggcgagcaagcaggcccacaccaggcacaccgttcttgacgctttgcaagtcaaggacctgaaggctcaactcctgagtgggtgccagctgagcacctgggctccccgaatggttccctctctgctgctctgcagctccgccaccgggggccttcgggaccttgcctcctgcggggctcccccctagctcaccccccttctgcgtcctcactttcaggtctagcccgagaccgcacttgttggtggcctgggccttg

SEQ ID NO: 1368 - DNA, 1413 bp, Mus musculus
tcgagggctggctgctgcttttctgctcctggaagcggctgaggggggaagcggcgagtcaacatggagctctcggcggtgggggagcgggtgttcgcggccgaagccctcctgaagcggcgcattcgcaaaggacgcatggaatatctcgtgaaatggaagggctggtcgcagaagtacagcacgtgggagcccgaagaaaatattctggatgctcgcctccttgcagcctttgaggaaagggaacgggagatggagctctatggccccaaaaagcgaggacccaagcctaaaaccttccttctcaaggcccaggccaaggcaaaggccaaaacctatgaattcagaagtgactctaccagaggcatccggatcccttacccaggccgctcaccccaggatttggcgtctacttccagggcccgagagggcctgcggaacacggggctacccccaccagggagcagcaccagtacctgcagggcagacccacctcgggaccgggaccgagagagggacaggggtaccagccgtgtagacgacaagcccagctcaccgggggacagctccaagaaacgaggaccgaaacccaggaaggagcccctggacccttcacagagacctttgggagagcccagtgccggccttggagagtacctgaaaggcaggaagctggatgagacctcttctgggacaggaaagttcccagctggccacagtgtgatccagcttgctcgaaggcaggactcagacctggtgcaatatggtgtgaccagtcctagctcagcagaggcctcgagcaagttggctgtggacacctttccagccagggtaataaagcacagggctgctttcctggaggccaaaggccaaggtgccctggaccctggtggtgccagggttcgacatagttcaggcaccccagcctcagtgggaagcctgtatcgggacatgggggcgcaagggggaaggccctccctcatcgccaggatcccagtggccaggatcctgggggacccagaggaagagtcctggagcccctctctgactaacctggagaaagtggtcgttacagatgtgacctcaaactttttgaccgtcaccattaaggagagcaacacggaccaaggattctttaaggaaaaaagatgaattgccggggtgggagcccaggaccagtgcaggggagagtgagctcaaatggcttagtgctttttatttctgggtgactgtggcctctggctggtcctgtccttcttcacacccctcttccctttcattcctccgtcctcagttctggctggaaaattatctctagagttctattttctattagatgtaaatatgttatttaagagaaaaatatctaaatatatatatttcaactcttgaaaaaaaaaaaaaaaaaaaaaa

SEQ ID NO: 1369 - DNA, 1089 bp, Mus musculus
atggagctctcggcggtgggggagcgggtgttcgcggccgaagccctcctgaagcggcgcattcgcaaaggacgcatggaatatctcgtgaaatggaagggctggtcgcagaagtacagcacgtgggagcccgaagaaaatattctggatgctcgcctccttgcagcctttgaggaaagggaacgggagatggagctctatggccccaaaaagcgaggacccaagcctaaaaccttccttctcaaggcccaggccaaggcaaaggccaaaacctatgaattcagaagtgactctaccagaggcatccggatcccttacccaggccgctcaccccaggatttggcgtctacttccagggcccgagagggcctgcggaacacggggctacccccaccagggagcagcaccagtacctgcagggcagacccacctcgggaccgggaccgagagagggacaggggtaccagccgtgtagacgacaagcccagctcaccgggggacagctccaagaaacgaggaccgaaacccaggaaggagcccctggacccttcacagagacctttgggagagcccagtgccggccttggagagtacctgaaaggcaggaagctggatgagacctcttctgggacaggaaagttcccagctggccacagtgtgatccagcttgctcgaaggcaggactcagacctggtgcaatatggtgtgaccagtcctagctcagcagaggcctcgagcaagttggctgtggacacctttccagccagggtaataaagcacagggctgctttcctggaggccaaaggccaaggtgccctggaccctggtggtgccagggttcgacatagttcaggcaccccagcctcagtgggaagcctgtatcgggacatgggggcgcaagggggaaggccctccctcatcgccaggatcccagtggccaggatcctgggggacccagaggaagagtcctggagcccctctctgactaacctggagaaagtggtcgttacagatgtgacctcaaactttttgaccgtcaccattaaggagagcaacacggaccaaggattctttaaggaaaaaagatga

SEQ ID NO: 1370 - DNA, 22715 bp, Homo sapiens
cgggcagtcagtgttgagagaggcagctggtgaggcacctgggttagactgcaggtgccgaaggacccaacaggagctgtgggagaaagtgactcagtcttgccctgtcttgccgtggcaaatcatctcccccaacatccactcctgtctttctccccttttctttccctacactcgatgccctcactctgggaacgacatctctgtgatctctgccagcgatggccccacctgctcctgaagaccctcgactcccccatgcccacctgtgcccaccttcttcatttcggctggacaccactgcacaccagacttgtgcaaagtgagggtcagacttggggatatgctcttagatgttcccgactcctgagagggacctgtacccaccccgctgtccctcactggggagctgtaagaccactccaaggctgaagcccagtgtcctgcacccctatccagtggacacccttcccattgctcaggcccttccaggctgaatggcgcccccctcaagaggagaggtccaacccctcccctcagcttgggacagagtgggggtggggtagagaggacagttccccaagggactgcccacccccatcccagagctcgtataatgcctggagcaggctggagaatgaggtccgccagagatcctgtcttgcagacctaagaaaaggtttcagggaacagaagaattggtaacccctgcaggcctccctgctggccacttcctcttctattcatcccaggtcctccctactctccaaaagggagaaactgagggagaaacctgggactgaatggaaggcctggaatcccaactccccctgaggtttttggctgggaaaatacctggggacagctggagtcttcgggtatcctggggcgcccctcccccagagcgcccccttcccctagggaaactttgatctctctctcgctctgtctctctctctctctctctctctctctctctctctctctctcacacacacacacacacacacaggcacacacacacacgaacacacacacattggaaaggagatgatacctctaaagtcaggctgcaccgtcggggtggtgtaaaaaagttagagactgcctcaaaagggcagtgggaatgaccgcaaagggaagaggaaggagataaaatgaggcctatccctcccaacccagcagcccggctctccagagacactcccttttccaggccctacagtcccttggcaccctcctcccttcccaccaatacagcatctgaaggtgtcactgagatcttccacccatttttcctccccctacccatctcacccacaggttgctctactcacagcaattccttcctaggcttcctcctgtaaccctgaactatttaaaagctcattttaaaaaagaacttaagactgataccaaacttcttagttgcaagcctgaactgtgggcaccttctcattaaacgtaaaacctgcatcttttccaagagagaggacgttcttgtccgtagaggggtgacgggaggtgctgcagagcccttttgagctcctctcactctctgctctgtgactgcaaaagtgagaatggtgccctcggaggaaacacgttttactgcaaaaattgtctggagcccggaattgccctgaaagtggccctgcaattacaattctggtccaaattcatttaccatatttatttgtggattttctcctcccactcctctgcgtattaaaaaagatcaagaagattttttaatgtataaaagatgtttcctccacttaaggcaccccaccgccacccacgcacccctttattctgctttgaattcaacgacttctgctgtctcggtggctgaggcgaccatcccagagcaaggaagtgctctgtcttgatctgttcaaagggtgcggaactgagtccctggaaggtccggacccagaccccggagctggtttgcaggacacccctttaatcctcagtaggctgccaatctaccctctccacaccccaacacattgaacatctgcccccaataccccagccacagtccatgtctctgcctcgagggccaccgaacctcccaggatggatggggcgatggtgggggtatctgctgggacttccacggtggcttaccccttcatccgtttggccaaaaagtaagctctgaggttgaaactagaaaaatacagaaactcagcgtgaacatcacatttccactgctttaaactttctctctccttggtcctggtcaggaaccctacaccctctgctaaaccggcttttcttgccataagcctcctctgtttttaggatctcaaggactagctgaagaaaattaattttgcctctgattgctgtgttattctagataagccattattatgcaaatgagggagtgcggctctcaggatgaataagacggtgccggtagcggcgcgggacagccccagatgtttgcataattacttctgccccaacttcgagagtgcaaaatgtcaagggaggaagttgtgcgggtaaatacggtaccatgttccctgaatttgatttcctacagaagggcggggaaaccgatcggaggcttcagctgcagagagaaaaggcatcacggctcccgggccgacggtgtcccggccgagtggccgtctgcgtccgcccccgcgatgctgagccacccctcggcccagggcggccggagagagcaaggtcccgcccgggtagcgaggcgcttgcgcgggcacagagcagcagcttggccccacgctttccggcagccccggaaccggcaacacggcttctgggcgtgcgcggagccgccgcgctctggccgcggagcctcgacgccagccgagccccttcgtgtcccagacggcgcctcctcccggggcaacggctaggggtgcaccgaggaagccctgtaccggggctgcgaggaaaggcgtcgaccacagtggaggacgccgaggcttcgcccagaacctcgccggcaccgtcgcgttttctcggtcagctcccaaacgtctgccctcgggtttgccgcccgcgtggcccactcttgcggagggtaggcggcccggcagacgcctctgttccccgaggttctgcgagaggccccagactggcctccgcagcttgtgccttctcgaatgacccggcaggccctgcacttaggattttctgatctctaaaaggggaagctggactgtggctcttggcgttaacaatctcgcaagggaacggcaccggctgagagactcccactttggaactgacttgaggtcccgacgtcccagcaaaaaagtcacttcaattccttctgcatgggggtggggtaggaaatgaaaaaacgggaagcgccaggcggagtccgaggagtccctggagcttccctgggactctggagagccgcgtgtggtccaggaggaggcgggaggactgtggcacccagcatcgctggaggcagaagtgcccaccctggcggagctccggctcaagggagcccaggaggtccagctgcctctctgcgcccaggctctggtgccaccattccttgactcgcccagcctctccccgtgttttcccgtgggagggttggtgctccccgcctttctcatgagctgggtcacgggaggaggggcgctcatcaaccgtggctcgtaaccgccaggccaagcctgtcagtgcaggcagaatctggggtcaaactctccactcggggtatctggaaccacaggctgctcacgcgttgagccagggcccggggtgatgcgagaacagagtcagcgcgccccgggcatctccaggcaggggttggggctggaggtttctgataacgtcctgctctcggacgggactccaaggccttgatctctaggccgctcacttgtcccgggctgctctgccgccacaccctgccggcctcccctcgcctctcgcagtccccgcccctggctgtgcctagtccgtcccgtctgagccccttctccccagaccgtgagaactgagcgcccagacccaaggactcccggactccttccaggttgcggttgtccggcccaactctggaccgcctctttctgctccccaagggcgcctggggctcctaggaatgggtctcacaagcagcaccagcgagcagtccggggattgggtgtgcgtgtgatgggggggcgcgtgggggggggcggaaatggggccggcccgcggcgcgcatgcgtgctggttcgggcgctgtgcgcgtgctccagcggcaccgcaccctcagctcgcccggcctcggcgctccgaggggacgccggcgcgttttcccagcgagcccacgtggcccaaccggtccagatgcccaaggaatgaatcaaaactgcctctaagcagcatacggtccgtttcccagggaaggatgggtgtgtgctgagcaccctctctgggcttgcccctcatggagaagaagggacagccgaggctgatactggagttcctggggaaagtcagaacagaatcactaggtcctatgagtttgttctggtctcagaacaccaataacagcaacaacagtaactaataatgaacatttattgagcatttgcctgtgcctgacagtgtgggggtgcttccatatctcattgaaccccccatgggctctgttgggaaaacgtgctaatattccttttcttatagttatggaagctgaaacacagagaggttaagtaacttgcacaagggcacacagccagcaagtgcattggaacccaggcaggctggccccagagcccaccttttttagccactgtgctctagcattaaaaaaaaaaaaaagcgaaaacgcccaccaacatccagcttccagttgacttaaatcggcccctagaactccctcctgtctctattgttccagtctcatccttgttgccgagggctctgagggtcctcctgctggagcactgctctgcgcttccacgaggctccactggacctttcttgaattctttcctcaagccttggaggagctgaaattcacaaggatccaaagcccctgctgcggagctttagggacgtgagcttacggcttctcaggcagaacccctgctgcgtgcccctgagcaagtgacttggccccgcggtgcctcgctttcctcatctagaaaatgggggtaagggaactgatgttacctggctgttgtgaatgttaactgggataacgcaggccctagatatagggcaactagttaagcaatagatgttgcttaactctgaggggatattttcttcctgtggaggggaagaaagggggcctgatttcagtttccggggtttaaggcagaaatgtggcttctagaatgtgtgcagccttgtgggagattcctgtagagtgggcagccccttcttatcctttgcagcctgttccagtgcttctctaacaaggaggatgtgtggatgtctcctagggaggagaaagtgggacaggaaaggtgggagcttcttgctcttgggaacaactagcggcgggaaccaaggccagaaacctggacaacctcacttccagtcacccaggctgggccttgggaccagtttccagaatgtcgggtcaccctgcggcattcccgcagcaggcggcaggcgcccagccctagctcggcgtctaggaagcagcgctgcgggacgcccgcccggctccgggaccgcgggaggtaagccactggccacaaggccacgcctcggagccgcccgcgctcatttcactgccggcccgcccgaggcaaacggttggcttccaaatctgcccgcgtccgcggccaagaccgggcaggtccgacgcccgccaagccgcgaagttgaaacgctcccaaagaaccgggccggcctcatcctcaagctagaggacgcgctagggcttgccggcctggcccaagacccaggagcccagcgccccgctggggcccgtccgcccctctccttggagtgctccagcctccaccctccctcccggaggacgagtccgtggtccgcgggcccagggaggcctaagagggcccccaaactccgggctctcaggaggctgcagcatcgagggcagagtcctggcaccttttagaggctggggccaagggtagggcgggctcccgggagcaggtcgcagaccctttgtcgggaagggcagtcgcgggccgtgcgcccaggtcgccagaagagtgcggaacagggccggagacctaggggtttgggaagcaggtgtccctaggagggcgggcgcccgcatttccgtaaacaaagaaacggggcagctcatctcaggagagggggtggctgttaagagaatcgccgacaatttccttcataaaaatgcgatctgagagcatttgatttccactttcactccccccatcccccgccccaacacacgcaccgtctctaaagacactcaaattgcagccatatggggctaaagtaataggaagcagttaccttatttactgcagaggcggcgcacgccaacctggcagccgcagcctgagcagcggaccgccgagcaatgggattaagagtagcgtgtcttgtcttttacaactttgttttgtttgctcctgggacgtgtaggtgggaaaggcaattatctaactttgaaacaggaaagcggttgtatggagaaaagggaggtggcgagaattgagtcggttggggaagggggttgataagaaaggtggggagcaaggatcctctttctgtgggttcctaagaccatgccaccagctgacctgtcctctcggtctggatctgacccggctggaatgactgcaaacctcctccccctccacgcccacgcatgctagcaccctctcccggaacacagggcttcctcccgcgcccacccagccagagcccgggaggtgggctcccatttctcagaccgccacctcccgctttgtctccaaactgtcgaggaatgaggttgcccggtgacctgttttcacaccccctgcaacgctgctctctcacgggttggggggcaggggttgcgccaggcagggatgagacacactctgccccgttggggattgccttccttggcgggactgagcgcgtctgctactgacaagagccaggctccctgccctcagatcattctatacctcttccttccttctgaatcgagttccacctttgccacaagctttgcaggattccccgacgtttgcaaactcagacttttcgcaagcgatagttttgtttagagcaagcatttccgaaataatcgccatcaggcacaaagacaggtggaaaattgggtggggaagctaagataattacctaagaccctatccagaggagggggccgcacctgccagcatcaggggttccatttcttcaagtttcagaggtatttaggcaaagaagggagaatggggcagaaagagagggagacggaaggaaggaaggatgggaggaaggaagggaggaagaaggaaggaaggaaggaaaatggaaagaacgcatggaggaacgactacagctatcttttttggggagaaactgaaaccatcgccctctgcacgcctagcgcaaaccccatgatcagtaaaggcatcaagggcaagcacaactccgggaagcgggttccagaaaccctatctgaaggaaaatcaccgctcttcgcgggtgcgggagagcttgccaggggtgggggtagggcgcgaggccaggcgggtcaggtccccccggcccactctgggaaggccccctccctcccacttccacagtggccctggagccagctcgaggggctgaggcggccggtgcggggctggggcgctgttgtccttggcgggcagcggattccaagaggaggcgggcgggacaggcagagggacccgggcccagggcggagggtgggctttctctgggcggggaaaccagacacttacaggcggctgaggccgactttatttttactgcccaaactgttggaaagtatttaagcttaaacagaaacagctgtatcgctggcaccggccgacgaaactatttgttaccgggaatgactttttatgattaaggacgcggccgtcggcggcctcccacgggcggcccgcgagggtcactgggagatctgagcgtcctcgacgcgctgttcgttcagacagaacggccggagagatgggactgttcgacaagcggccaccttgtgaagtttaggaacaaggccaaaacctgaaacccgtgtttccagaggctggggcacgactgggagggaagatgggcgaagcgccccgcttgcccggcgggtcgaggacctcgcggctgccgccgcctgcgcgcgcctcactttggacaggaggccagttttccgctctgggcttcctgcccctccgtgtcagactccttggctgcttctctctctcttcctatcgttctctctctgcctctctcttttccccccctctttctccaccccatctctggccaagggaaactgcttgcagtcaggctgatcatcgatgtttgaactaaatcgtgggttccaaggagtgggagttgtgatttggagcttgagcaataagagaacagggtgggagggagctgggcccagagtgaggctgctgtccccagcgccgcccccgccacgggtcaccggtagcctagctggcggcagggtcggcggtgcacgtgcttgtgtgcgcacggcaaggcggtcgcggccggcccttgtccctttccaggagcccgccatcttcgcgcgtgagaccctctcgcccagcccgcactggacccggcgacgtcccccagcttcccgcgctggcgtttctcgcaggatgtccgccgcccacgttgggaagagcggtggacaggaagtgcgcgggccgggcgccggggttcggggaaagccagacgcacccccagccgctcgccccatcctctgccggctccgcccagatgcccttagcccacccaggccccgagcagggggcggcgaggggaaggcgaggttcggggccgaagcctggcgggggcgggcagcttgggctaagggcaggggcaggtggctgcgggcgtcggggatggtcggggggcaggaagaagccgcgcgacatcctctgtggggtcctgggctgcagccgggctccggagggaacagcccggcctccaccaggtctgtgttcggcttcggagccggggacgagcgctccagccagcccggctcgcagggcccggagggtggccgagggcagggccgcgcgacaggagcctgagacacatgcacattgatttgttagcgggacccggcttgggggggggggggacgttgccatggagaccgggggtcgggtgtgcggctccgggggaggggggcggcggccgggggagaagcccagccgatgggcgcgccgcaggctctcggggttcgggcgcggcccgcggcgccccagcacctgtgcattgtgcattgtgcggcgcgggcggctgggggaggggaccgcgcgagtcctgggcggtgggggtggggcggcgggccggggtctgccgaggggcggagccgggctgacatcgccgcggggatcccagcgagagctgtgggggacgccgaacgccggagggacaacttggtggcgggggaggggggccccggcgaggacagagggcggcctgcccccctcgccagccccgcagactgacagcggccgggcccgccttcccctggcgtcacttccggcggcgccccctcccactcgcgcgctcggtctctggagtcgcctcggactccgccccctggcgattggaacgctggtcacgtagcaacgcgggggagaaaggcagaggggcgtggctcggagctcgtccaatcagcgtgcgggggcgcaggcctccggccgctcggctttagcaacgtcgttagcaacacgtggggcgggaggaagcactgggcggaggggagggggccgagcggaggagcgcgggaggggggccgcgggagggagcgagagcgccgggagggggaggagaactgacgtcagcgggagagtattatggtctgtcgtgcgctggctgctgcttttctgctcctggaagcggccaaggggggaagcggcgagtcaacatggagctttcagcggtgggggagcgggtgttcgcggccgaagccctcctgaagcggcgcatacggaaagtaggtgcccccgggcctagggcctccgtgcggccgggccctcccctcccggcccgggttccctccccctgctgcagcccagcttcccttcccccaggtcccagcagcggccgcggccgtggcggcggcggcggcggcagctctgagcccaggcgctttccttagacttgcagcgatgcacggattgcatgggtggggggcggggtggggaatgaatgccggtgcatgcactttgtgcagcattaggtgcaggggtgatgcagcgggcgcgtgccttttgcggcggggtttcgagcattcatctggtgcatgcattttcgcatgcatttcttgtatcctcgtcatgcgtttctccccatgcacacacattatcgcctttgcacccgcagggacgcatggaatacctcgtgaaatggaagggatggtcgcagaagtaagtaggttatatgcaattctcaaccccagactgttattcgggaggtttctttcttcctctttttgcctttacattgaaatacaatacaatgcaatgagaaaagttacacacacacacaccccctctgctctcaccctgctcctgggactgatgcccacttcttcctgattccctttaggtacagcacatgggaaccggaggaaaacatcctggatgctcgcttgctcgcagcctttgaggaaaggtacagacccttccaagtcccagccgctcacttagaaacaagtagagtggcttctttccagcctggactagagtcccacttgctttctttactcacgcaccctttctccttttcttctttctccagggaaagagagatggagctctatggccccaaaaagcgtggacccaagcccaaaaccttcctcctcaaagtaggttggcagtgtccaatggtggaggaccatgttatggagtgatttgtgggaagggggctctgagggctgtgagccaatggggtgtccacacatgttgcctatttgtaatgtaggagggagttccctgacaagatgtcaccaagtcagtagcagcaccaactgtgtctggggggacgggcttggccacactagaattcctttacgctccccctcccaaatggacacaataatcaaatgcaaaaagtgtactttttgcaaatgactacttccagccaaatcttctacctcttctctcatccttctacctctcagctccaacagccatcccacccattcatccagccatccacccacccacccacccacccatccatgcatccatgtagaaattcccaggcatcatagggtaaagataggaggtcagggatagaggaggagtcctgtgggggtggacagggccctgccccactcttgagaccatcttctctcctgcaggcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgccttcctggaggccaaaggccagggtgccctagatcccaatggcacccgggtccgacatggctcaggcccccccagctctggggggggcctgtaccgggacatgggggcccaggggggaaggccctccctcatcgccaggatccctgtggccagaatcctgggggacccggaggaagagtcctggagcccctccctgactaacctggagaaggtggtggtcacggacgtgacctcaaactttttgaccgtcaccattaaggaaagtaacacggaccaaggcttttttaaagagaaaagatgaatgctgggtgggtgtgtccaggaggagagcaggggagagagtgagcgtgagcttggcatagtgatttttatttctgggtgggatgtggccttttggctggtcccgtccctgatgtcacccccaccccaccagcccctttcatccctccttcctccccctcagtttttgttggaaagattatctctagagttatattttctattagatgtaaatatgttatttaagaaaaatatctaaatatatatatttcaactcgaagttgttttatttaaaggagagagactctcattgtgctttagttggggcagcccgaatgagctggggcaggaggggcccccttgccccagagctctagggaagttgggccctgggtacaggtttctgagagtgtctggaggggcttggcctgcccacctcacccctcctcccttctcccacagcccaatgccagactcctggcaccaaggcccggcccagatttgctctctcttcccattggccaggcaggccaacaaaaggttggctccccaatcagaaaaaagggggggtggggtcagtctgttttccttttttctatttttttttttttaaggtaaagaagtctattagggaaaaaagtattaacttgaataagcttttcgtgtgtgatgttgaaggttaaaacgtccccagcaggcagggacaggaggtttctccccaggaccacaccaggaaatgcactttagggaggggtgtgtgtgtggtacacgcagatcgtgtgtatgtcatgtggataaaatctccccgttccctcgttcctttccttactccgcagaaagaaaagaaatccagcgaatctgtttacattcccgaaatgccaggataaattgggaggattgcgtgtcagtgctgagagttcgagacagttgttttgcaagaaaagtgttggggtggacttttccttttcgcgtcctctagctttgccaggagaagagacggtggcccccacctcccaggaagagttggacaagcctccctgcctggggagggcgggccgccagctctgtggtggacacatggccagacaggcccaccctgcgggacccacggagggaggcgcggcggcgggcgctgctaggagcagtggcttcgcacccagggcctctccacggccaggcttggagtgtggctgaggaccacggctcggagctcggagctggggctagactcacccccgcggctccggccgggcacgggaaggaggggcgaggcggggttttcatccaagaatgcgcatcggaacttttgctttttccttttttttcccccgtccttcttaaaagcaaaagctataatttataggtcttttcgattcgcagtgttctctatttgaactcgacattcaaactccgccaaagggggagggaggagcgggagttgggagtggggacggccgcggcggggaaggccgtgcgaggcggcggggcctgggacgcccctgcccggcggacttgaccgctctgcgctccgaggacgcagaatgcgcgcccctcttttgactcaaaagcacaaatcagtcccctccactccacccccgtctcttggagcacggatcccgcagcctccctgccctccccgcccttaaagggccagcgaagatctaacttcccattgcttgttgagggaggggcgcgggggccctgcacgccagaggaagcacagactcggggggagcgaggcggggagtcgggggtgggggagcttcgcgtggggtggggggtgctgggagggaaccccagcctcgtcctccgcactcccggcttctcagcctctcctccagactttcttgcctttaaagagagaaaaggagggaaacggtgtactacatgattgtgtttgtttttgaatatcaaattgcgcctataaagagaagcccctggaatggggatttttatctactcacatttgtaaaactggtattttagactttgtataaagaagcgccgttgaccgagtgtatctatttaaatgtcgatgctattttcagatgaaacttcactgaaggggcatgtctgttacctagtggacgggactgggggatacgcgtcttcacctggccgccgccttcccttctctcccgcctgtcctttactcccacctccctcccttcctgggggctgactttgccccttcccttggaccttctttccagccagctctgtccctgccgcccctccgtcctgctgtttgtccgtggccgtgtgtgtatgtgtctccttctctcgctcttgcgacgctgacctggggggtgggtgggcaggggccgggggccacgtggctgggagtctgcaaccgcgcagggtgtgtgcgctgttgggtttatttaattctaagatttgtacaaatctccaatcgatctccgcctcagctcaagagtgaagcttcggtacctatcttctgcggtcgtgaatgtctgtatccaataccgctttttacgtgtttaaatatatactttgtaaatagagacatgtcttggttttattcttctttttccttccctgagcaaagggaagaggcatcccgggaggagaggatccgtccctcttctctcagtactcatcccgtcctcccgcccccatcctcgcccccatcgcgggggcaccgttcctgcaaaggcccttccccaactggggaacccacctggctgggatagaggtgggcgtgggaggccgctggggcagactcccctcagcccgtccgggggaatccgtggctctccgcacctactggctgcacttcttcgggccccgggcagaatctggggatcccgggaggatgcgcctgaggtcgggggttccactttcctctggcgggatcctccagcgcgccacacccccaggccggaggcgtctggtctccgaggccccggggcctcgccgcgttagccaaagcctcccggtgccagcccctcgtagctgtcttgagacccactccccagacccacccaaccttgctagcgctcccctaaatgcagagcctcgcgcctattgattgaggaattgaattcgcgggtattgctaggcaactgcaagctcggagccggcgcagagcgctgctgatgtgattagtgaacctggagccgccgcgccgcagccccgcgcacccccgcccccgagtccccgcagcctctccggcccaggtctcctgggcgggcctaaaccccagcgctgggcaagggacggtgcgggagagcagagtgcggggtggggggtggagagagagatgttcttggccttttctggccgcagacttcacagcagtgggggcggggtcttgaagcccgcacaggagagccactcttcggatccccaaagaggccaccgcactaaacccatttctacttccgtagtgccccgcagacgtcaccctgccaggaagccacgattcaggctcacccctaacgcccaccaggaggaacatggacaggggtagctcacgcatctccagccccttgctgaggagtcagtggcccggcccttggcagagcttcccccttccccagctgtgaccggtgtgggagggcgcgggaggacagcagcgtcctgctgcccaggcccaggttagcgggtcacagagccttgagtgtccttccgacgtgagggcctgcgctgccggccgagtagggtcgctggccgccaggcgtcaaagatctccgcccgagactgccccaccgcaacgggcggtctctgtgctggcaggggacgtcaagggaaggtgggtggggtggccccgcgatggtcgccacttggacggggctccctcctgcgtccactcggacggggctccctcctgcgtccactcctgggcgtgtggggcagtggaatgggctactgcttaagcggatgggagggcgcccaccctgcccctttttcgggttcgctggccatcaccaccctcggctttgaggagcgccctcacgggtttccatttcctgggcagagtccctgggaatccgccacaactgcagagaccaggcgtgcgtggcggcctccagccggactggttaccttgcgtcccgaggacagggctggcttgtgtggccaccgcggcggggaacctggcctcgcacaaacattggttggattggaaggttcatgctcttcctagagtgtcggatcggattcattttctgtccgtttgatgctggcttcgcaccaatcctgatccaggcactgtgccatgcgcccgggccgctggcgcacagacctgtcccggccctctggggctcctgtgctggtttcctcttctcctctaaaagccctccaggcccagaggagcctcggacccagctgaagtccgagactggcgtggctcggggcccggcgggactccgtgctgtccgtcgtggaaggcggctgcccgcagcctcgggtcctgaacgcggcgagagaggctgcgggctgggtcggggctttcctcctgagacttcggaggcggaggtggccggggtgcaggtggtgcgattgagtctcgggcaccctggagccgcggctggcttttccctcgtccgtccgaagggccggcggccgaccttggtgggacgcgcgcgccctctgcaggtggcggcgtcggcccgggtcgccggcgcccaccccttacccccggggggccggtggctttctggttccgaacccgagctgagaaagccttacctccccccgacccaaaggtaccgctgggcgcccaccgccacgggcgccccctctgcgtcctccctgaggcccggcgctcgagccacgaaggcggaggggaggaaggagaggtccagccgcccggatgaccgtcctcccagcccctccgcacccatcgctcccggtgccctcgggcaggtcgcggcggcgtggggtcgggccattggcagcccagtctgttcttctcagggtccactggattaggcgatcacatcagcggcgccgaaactaacaaaggccgagcgagctcggcccggcacccgtcgggccgaatccctgtagaaatgggctctcccgaaagcctggctccacatccggggccgcgcctgctcctgctcggccagcttgctccttcctggcggtcccagcccctttctgcagctctcataagccagaggacaggcccgctggggtcgcccttgcccactttctccaaaaggaaacagccagagccttgcgaaggcagcaaaagagagcccaccagcagtcttctttctctgcaacagtcgatttcgaattcgcaggacttcctggagcgggctagtgctgggggtcacatttccatttgcagggggaaccctttcctgaaccaaaacattcaggccttggccccaagtagcttttcacccagttactccaacatctaggcccagcttctctcttcacttcaaagaagctctattctccctggaggctggaattcatgaataaattcatgctgaagttggtggaagccttaaggagccggggaaggttctgtaataagcaaatcgcctctttattcgcgagctttgggttaggagttgcagtagctgctaactcacagtgactcccctggaattttatggctgcctccttgtaaagcattattagcacatgtggtggcttcaaggggttgagtggctttccaacacagcatctctggatactgtgggcgcggggagagggagttttattttaactttgcatgtcttttgaagggagcagtctcaaaatgagttgattatatattgcagcatccctgacctcacctgacagatgccgataatgccgcccctgcccccaacccctgccattgtgttttttctatttttcccattaattcagtctctcaaactcagcactactgacgtgctgggaaggatcatttctttctgtcatggagactgttctgtgcacctcaggacgtctagcagcactcctggtatccacccactagatgcaagtggcatccaccccacagcgtgacaagcaagatctccagatctgcaagtgttccctggaatgccagttgttctctgttgtgagccactggtatatggactcttaaacacccatcctttgcttggaaacatatctttttctgcaccctctgcaagtggcctttcccagtctttgatttttctgtgccccaagtatttggcctatgtccagacgaattattttgcctcaagaaaggaaaagagcagagtctactgtgtttccagggatcactcatgatgtacatcaggccaaattttttttttaaaaatttattgatatactaagagataacaaaaggacaaaaatcttctgacgccatttgctgtccttcccctgcaaaataaattaacatcagtctaaaagaagaaaaaaccctgcaacctatgctagttttccaaaaatgctagaaaacccacagaatcatgagatgcacttgagtaaaatctggtcatgtaggcactacctgttcccaactcaccattccccttccccacaccatcaggggctttttgggggaagcatttccttaaactggttgatcctaattaaatgtgggccctaggctgctgtcctgtttcaacagagatcctttcctagggcaataacatatctacttttgttctcttttaagaaagcaaacagccatagttgaaagcaattagaagtggcatacatgaatgattttttttttaattaaaaaacacaaatcaagccagtgattggctttggttcaaagcttgatcctcccctgaagtctccccttagtgaaagctctcggcccagagccctctccagctaggtcagaatttcgagtgtaaccaaaacaaggaacactcttttttggtacaaaatatatacatataaaaatatgctaacatctctaaggaagacagactggccactgcttcctattcaatacaggagcaaacaaaacgcggttaacacaccatttcacacacacaccattgccacagttcctgcgggaccttcgggaaaaaagcaacaatgcatcgtcagaagtgccagatacctagctacacaaacacaaacacacacacaaatagcagcaaataaaaatagaaaaagtctacttttatttattggtaaacataagacaaccaagtctgagcatctggtgcagttcccagtgacggcacttgccctgcacacgctcttgaagcaccaggaaaaacacacaacacagtaagaaggcaaagtggctgggagtaaggtatctgcagattcaaactttgggattgaagtagctggtaaacagaaaggcaccgaatcagggtctggagagacccggctgctggggaggaatctggcctgcccaggcagacagggacagacatcctcatttctccaacagctcctggaagccgagtcaccccaagggcttggagagctgttagtctggctttggagcagtgaaggtagcacagtgctcagcaggaaggagtcaagactttgctgtcgagcacagggaggctggtgcctgaggctcagcgtgccaggatccacgcctcctcccaggctgcgcagtgagctggaatctctccctctcctgtgggagcagctcttccccttactgtctgcttccagctctggcctagctatctgggactcttagcccttcaattcgccgaggtgggcaccattcctgctgcagccaatatggccactgtgggctggcccccagctggcatatggatggccctcaacgaagccatggacatgggtccctccccaaaggcacactgttaaaaagatccatttggctacaccaaggccacctcttcctatttggcacggtgaggtactggggggtcttgcagtctggtacgcctgccccccgcaaaccagagcccattctcaaagtccgggctgctccatggaatcaggagtgcctccctatagtcaggcactggaatgtagccccatgcctgctggcggactccatccaatcagaggaacagaaagcacccaccccaccctcttttatttttggcatcacaaagacctagtgaccagattgcctgccgctgccacctctgggctgccctgccttgctgcccacgctgctctcagaacagaaatcctgatactggtcagaagccatacaagctagctcccagacgtgaccacctagaggcagctcacagtcttgagttaacaggggcctcagggccgaggctgacagatccagcttcccgggaccctctaccaggcgggccccctagactttgtccagcttccccaatggcacaggtctagtttttcagctggaaaggagccaagcagggaacccctaaaggtgatggggattgtcagggaaaatgatactcctcaaggaatgcctcatccacttgggcagggccccacacaggacgtagggagttgttggctggacccacggccaacacttgcagcacaggcagagccggcagacgggcccatggacacccaagtgccagcactgctgtcctccaggtctccggggcagtctgtgggccataattagaatgaagccagtcctttactagcagaaggtaggtcctgggagtgaagggaggggcttgcctgccaagggtcctgcccactggactcccctggacctgagcacctccactttgggttttccttgggacacactgaactctgggctttttagaaatggaacatgcttcagtgggcctggggcaggaggtgggtctgggtttggaaggggactcaggtcagttctcactgggacacaggcaggagggagggtggcagccatagcctgcctctcctgctccgaggcacggaggctcttcaggtggaacccagctgtgggaccacccccgccccacccacgctggcttgtgggctatggatgctgccctgaactggggctagatggccatgaaggcagccttttagggctgctgggctcgctctactccagctgcctgccactgtcttttcacattaaggccccagccagcccccacctgtcaagggcaagctccccacttcatcactgccggctcaggcaatgccagccaggaccacccctgcccaccccatctcccaaaagctgtggccagatggagggaacactagtcccactggccatgcctccccacaatactctctgcccactccagggctgaaggcaaggtgggccagaagtcccctcctgacacctcagcccctgcaagacagggaccaaagctgtgattcagtcacgcaggccagggaggagcagttcaaactcagcaacaacgcagccatgaagaagcccgctctgttcaagacagtcacctggagccacaggtgccaccgggtttcctgaggcaagaggggagagcaaagaggcctgcagaggtaggaacaaggtggagaccaacaaggcagtgaggccccctgccctatgtcctgggacagagtggggtgcgggagaagtcccttccaagcctgcccatcaaggaggccacccactcctcctcccccgacccagactcttgagggggcttgggctgggagtcacttagccaagcgacaccataggcagggaaggggagtaagaccgcgcagctggtggcgccggggcttcagtaatgcctcaggttgaagaagcccacgctggtgggagactccttcactgtgacggtgatgaggttggcagtgacgtcggtgacaaatacgtgctcgatgaggctgcgggtgggcttccagtcctggctggtctgaacggacactgacgggttctgtccagtgctgggcggcgaggcggagtcggggtcggagtccgagctgctactctcctcacctgcgctcatctctggcagtgtggccgccttgcgggcttctccgggggctgtgcggctctcctgcccactgggggtagcactgcccttgacacagtccctcttgctggcaggggtgggtggcgccactgctctggaagctagcttctcacttttgcttgtgtcggtgggcatggtggccccgctggccccaatgaggccactcccagtgcccttcccaggggctgggttggtggccgggacacccttggtggcggtggcgtggcgggcaaggagacccaccccgggcatgccattcttgacactctgcaagtccaagacctggaggctcagctcctgggtgggtgctggctgggggcctgggcacccagcaggcaccctgctggcaccatgggtgtgcggggggccccctgtgttccccactttctgctccacagccccaccgctggg

SEQ ID NO: 1371 - DNA, 1540 bp, Homo sapiens
ctgacgtcagcgggagagtattatggtctgtcgtgcgctggctgctgcttttctgctcctggaagcggcctaggggggaagcggcgagtcaacatggagctttcagcggtgggggagcgggtgttcgcggccgaagccctcctgaagcggcgcatacggaaaggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgccttcctggaggccaaaggccagggtgccctagatcccaatggcacccgggtccgacatggctcaggcccccccagctctggggggggcctgtaccgggacatgggggcccaggggggaaggccctccctcatcgccaggatccctgtggccagaatcctgggggacccggaggaagagtcctggagcccctccctgactaacctggagaaggtggtggtcacggacgtgacctcaaactttttgaccgtcaccattaaggaaagtaacacggaccaaggcttttttaaagagaaaagatgaatgctgggtgggtgtgtccaggaggagagcaggggagagagtgagcgtgagcttggcatagtgatttttatttctgggtgggatgtggccttttggctggtcccgtccctgatgtcacccccaccccaccagcccctttcatccctccttcctccccctcagtttttgttggaaagattatctctagagttatattttctattagatgtaaatatgttatttaagaaaaatatctaaatatatatatttcaactcgaaaaaaaaaaaaaaaaactcg

SEQ ID NO: 1372 - DNA, 1170 bp, Homo sapiens
atggagctttcagcggtgggggagcgggtgttcgcggccgaagccctcctgaagcggcgcatacggaaaggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgccttcctggaggccaaaggccagggtgccctagatcccaatggcacccgggtccgacatggctcaggcccccccagctctggggggggcctgtaccgggacatgggggcccaggggggaaggccctccctcatcgccaggatccctgtggccagaatcctgggggacccggaggaagagtcctggagcccctccctgactaacctggagaaggtggtggtcacggacgtgacctcaaactttttgaccgtcaccattaaggaaagtaacacggaccaaggcttttttaaagagaaaagatga

SEQ ID NO: 1373 - DNA, 25083 bp, Mus musculus
  misc_feature (4282)..(4772): "n" at positions 4282 thru 4772 can be any base
  misc_feature (18040)..(18567): "n" at positions 18040 thru 18567 can be any base
ccttcttttttgagccagagtctctccctgaacatggaacccactaatttcttactggctacaagtctctaggatcctctgtctctgcagccatgggattatagaagctgccaggtttttacaagggttccagggataagaactcaggttctcatgcttgtgtgggaaatactttactaactgatccaaatgtctagccgctggcctcttacttctcaaggggactctgtaagtagctgagatgcagagagtcagtgaataacatcgggatgtggctggagcatgctatgtagcaggaagcagtggcattgccaagagctacctcgagcccaaagggcacagtccaaggttacagtctgaaatacggggatccctaagcccgaagttttgcaaatactggagtctctcgattcggctcttcctgaggcaccccagtctcagccggctctagcgatgtcttgattggctggaagattgctgcttcttgatgtggtggtgattgcttccgaaagatggagtaatagcaactgctatcatttctgagcattttctaggcaccgccattgtgcaaagcgtttttgcacatattatcccaccgaccacccctataagatgaacaggcaacccagtgatattggccctgctctgcccccatccacttctttttagaacctccatgtgacagagaaattgaggttcagaggtgaagtaacttcccccaaatcacacaatggcgttctgtctacataactcccatgtccattctcctaagactcaaagggactctgtaagtaactgggatgcaaatgatagcagaggaaaagacggatctgatacacgttcctacaaaacctgatttgtttatcgctaaaattactaatagaacaaactggccctgaaaagtcccaaatgagtagacaaatggtggagcctctctcacttcagctcctccacagcaccccagtctcagccaatctctggaggatgtcttgattggctagaagtcagatgcccatgacaactgaacatttaaagaattttccatgtgagctgaaaccatattagaagagagctttatttccgtgactatcgcaactaacaagatgtatgttgcaactcagcttccagtgattaaaacaagaacaaaagtaaattgaccttgtaagcattctccccgtgtgacacttcactcgtagcagaagtccactgtagcaaaggcatgtagtcatagtcacgtaggactcttcttccctggaaaagaatgtacttgtaaatgtactaagaagaaaataaaaggggggttccagtgaggaaaaataacctatctgtggtcatgtttatcacgcagactgattcagacttctgacatccttatttcagaaggaaagcttgggaatgtctaaacttccgggtatttaatattttgagggtagaggagaaggtacagtttagtcttgctgggtagggatcaaacaaagatttctttagctctcgttctacacattcgaattgcctcagagtagctgaatcttgcctgaacgtggcagttactggatgctatgggaagataccgtaaggccatgattgctttaaaatcactcataataaaaagacataaaaaacacattttgaggcttgattctaaatgttatacttaaatttaggcgacttaattgcccatagaatgggaatgaagtcccaccagtaggcagtaatttcttacagccatggtgtgtgaaattgaaatcttaagatatcatcatatcaaagacgtaccttctcaaagaaggctccctccaaagagttgtgaaagacaagaaattgacccaaagtcatgaaagtatctccctccgcccccttagcacactcaggtcaaagcaaaagcacaattggccattccaaagttacctcttagaatccaaggagatatttattttaataactcattccaatgctatgggaaattggagcaacaacaacaacaaatacacacacatttaattacagatccatgggtcacatgctgggtacatagttatatatatgtatatatgcatacatatgcatatatatgtatatgtatatatgaatacatatgcatatatacagatatacatatatgtgtatatatgtgtgtatgtatatatatatacatatatatgtatatgtgtatatatatatatatatatatatatatatatatatatatatgctcccatttcattagagatccatgtaccacatgatgggtgtatagttccatcaatccttacaccaaaccctctagttagtaaatcccattattcccattttactaacaaggatgctgaaagtgtaaattctgcttgttcagctgagttcacatgatggtaaaagggaggttacaatacaggcaaactcctcagccactttcttcatgccgtatcttgaaggtagttttcctagtcacatgagctgataagagtctaaagcaaccccaggaaatatggttctagtggctcggcattaaaacatcattattaagtagatatactgctaatcacaacccgtgtgttttcattgtttctttttcttcttttggttttggttttgagacactgtctcctgtagcccagactggcctgtgacgaactttgtaggggaggatgacttagaatccctaatgctcctgccctgcctgacctgggattactggcctgtgctaccactaacaatgtttattttcacttcagatagaaatgaaagtagaataacaagttatgtatttatcatataatttaggcttgcctaaacattgtaaaaaatttgttttttaatttagaaaaactaaggacttaaatagaaaatatctttttatacactgaaggtgggttttggaccaacacgagggcaggcgcacaaacacagattttaattattccctttcagtatacgtgtcaggacatggagagagagggaaatgacacgaatctgtgggtagtggttcaggctattgctagggagaaatcagggaggactttgctcagtacggggaatccgggaattcatttctgactatcatcttccggggtgagctggtctaggttattaaagcaatctttaaattggggctgaaatgcctatgtctttgatccgggctgttcttactaaacaatggattctgagagcactcgggactttcctctttacaaacctgaagactgtcatcatcataagctaacgggccttgaacgatcatttctggactcagtttcaaggaactcaaggcccagggggacctaggtttttctcctgaaaagtagctagctggaatccatctcttcccttctgtatttctttctccttctagaacttgtcttcaagcttgaaggagaaacctgcccttttctttgttttatataagacaaaataatagtaagtaataactgaaagtctttttatcgggaaggaacttcctccggtccaagcaagtattgctgctgatactttacagagagggccagcctcaccgctggagttcgctctttgaaagaggctaggggagggaattctgccgccagcagatggagaggagacccggacaacgtggtccctcccagacaccctccctgcgggattagctgcccccagctctgctcaggcgcacctagcgcgtgaggttcctggtcacacagcttgcgcccctctctggagagcagtcgcagctactagcttgccgccagcagagccgcactgtctcgggcatcgcagagcaccacgactgtggacttgggacctcgaacccgagacgagcgcgcgctagccagccattagcaacgcttgcatttctgcaggtgcttatttcacattcttgtcttttctttcctgctggaacgggcgagtggttactttcagcctgaggccaaagggaaaggcagaagaaggggaactctgaaaaagacagtttagtggcagcgggattcttgccccaggagaggggctcaggggagactctcggtctctgccgcgggcccctttaagaagccaagtcagggctgccgctgtcgccgttgctgctgctgccgctgccgccgccgccgccgccgccgccgccgccgccgccgctatttggattgctaatccccaggagccccgtttaaaaaaaaaaaaaaaaaggaagaaaaaaaggggggagggggcgggcagctgtctctttaaatgtgatttccttctattgtatttgaatcgtgatcaggaaaaaggaaatgaaaccagagacagagggaagctgagcgaaaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgcccgcagcgtgcccttgatccctccgtctcccagggttctctttcctcgcgggtgactctggaaacaccgagagggactgggcggcggaagctgtaactgggatcgaccctgcggaccgctccgggctatctggaaagctccccaaacctttaccagggccagaaagtttgcccaggagctggcacccggagctctgaggcacaggtgcagggcagggagagtggaggacaagattctgccttctcccttttcgtcccaccctctccaggttcccttcctttttgtccatttggccttggaaaggggggcatcccaactagaacatcccggggtctccgacgtcgactctcctaccaggcccggagtagagcggacagttgatgaggtccgcttgtccacctgggaactggttctggcctccagagacttctagaattgctaatctgtcgttcctcccggtacatgttcgcccctcccctgagtttcctagtgcgggcatgtgaacctcgaaagttagtgcacatttttttttctgtctagtatgtttttctagggagcagaatctcatcgaactctcagaagggctgtgtgtgtgtgtgtcagcgaaccagagctttaatgagcatgtactgtctagtgctctgagctttgcgctggtttgcaaagaacagccccccctcccttccccattccacagcctgtaccctcctagcccattctctagccttaacaaggggagccaggaacgaaggtatcggttttttttttccacgtccacacaaatgcccttttaagagtcattagctgtctggttttgagtttttattcctttgaagtcctcatctaatcctttgaagggatttgttaacacaagaccaaaggcactgctaatgacttgtccgtttgggcttttaagatgcatttgttttggtggggttttgccccccttttcttttcttttcctgctttaaaagaattgtgctttcctgctggagttttcctattcacccccccccttcaatttcagccttctgtggtgtttatttacctgggctttaccctcagccagcagcataaaaacccagcgtgttctcataaaacacaggaagtcccacgatccagcaagaatataaacatcactcttcagtcttgaaggttaagacactagctcagaaaggagctaggtttgttggcaagaggaccagcttccttaaaatctcaggagagaaacaacaaccctttaaagagtcagtgtctatagcttgttcccttttaagcataagcttagaattacatctgggccccgagttttcagaaattggacaagacataagattacacagttggggaggcagtctggtgaactgctgtttactggctccctatcagcacaacctaaccactaatcctttattagatgttgaatctacagagtttggcttcttaaaaaaattactaattacatgaatgtgtgtgtgcacctaagctcaggtcccctggaggctagaggtgaaggatctccctagagtgggagtcacaggtagttgtgagccatctgatttgggtgtggagactccaacttgggtcctttggaagaacagaaatcatccttaaacagctgagccttctctccagcctgggaattgtgttctgtaaaggaagtttactcttgctaaagttggtgccttttattgcctcagactagaaaactgaaaggtatctcatagctgtagtagtgagcacctacctagttcaggaggtccactggtagttcatctttcctgcagtatgtgtccggtaaaggaaggctgtaactgaagatggacaagccccgtgggaaatgtctgtggaacatttcccctctttctgggaaattgttgagaaatttttgccagaaaatcaaagctaaagagatactcaggtgtcatatttgggacaggctggcgggagaatatcaaatattaacttaaggtaaatctcatttagtctttggcttgaattgttcaacagaggtaatggcatgtcattaattatagaaagatagaccgagtccgaatcttgtcctgtctttatctgttgttctcagaccctcgtgtctctttctcctgcaactagctctcctgccagcggcctcactgagtgcttgctcaaagccagcttgggtctttaccagcttggatctccagatgcagatcggtccttgcctaggcacgtgcaaaggtagcgtgtgcacaggaagccagtattcatgaacacagatatccttcaccatgcaattggtgttcccttctgcttccctacaggtcattttaattctagcgaattttgttccagctaagtacagattcttctctttcaaagttggctgcaataacatccaccctctgggcatcaagcatgatgggagttctgtgagtgtttttgaaagcccactgtaaaaccttgagctatgcaaaggatggagattagattctgaattggtgcacttgaataggccaaggatcttagttaactttcaaatatgaggatggatgccttatatataccctatagaaacaaaggctctagtaggaacctgacagggtttctctttgtagttctggctgtcctgaaactcacactgcagcccaggctggcctcaaactcagaaatccacctgcttctgcctccagagtgctgggatttttaggtgtgtgccaccactgcctggcaacttctagtgtattattaaaacgatttaaggtcttagcccacctcacccataattctgtatacatgagagactggggcagaagaatggaaagttccaggacaacctgggcaatttagtgagatcttgtcttaaactttaaaaggaaggaaagggttttcgagctgcctcagctgctaaaggtgcttgctctaagtctgatgacctgagtttgattcctggaacccatgtgaagggaagagagaaccggaatacagctcagtggttaagagcatcccctgctcttacatgggacccaggttggattcccagcacccatactgggtggctcacaaccctctgtaaccccatctctagggtatctgaggcccatggccttctggggcacctgcccttgtgtgcatcttcacccttcccccccccccccacacacacacatacaattataaataaaaataaacctttaaaaacaatataaacaaacagaattgagaaagaagtcagtggtggagcacttacctaaagcgactagggacctgggtttgatcatcagtactgaaacaacaaacaaacaaacaacacctaaaacctgacttgatctttgtttttctcaaagaaactgacctgagcttcaaacttcctggttctaaaagaagatactcttatattttgtgctaaaatggtgggtttggcattagcatttagctaaatattgacaacggatgcttaatagtctcctagatagggtcacctgtagatgctggagtgccctataaacactcattccctgagtctcactgtccccaactataatgaagctgggcttcatgggtacaggccaattacgccacaaggtcatttggtaaaagtgccaaataaaactaagagacacagacatatcacctagggtactcaggaggaaattccattggagatttcataataggaataaaaaccaattaaaaaaatttttatactagatttttttaaaagcaggttttatttgaacagtgttccaggaacacatattacaaattaacaagcattaagtatcccctgtctcctatctgacatcacattcatttcttccatgccgttttctctcagtaaagttatttcttacatgtaaaacaaaagtggtcaggttccagggaggcaaagcaagcagaaggccctatgtgtgactttaaagcaaatttttacattagtgtgtgtgtgtgtgtgtgtgtgtgtgtttatctatgtgcatggatagaacagcctgctgtaattggctctttctttccgctgtgtgtgtcctggggaccacatcagatcattgggcttggtggcaagcaccctcacctcctaagcatcttgtgatcccctacataacactttttaaatgaaagaacacatccctcaggctcactgtgaacaccgtgcctggattgagactttggtatcaatttaattgccttccactctcttttaaatccattgtttggccccctcctccactctctttactaatttgattttattcaaactacttttgctgtggtgaaaaaagtttgaaggaaaaaaaaaaaccacatcaccactatcctctgtctgtttaagagctgcatcgtgacctagatttcctgccagagtcattcagatcttgtacttctttgagacagtgtctaacgcagcccagagcctccggatgatgctgataaacttgccatcctgctcctccaggttccacctcaggatggactgggtgtatgtccccactttaggtggtactggagaaatgaccgttgggcctctgacatgttgggctgtctctctacctatgaaaccgaatctccatccaaagactcatgcaggatgtatggaagaatgcagaacttcaatcggaataatcagatattgacggaactttctgtttggggaagagaaggcaaccaaatataatttcgatggctttcttccttctctacctttgattctgtgcagcgggaaggtctttgtagggtgcattcaacaggttatctgtagattgttagcacactggggggggggggggtcatcagatgctttggctgtgagcaactcctttggtcccaagtctattctttgggattctttggcagtgcctgtgtccaaagaaaaaagggagggagggctgggaagatggaggagagtaggaggggaaggaggaagaagcagattggatcagaggtgcctgcagagatgctggaatgtagtcaagggtccaagggctatctgtaggtgccttggacacctcctggtatcccgtcttcagtttttcagatgataaggtctctctagcccactcccgtctttatccaaggttgtctgtgtctatgcagtctgaatttgggcgtcctttctccttatactgctggaaggaaatgtagtgaggttccccatagaaccttgggcatgcagtgattcctgggactttgtgcttgtctcccttcaggcagcatatcctaatgcttggctcttccccagggaacccgtggatgaggtgctgcagatacccccatccctgctgacatgtggtggctgccagcagaacataggggaccgctacttcctgaaagccatcgaccagtactggcatgaggattgcctcagctgtgacctctgtgggtgtcggctgggagaggtggggaggcgcctctactacaagctgggacggaaattgtgcaggagagactatctcaggtatatccctcacacttctggggcacatccggggttggatacatagtctctagctcctgaggtgtctgcctaaggggcctaggctgtggaggctgagcttcagctgcctcttcagagaagccgtgagttcttcctctactgtggctatgtttgcagagacacatcactgcatggtaaatcaccaatgtttttaaaggtaagagaataaaaaacacggaattcagaataaggacaaaattctgggggtgggggcagaccaaaggatagggtttggagaagtgtacgtagggaaatatccagggaactaggggaagagagaattcatttataagtttcttgggtgggttctcatttagtactcaataagcatatgcatatgtgtagatagtctttttgttttgttttgttttggtttttggtttttggttttttgagacagggtttctctgtatagccctggctgtcctggaactcaccttgtagaccaggctggcctcaaactcagaaatccgcctgcctctacctcccaagtgctgggattaaaggcgtgcgccaccacgcccggcatgtgtagatattcttttgcacaactccagtattattgatgagaacttttaaaatagcaatgtgtccttgctagtgagcccccaagcgctgaatttcatagcaggaggctagccttcagcagctataaaggtgaagtcaggaggtttgagtcactactccattgcttcctagtgctggccttgggcaatgcacacaagccttcacgtcctgtatgtaaaatggggattgtaattgtacttacttctaaagttagaatgaagtacttgaattggtacataacttaagaaataggtggtagctgagtttataattgacaggtaccatggtgggatcacaaattattttccattataatggacaaggagatggtaacatggaaggcagaaatagaaagtgtacaaggccaagcgagacagaaacatttcccctgaatttgtgtgtcctggcacccaatgagtgcctttgtctggcgtgttctagcatctctagcttctatattagctgcactggaggtaactctgtaccccgtactgccagatccactcaactgttcagctgtcagttcttcgccatcctcctgtggcagaggctccactgagcgcgcagtccctgtgtattagggccagccagccagcggagagaagctcttcagactccagtgccctgggctgctaagcaggctcttccccctgcatgtgttctcggggcactgcacatgtgaaataaaaacaaaactgctggtccttctgaagtcaaaggaagcttatctgtccacccaaagactgaagtagcgtgcttagtctttgattgaaatcattgcagatgtggtggttttgggcaaatggaaaagagagcaagtaggtctgactgtcattttgttgaatttctttcttccttttttttttttttttaagtcataagaaaatagaacagagataaatacagacctggtttttactcaccccaggcctgccaggtccatcagaaagcagctgggtaaatgactcccgctgggctcctgcctccatccctgttgaatcatttgaatcttattaaacgaagtcagattcagtgaggtcaaaagagccgattcctccctatctccccggttttatagaacattcaggaagaaaggcggcgctgcctgggcttgttaatcttttccattttcaaaaaggagaagggaaaaaaaaaactagtctgggagagcccagtgttaattaacttgtgtcttggtgacacgaaataattcttctccctgctacattcccagacaacatgttaattaactctgcattagcgcaggcgttcccagccatcctttaatatttgtattattgttattaaaatgggcagcagaaagcttaaggctctgacgcctcttgacagcggagggatttctatttcgttcagggatggtccattagccatggatttctttactttagttctttggcatatccagagctattttatcaggataagttcagagtgactccgagggtcctccaaagagacccagtccctatctatgcctagaacagcttctctccatgagggtcttgaatggacaactcttgtctggtctttttgagacattcaacctcaaatacccaggaccccaccaccacccctcatccttctctcatatacaactcagacctgctactgttgcattgtgttaagtacacagcctggatccccttagatccaattttctcgaacttttatgtagggcaatcccctttagcctatggttctgtttcaacagctggcacctacatctagccagcatctgttgtagccagaactatgtagtctcaccagatcctggtaccaaagacaccccaattcctgcagcttaggggggagccaaggctacttggagacaggacttatacttcaggagtccccagacatcaggccaaagctcccactgaggctgggcacctgagattgcttcttgactccctcaccgttttctcacttaccctgaggacatcataaaccacttgaacataaatcctcccctgtggtctgttcctgggatacccagctaagatgaggattctgtgagccagaggttaatgcacacattaacggccaagtgctggccggttttcatcactgttagcctttccaagtccatgagttggggtgggctgccaagacctctgcctccagtctcggcttacagtgtaagcacatgagccaggagaggacatgtcattttcttgggtcacctacctagttagagattctgggacctgggcttatctcccagacatcagtcctttgtcctcccgttagctgcttggtgtgttgtaatttgcccccgacttccctttaatgagctcccgctttcttaaggtctacacctcaggcactcagactcatttgccgcacactgttctctcagtcgtgtgtctctgctcagccccaaacttaacttactcaacagtcaggacaccaccagaatgctctttctgctctgtgacctccgatggggcatttgcctacagcgccaccgtctgctctggtaagatagagtgttctcccccattgacaagtctgcttccagcacagaaagtgggatccagaacagagatgacctctgacctcgctgcggggagctccctctctgctcactggccctgcttacaggccatccattttggccaaatgttgcaggctttggtggctgtccttacctctcctacaacctcttaggatgcaccagtccattctctcatttttttaagttggtacagacttctaaggagagcaagcatttactggaagctacgtgcagacatgctatgttacaagcactatgtaaaaaggaccctgctgcaacagttgagagcacacctggaatgtgatcacatagccagagttggctcagtcattgacctctgatactctgacacgccctacatgtcacactaacatctaagcaaggtagatgatggggttgccaaaccaccttctggtcctcatgttcttcttccaggcaggcttgttttcaaaagttagccatcactagatcattagtacagtctgctgagccttctcttctgtgtctctgtcaggtgtagagatagttgggaatttctgtttctaacaagttcctggatgctgccagcccctgaccggctccttttcaaccactgcagtgactccaaagttgcctcccacacctcaacactaagtgtcgcttgcttaagtgactgatgctagggagaaacttgatttagttgtgaggaaagtcacctctccagagagtcacgctgagtgggcaggaggagcatgaatgaagagccactgtgcatcatggagagatcctgtttgtcctctgggtctctgaggcatgattgtggcactacttgtctcccgggacacccctgtctcctggcagctgggctccagtgaatggtcatgtggacatggaatttgcagcttgacgggtaggaggtgaatcaaggcacactccccaaaaggggaaattagtggctgttgacatgagagtgaattcctggtgacccacccgtccaagggctggccccagctcctcttctgcagccagagttcctctaggaaagagacacagactacatgccttacttcttacacgtcacttcatctgcttcttttccatagctggtccacacagcctagaggcatggataaaagtagggaaatgcttggggaggcgaggaataacagcaagcaaaatgtcatcgtgtctcccccccccccccagggaaggattcatgggctattaattgggttcatctgtcttgcttatctgtttttatgtttagatagcttattactgtgtatcccggtcctatgtggaccttgccatcttcctgcctcagcctcctgagtactaggattactgctgtaatccactgtatccgactaggtgcagcattgcctaggttttttggaaacctgatagattcacatcagtttatcatctcacatcaatctatcatcgccagccgccatctttctgttgtccccgcccctgtctcttagcgtttttgtctctgttttttttccttttcttttcaccccaggctttttggtcaggatggtctctgtgcatcctgtgacaagcggatccgtgcctatgagatgacgatgcgggtgaaagacaaagtgtatcacctggagtgtttcaaatgcgccgcctgtcagaagcatttctgtgtaggtgacagataccttctcatcaactccgacatagtgtgtgaacaagacatctacgagtggaccaagatcaatgggatcatctaggccagagtcccaggcacctgtggggaggtgttcagtgaagacgccgtctcggtgtggtcttcactcttaggctctttgggaacctgagggtgggtgaggcatttcttaggagattatggactcttcctgggcactaaagacatagcaatcacatgacataatgcaaaggctgagacttcagtgacaaaaaggaccagcccttagagagaatttatggtcacaggctagccatagtaactgacaagattagtggaggaaatatttggggaccagcatgcactgtgccatcctgataggcttccccaggtaactatcgattagatgtgaccttggtgttcatggactagagttgtgcaattaattttttcctggctttggtaactaccctgttctagtcacagtccttcacactaggaaaggaaagagagaagaaatagtcactctttttttctttctttcttttttccttggtcaccttcccgtggccttaagctctggagccaagggaaactgcatggaggtacatttcagttgggaatgaaatccacatctttcaaccagacaaatatttatagcgatgttgatgaatcactgtttttagacaccttcattttgaggtgaggcgccccacagattgtttctatacaaatgtaaatcttaaaaaaaaaaggtcaaagttgttcaactattttattatcttagattatatcaaagtatttgttgtgtgtcattaaaaaaaaaactcgattctgaagacttaataaaaatgacaagctgaaatgcagtgctgttcttgatgtgaaatgacttacaggttgggccagcagggaaatggtttgcttttttttttctctttggaaaggtgaagtcaatacacagtttatttctaggtcaaataaaagcttccatttattgcaagggtttatatgaggtttatataggtttctgtattaccagcaattatgtaacaggccatcacgtagctcagagggatatagaataattaagttggtattgtaaaatgtgcatttcacgttggcattgtgtggagtgaggggaaggcagggagagcattgcctttgggaaacttgtaacctagaaagcacacaaatacataaaatagattccctttgggagagaaggtaattacctggcttgaaatgtggcaaagatgctgagcctgacatttctattttccaggatgtgtgtctcagggtgttttatgacaagtgcttaagaggaccttactttgaggatttaaagctggccccttggcttgttgtgtccctgcacccccatcgggggcgttatctgacttcaagcgccacctgctggtcattcctcaacccaccagcccaagggtgtcccagggaatgacaaacctccatgaaggatatattttcaattatttcataaaaccgttggcaaacaccagtgagtctagatgtgtttaattatcaagatgtcagaagcatgcagctaaagctatgtttaattaacttgaaagtactttaacgtctctgtcattggagtttatttttccctctttaattctagagaaggaataatgaagcaatgactgactctcctggcctgtaaaatgctcaaagaggttgggagatctgactgcttaaggtggcctatttaaaacaaatccaattatatcgtaccacagcctaggtggcccgcaggtgctccctcagagggaatgtttgctctaactcagcagttctcaaaccaccgtccctgagcctggttaccagcatcagcatgaacttgctgggaacagacccagcccacaaggcacacagaagcagaaactcagcagggggctgcctgtcctggaacagacctgggggtgactgaagaacagacctgggggtgctctgaagcttaaaaatggctgttttaccacaactcccagctagcaggatcacacgctcgaagttgttactattcaggttagtatggttagtattttggttaaccaccgaggaactcacacacgtggacaaacactgcttaccaaagggccggaaactgagactgcaccttgtttggctaacagctggctcatccttcatctgacacacttcatcacaattcagtctaacatttttaaatccatgctcttctgtttaattataactagtcagatatggcagtgagcttacaagagtggaggatccctatccaaagactaacatgtcaggcatcctcactctccctggagagctagacacaggatgagcgtgtgtaaagaaggtacatcgtggagggctgcacctgtatttccatcacgaacgaagccaaggcagaaccagccttttatatttaatcccgttcttaagccgcaagctgctgccgatatgtgatttgtatgttcttcttccgcataacacataaattaccaagatgagcccgctggatcctagcaggtatttccatttgagcctgtgcagatatttctaatccgtacaatacctgttctgttatacatcttgcaagtatatgtgtgttccaatttatgatgttcaaaattgaaccaaagccttcacgcgacctaggcagatgctatagaggttagcctagtgttttaaccacgccagcagcgacagtaatagtaattattgctatgtaattgtttttcttggatttttgttggagacagagtctccttgttgcctagaatagcccagagctcactatataaccctggctgactctgaacttcttactcctgagtgctagtaacatggtcatacaccaccacgcttggctaaacccagtattaaataaaatgatctctgcctgggtaatataaactttattgctaaccccagctataatagtacaactcatattaagatttatgaggtaattagtccagatcgtcaccattctaacaaagggatctctgataccaccttctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctctgctctgaagcaacttcttccattgcacctgcacctcagcctgtggttctctgggaagcttgggttcccagggagctggatagagcaccaggtgggtggcttagcagctggaagtcttgggttctaattacagtgacagaactccttagtattcctcctggcgcttcctgggccagatgctcacccaggtcttcctaacaattaactccttgaattcagcgagccctccccaaggcttctgccccttgctacctgtgtggtactgtggaggaccttgaagccccggcaggctaagccacttgtctgaggttctccaacccagcaggggtaggctgctttctctgctcctctcaacccagtgccctgctgccggcccttcagcctcatctcgctacagaaagatgaacggaacttaagtgagggtttaccagggagtagccattttgctttatgatcttatgaaggaaagcttgtgtgcccatacacacatatcctgagccagcaacatgactgagtttatattgcaaatacatattgcaaatagggggaggggagaggacagggggagggaaggtagtggtacattcctgggaaggctagagcaccatctccttttatcctggtgtttccagatcacccagctgacaaggaacatgctgatgttatcaacatgacttttgactctcctctaagtttccccagcatttattgcctagcgtgttttattttccacactgttccctaatttaaaacttcatttggtaaggctggagcgatggcccagtggttaagagcactggcttcttttccagaggacccagcacccctatgacagctcacaactgtatgattctagttctaggggatccgacatcctcacacagacatacgtgcaggcaaaacaccaatgtacatgaaataaaaataagtttaaagtcaacaacaataacaacaacgaaacccatttcatttgggagaaaggccctctctccagataagcgaactcaaggttctgagcccctggataaggtcactcactctgtcattcacttgctgttgggcctcagacaagcgagttcacctgtctgggtctcagtttcctcagtaagtgacaagaagtagaaacgaccacagagggctctaatatgcttctgagtttgtgtttataaagctcctagcaccacaagccagagttacacgtgtggaaaggagtgtttatggtatatactgagaaagatggtagctggtgagccaatttatagggcagatgggcttttctgtaattaaattaattcgatctgtttatgtattatatgtgcgtgcatatgcatgtgtacacatgtgtgccacactgttcacttgcaagtaagaagtcaagtcgttggagctagttcttgcctctgccatgcaggtcctgggtcaggctcagcagcaagcgttgttacccactaagccgtctccatggcccatgatttgttttggggtaagggaaatcttattctttgagtatcttaaagctttgaaagatagtgaaagtctgtgaaatgttcagactaaataaaggctcaagagacctgactactgcagttctgttctgaatccagtagtcttgggtaagtaatgctacaaataaataaaattaattaaacaaacaaacaaacaaaacaacagcacagcattagggactggggaaattgttagtgaagcactagctaaatggttctgagacccgaacttggttctgaagagcctgtgtaaaagctgggaggggctggtggcttccctgtaatctcagtgaatgggaggtagaggcaggagagttctcagagcaggctgcctagctagactagcagttaacagtgagctccaggttcaagggagaccctgactaaacattcaaatagagaatgatggaggaagatgtctgatgtgctgagtagtctcatgtcagcttgacaggccagagtcatctgagagttggaatgaaaatgagagttgagaaaatgcttccatgagatcaggttgcaggcaagccaggagagcattttcttaattggtgaatgatgtgggagggcccagcctattgtgggtgtggaccctgggctgatggttttgggttctacaagacagcaggctgagccagccatgaggagcaagccagtaagcagcacccctccatggcctctgcatcagttcctgtctccaggtttctgactccagtccctgcctttgcttcgcatggtgaactgtgattcaggctatgttagccaaataaaccctctcctccccaagcggcttttggtcacagtgttttgtcacggcaatagtaactctaactaagtaatccatcttcagtcttaggccttgacatgcatgtgcatgtgtgaccctcttacacacatgtatcctcctaaaacatcattgggttagatgagaaagttggaacgtgaggaggcatattgttgaaaaaaatgtctcataaattacctgctgaagctgatagctatatcgtgggtgtataagagcaaaaacatactgaaatatctaggaatgaagggccataatatatttatttccaaatggttgaagaaaacatatgcatgtgtaggagtgtttgagagaagagagagtttgaatgtgtatatagagatagagaggaaatggtaagaaaatgggggagaggagatgtccacaaaaaggttaatgtaggcaaataatagctcagtgtgctatttttagtcttgaatctttttttctctgactgggaagaccaaataaaaagttctgctttgattttaaggaatgttagcattttcttgtttgggcttctggttcaattgggggaagaagaaggcatcagaaaaaaaaatcccagtttggaattcagtggctcgacagtgttcattcatgacaatttcaatgtatagttggctttagaaataatctatgccaggaatgagtggctgaggcaggaggattgctgtgtgtttgaagccagtgtgggctacagtgaaattttgtctcaaaatccaaacacatctaacagaaacaagagttcctgcaaggcagtggtggcgccacctttaatcccagcacttgggaggcagaggcaggcagatttctgagttcaagtcctaccaatacttgctgccaccaccacacgtagtgactatggtatctttaggaggattcgtttagtgccaatttctcaggctatttcttataaaatgaacttgctaaaattctcaaatttcctttgtaattaggatccaaatttcattatttgactggggaaatgtgtgtattaaggcaagatcacctctgcttgtgtgtcttagaactgacttaaaacgacgtttcaaagcactagatgaggctgctctctaccagtggctatgaattaattcttcattaattaaaaaaatcattcctacaagcaaatagaatctttgaagctcaatcaagttaattttcattgtcgaattgtgatgcctttgaacttggcttattgaattagcctattggatggccaccttgaagatggttctgttggtgactctaagcccagcagcctctcagtggctcaacgtcccaccctgtcccattcatcttagttgcttaatgagcagctacaggcaaacactccctttccgttatatagtagctaaaagagatttgtactcaatgtaatagagacaacattgaaatcaagaatcctgatgttgccactaatgaggccgccagctctgtttcctcatttgcaaattgagggatttagatcatctctaggaatctggtattcacgtttcttagaaggtattattttattttacatgaatgggtgttttggctttgtgcatgtttgtgctccatgttgaaacttggagactgaggaggccaggagaggtcaataggtctcctgaaactggagttatggattggttgaagccaccatgtaggtgctgggaatcttccaaaggcaggtcctttggaagagcagccaacactcttaacttcttaggcatctgttcagcccctagtactcagaatttgctttacagacaggcaagtattcaaatgaggagcaagcatttgctggcagttggtctgcaagatgccctaaagatttttgttttctgcgtttgagccgaatgaagtctctgcccacaccaaataagaataatatgccaaagatatagcaaagttgatgaactatgacttcgaagaccagttcacaaagaccgtgtgacttgaacattgtcatttgctgtatcatttattctggacttgtcaggtcatagagaccttctaaagccccacatggaaggaaatccatgtccgtgaagagtgactgcagcaacctgctctgccaacactcatttaccaatcttggaaatgagctacctagaaagtgcatcctctctgcccagacaaactttcagatgactgtagtcccagtttgtgtcttgggcataacctcccagcacgtcccacatcaatgaactaagctccccccgaattttctgacccacagcagatgtgtaacctagagcattattacgaggtcctgagttttgtactgatttgaagtgtatcaagcggagatgcttgactgttgtgggccacctctgggtgtgtctgtgagattgaaattgaaaaagagaagatttaccctgaaggtgggtggcaccattctaggggctagggagctgagttaggagtatttacctctttctgcttcctgattggatacaatgtaccgactgacccatgttcctaacactatgccctccccaccaagatggactatattctcaaactgtgagcctaaataaatccttctttctgtcaggtattttgccatagcgatgaggaaagcaactaatgtacaagctataattaaaacacatttagtaacttttatggcaatttgatggagcaattttacatctaaattactccagtgataaaaaatgtggggcttttatttggtatgcctttttaaaattgtatgttccttgtcttccagttttttatggtattgcacaaaagcatcagtggatggtagattgaagaattaaaaaataattggccccattccatagtgagtttgaaagcattgatccgaatggtaccatctttgtgggaagttgaaaggcttttaaaattatctggtctaacctcccactcagtgataaattgtctcttctaggttttttttcccctggcaataaagttttgattcttggcagtgttgttacaatcaatgttactaaatgtgcctctctctgagtacttgccatgtaaatgcctaccctgggtatttatggtctgtacagcaacactgctcagcaggtatttccagcccagtctcatagaagaggaaattgaggtttagggtaaaacagatatttttaactaactctggccatctgattgcagactcaccgtatgacatctgggttcttttctgtatttatacccaataaacttcattttatataacaaaaatgatatgttctttctgatggctggaaattatacttattttaagaagaaagggacagaattggaatcttaaggtaacccatgaaaacagagtgttcaggggctggagagatggtttggtggttaagaccacctattgcttctccaaagaacccgagttgacttcaattcctagaacctactgctttggtgctaagatgagagaaagatggcagagagagctagaagctggctttggttgccccagcagaaacaagagaaactctgcctcaaaaacaaggtagaaagagagaataattcctaaaaagccatgtatgatgtatacacacacacacacacacacacacacacacacacacacacacacacactacatacacacagttaaaatgtataaaaagacaataatcatttctaccaacccgcataccacaaagatttgtttgatgctaataataaaatcttggaacatatctgtcacatagtaaatgctatgtagtcagccctccatatccataggttctatatgcaaagatttgaccaaccacagaccaaaagcctattttctaaaaccctgactctgtgtagattggttcagtagttaagagcatttgctgttcttgcagaggacctgggttccagttcccaacacccagatgatagctcacaaccatcagggactctaggtccaggggagccaatgccctcttctggcctccaagtgcactacacacaaatggcacacctatatgtaggcaaaacatccatatacataaaaataaacacatcaaacctgtatctatactgatcatgcacagaccttttcctgtaattggctctagtagagtacaataactcttcatatagtttcacatgaagtaacctagagatgatttatacaggaaactgtagaagttatatgcaaacactatgctatgtatgccgttttacacaaagtgcttaaacattcacagattttggaatgtgagtggagctgtaaag

SEQ ID NO: 1374 - DNA, 1552 bp, Mus musculus
tgagagacagagggaagctgagcgaaaatagaccttcgcgagagaggagggagcctggggagagccgcgcggtcagctccccgcccccaggccgccgccccctcactgcccccggcgccccgaccccggcgaaggtgcgaggggctcggggcgaccgggcggagcggctactgcgcgcgatcgggaccgggcggcggcggcggcggctgtggtgacggcagcgggaccgggatggaagggagcgcggtgactgtccttaggcgtggaggggcgagctcgccagcggagaaccgagcaagaggaggcgcaggagcggcggcgcccgagcacccgagggggtccgagtccaggcagctagccagccacgcgccacaaagggagcgcccccgccgcccggcacgccgcccccctccccaatgtcctcggccatcgaaaggaagagcctggacccgtctgaggaacccgtggatgaggtgctgcagatacccccatccctgctgacatgtggtggctgccagcagaacataggggaccgctacttcctgaaagccatcgaccagtactggcatgaggattgcctcagctgtgacctctgtgggtgtcggctgggggaggtggggaggcgcctctactacaagctgggacggaaattgtgcaggagagactatctcaggctttttggtcaggatggtctctgtgcatcctgtgacaagcggatccgtgcctatgagatgacgatgcgggtgaaagacaaagtgtatcacctggagtgtttcaaatgcgccgcctgtcagaagcatttctgtgtaggtgacagataccttctcatcaactccgacatagtgtgtgaacaagacatctacgagtggaccaagatcaatgggatcatctaggccagagtcccaggcacctgtggggaggtgttcagtgaagacgccgtctcggtgtggtcttcactcttaggctctttgggaacctgagggtgggtgaggcatttcttaggagattatggactcttcctgggcactaacgacatagcaatcacatgacataatgcaaaggctgagacttcagtgacaaaaaggaccagcccttagagagaatttatggtcacaggctagccatagtaactgacaagattagtggaggaaatatttggggaccagcatgcactgtgccatcctgataggcttccccaggtaactatcgattagatgtgaccttggtgttcatggactagagttgtgcaattaattttttcctggctttggtaactaccctgttctagtcacagtccttcacactaggaaaggaaagagagaagaaatagtcactctttttttctttctttcttttttccttggtcaccttcccgtggccttaagctctggagccaagggaaactgcatggaggtacatttcagttgggaatgaaatccacatctttcaaccagacaaatatttatagcgatgttgatgaatcactgtttttagacaccttcattttgaggtgaggcgccccacagattgtttctatacaaatgtaaatctc

SEQ ID NO: 1375 - DNA, 477 bp, Mus musculus
atgtcctcggccatcgaaaggaagagcctggacccgtctgaggaacccgtggatgaggtgctgcagatacccccatccctgctgacatgtggtggctgccagcagaacataggggaccgctacttcctgaaagccatcgaccagtactggcatgaggattgcctcagctgtgacctctgtgggtgtcggctgggagaggtggggaggcgcctctactacaagctgggacggaaattgtgcaggagagactatctcaggctttttggtcaggatggtctctgtgcatcctgtgacaagcggatccgtgcctatgagatgacgatgcgggtgaaagacaaagtgtatcacctggagtgtttcaaatgcgccgcctgtcagaagcatttctgtgtaggtgacagataccttctcatcaactccgacatagtgtgtgaacaagacatctacgagtggaccaagatcaatgggatcatctag

SEQ ID NO: 1376 - DNA, 53795 bp, Homo sapiens
tcgaaggctccaacgatgtcattaggacttggtcttcctgggcctctcttccttgccctgctctatttcatctttcagtcttggctccatacggtggcaagatagctgcagcaacatcagctacccaaggtgacccttctctgaaccaatcccagtggcctgggaggcaccatgctttgattagccaggcatgctcacgtggcctactctggaagttggatgtgggaactccaccaagaacacagggactaagagtaaggaaggaatggctttccaagggactatcaagggggagagatgggtgccaaggagccaaccatgccaagtaccaagagatgagggggtgctatgttcagattgtagctttgtgctgcacctttacacctccctgctctggtggtgctaacccacctccctggcccttctaaatcctgggaagggggactcaagtccttattcagaactccagcagcaggctataaatcctgtcccacttgcctgagccctttcagccccttcactcaaggctagtttccagattaccctaacctggagctggcgccatgtcctgcaggagacgggagagggcagagggcagcttcgggctcttaggtagaatttcttctttttaaattttaattattatttttttgagacagagtctttctctgtctcccaggctggagtgcaatggtgtgatcttggcttactgcaacctctgcctcctgggttcaagtgattctcctgcctcagcctcctgagtagctaggagtacagtcgcacaccaccaagcctggctaatttttgtatttttagtagagatggggtttcaccatgttggccaggttggtcttgaactcctgacctacattgatcctcccgcctcggcctcccaaagtgctgggattactggtgtgagccaaagagcctggccttacatagaatttctgcctatggatctcacttttctctgcattaatacttaccgctctgttttctgactctgttgccatcaattccccatacaacttcctgcctattccatcaggttgggctctgtggttattgtcacctgcctaaattgcacttgggttttactcacactcctttggacctaactgtcaagttctcaagagagaaggtcccatctctttggtcttatcgcagtgaatccttacaccaccaccatgaaatgggcattataattcctaccttttacaggtaacagaatagaatagaatagaggcatggcaagctaaaataacgagtccatggttacacatctggcaagggacagaactaggattcaaacacagccggtccgacactaggggctgtgctcctaacttctacatgatagtgctcagttttagggggagaggctcaggtgttacaaagggcttacccagagttggggaacagtcccaggtagactatgccaaaccaaaacagaaccatcaccaggagttggcaatgagttgtcaggctgtcctaacctagagattgggctcagccaatgtcaccaacagggaggaactcagaccaggaacacaagggctcagaatccagttgctaaggtccgaataacaagtgcaggtgcccaaatctggggagggcagggccggggagaaaggtgatctgccaggaggcaattgacctgcccccttaaatgcagatgtttccttcctcaagtgcatatcttggctcatgattcaacccctttatactcatagaatctggacctcaaaacattaaacagagatgtttactgtgggttgggaagggggacagaggtggagagctagagttcaaaaaccgtatgaagatgttttctgagctgaatacccccagtagggccacacgatgcccaggggactcactaggagatttaaggcatgtacagaggtaagagaaaatgagaaacaagaacatgaaaactagaagaggaaggaagacaaggccaaaaaaagagaaaaccgaggccactctagcgggaggtcagagacttgtgctttggcaattactggagttgtcccacagcgctgcccctcagaaacctacaccagggttggagggagccatgggtggacaggctgtacctgataacttgtgcttccttcccccagttttcccactctcgttaatgagttttgagacaaaatgtctctccccaggctagaagagcttcagtaacaagatgtccagagttagttgacactcaggtgaaaagcctcttgcagaaaggaatttttttttaatgccatcataaaacttcccagctcacctaggcctgccgtggaaatggtgcctccaaggacagagaggagatcagagcatctgatctgaagccgaggcataagggaaagttgggaatacacaatcctctcccagacagaatcaaacttgcctttctgcaacatctgattttgcaagaagtgacggactgagagtaggagaggaaaaggagagttcaaacaaggtcacttgacccacctaaccctgtccagaggaatgaagcctgagaaagcctcccagagacccgtcctcaatttcgccttgaccttttctgggtttatccatgtgcagcaggggcagctgtcccgaactaatcctctgcctaattcgagctcttcaccctccattctgtctcaattaaacaaacgcgggtctgccaggccgtttccatagaccactccctcacatgagaggcattccagcatctgggctctggagtcaggaagagctctgtccaaatgtcactctgccatttcctagctgagtcaccctggatgactgcccatccctacgcctctgttctctcagcagtgagttggggaaaattgtactcatctagaagggctcagagaaacaacagggagagagtgctgaaggcattgtgatgaaaaatattgctgaattattaaacattaaattatcaaaattattaatcgcattaaaatatcattacacacttacctgacccaaagtcttaatgatagggttcaagaggcttttcctcccagaggtgcagctttgaggggcttttgtacactggccctagagacacaggggtgaataagacaggtaccagctctcaaaggcacacagtgagcaggggccacaagacagcctaacgctcaactagaatcaatgctaaacatactatgacagataaatgtacagtgtgctctcaagagataacagtgcccacctaggaaacttagggagttgtcatttgatctgggcctggaagagcgagctggatttgattggatggattgttcttggcagaggaatgacatttcaggaagagggaacagcaggagcaaaaagtatgatgtttggattccactcgggatattgggaacacatgagaaggactagagaatgcagtctgttatgtgggatggcaggctaggagatgagaaaggtaagctagtcaagactcggaagtggctaatacaactgaaagtggtcccataggacaatgggagaactttcagtgatgatggaaatgttctacatctgcccgtccaatatggtagccactggccccatgtggctattgagcactttatttatttatttatttttattttttgagacagagtcttactctgtcacccagactggagtgcagtggtgcaatctcggctcactgcaacctctgccttccgggttcaagagattctcctgactcagcctcctgagtagctgggattacaggcgcacgccaccatgcccagctaatttttgtatttttagtaaaggcggggtttcaacatgttggccaggctcgtctcaaactcctgacctcaagtgatctgcctgcctccgcgtcccaaagtgttgggattataggcgtgagccttcgtgcccggcctattgaggactttacaggaagctagtaagactgagctgtgaaatttttagttttatttaattttaattagtttgaatgtaaatttcaatagccacatgcagctagtggctactattctggacagtatagccacagaacttatgacaatgactcaaggccctcatcttgcagtcccatcctcagcccataaaatgggagccccgcccaagctgctgctgtgattatgcagcagggtagatgagtttggggctgaaatataatttatttcctgcttgctaagccacgcactctgatgtggcagtgtctgcccagaggaagaggcagctttttctaattcttacagaggcatcatgtgggctagcagtagccctgcttcctctgaagtttgttgctcagtgatctgtctgcatgtagagtcaggtttcttttcatctcctgcttcctggagtcactgggccaggtacgcacacctggaacatggcccaggtgggatgtgctgggcactgactgttagtgatgctcccacagtgtgagaaggccgggtcctcagtatggctgtcagtgtaaagttctattctgcatcccaaattctgcccacaggcagatcctttggcctaaacttgaggaggaggtaatgatctctactttgaccacaggttgaaagggcagtcactattccactttgccagcaagagagcacatattatagtttaattctcacttggcttcctggtctatttctcagttgtttctaatacaaagaggaaaggtaaagtcatgatacttttttggagcctcctacctcccagcaaaaaggacatgcacatactttccaatcttgaatgcaaaagcggtgacatattcacgagccaacaagtacacacatgacattactgctctaaaacacaggcacagactgtcaagagttggaaggaatattgaattctaaaatctcatcataagatgaggaaacttgagtctcagagaagtttgatgatccgctcaagccaggtaggagccagatatggctagatcccatttctcctgaatcaacccatacctaattattaaaattaaaggttgcgaactggtagccattagttaaagtcagcctgctgatttttaattttttgtcctcagtgttggctcatgcacaacttaaaaaatatttttgccagcctggccaataaagcaagccccatctctacaaaagaaaaaaaaagatttttaaaaaacttagccaggcatgatgacttgcatctgtagtctcagctaataaggaggatgaggcagaggactgcttgagccaggagttgtagtctgtggtgagctatgatcacaccactgcactccagcttgggtgacagggcaagaccctgttttgaaaacaaaattaaaaaaatatatatatttggctttatttaaaagacgaaagaattcactttgaaatccaaattaacgaacatttctgggcctgtaaatctacatggtagaaggggctgaagcaatgtcgtgcctgatcctaccatagagaggataaaggggaggaatgagggatggggatcatttcagacactgataattcaagcagttaagctggatcacaaagtaatatatgctgctttcaaaatgtctagttcatgattcattattgcttattatgaggacttagagtttcaatctgtagaagtttcaataaaatacagatcttagagatcatgcagtcaagccaattcattttacagatgagcatcacaggtcccagaccacacacgccttcagataaaaacagggtcgcagaggtggtgaccaggccggagttggtggattcccctggctcctgcactatgggggcgctagatctgtcacattccttgcccctttacaaatagttttgggagcaaatccccaggaatgtttcttgtggattcacatgtatcaaggatactcatttccacaccaaaggcattgatgccccacctggcacataacagccactcaataaatgtgttagatgaatgaatgaatgaatgtgtaagtgtgaatgacctcaaaggtgagtgatgctgcctaaaccaaggtcatcgaaactggcccttagggcaccattccctgaagccaccagtgccatcatctttattcacagccaagcagctggccccagagctttgtgtcttgctcttccccagatatctcagtgaaaagcctttgattcaattttcactccctctcttatagctctcttgctctaggactccactgggggtccgagagctgttcttcctctgctatttcctgttgttcttgaataaaacaaatgccccttcaactttgcttctccatgggacatgttgttctccgagaggctccttgatcctgcaagtaattaggtctggaagggagggtgtcctattggccctccagactggttcagacatgtctagacccagcttaaattaccttgtctgttacacaaggatggtaacaagttggaaagaaaatgagacaagcactttgctgctgtctggtagagcaggtggggctcctgtttaacatttgctgatctccacttaagagcagaacatcatcagccttagtcgccatgctgaaatgggctctgtcacttggatagcgtttgtcagttgaaagctttctctccataaacatcaacagactggaaacccagtgaaaactttgtttttaatatttaaaaattaagtctccacatgcactctgggacagaggggcaataaattacaacttgctatgtgccagagattatactaattgtatatctgattaaattctcacaacagccttaagagggttttgtaatcctcatctgcagatgaaaagtggaggaggagagagtaagtggcttgcctgagtaagggccaagacggaattcaaacccagatttttgatgtcacaaagctagtatcctggcggggcgtggtggctcatgcctgtaatcccagcactttgggaggccgaggcaggtggatcacttgaggtcaggaatttgagacccacctggccaatgtggataaaccctgtctctactaaaaatacaaaaattagccgggcgtggaggcaggcgcctgttatcccagctacgagggaggctgaggcagtagacttgcttgaacccaggaggctgaggttgcagcgagctgagatcacgccctgctgcactccagcctgggtgacaggaacaagactctgtcaaaacaaaacaaaaaaaaaagctagtatccttctcttagtgttgccccctgcagaggaactgtttttttttttttttcttttaaagcaccctacatcacataatgtcagctggacttttctgtgatattaacactgggatcctgtaaaacactatattctgaccatagtctgacactctgcataatgaacaattagccgggaaaacatagtatttgaacctcctttgcagagaggaaattctcacaactccaaagcaatagtcagcccacagtcaatgccatctcatcacccagcccaaggctcggcctaaaaccttctagagggtctcactctaaagataacccaaaggtctcacagcttcctggttgcaaaaacgacaacaggagcaggaattgagacctaaagatcatttgggtagaaatgaggaaagaaatgacatgttaaatgatgatttttccctaacttgccttgttctttctagatgtggctcaagaacttgcagagttatggtgggataattcgactgatcaaatgctgaaagttttcctatcgacttcaaggctgttcaaatctctatgtactttgaagtctgaggcacaagataatttcccagagattcatgtttctatcgatgctaggctgggctgacacagataacccctcaagaggcctttccgaactgctgtataaactgtcctgggtccagcaataaagcaactgtgtcattatagttctctgcccttcagaagatctgatcttaatacccttctcttctttttgtccctctgatttcatcaaatttgttgccattctgggtgtttctccttctctccctgactttttctacttcagatcaaagaacttcccctttttcccacttttggatttgcgccctggaggacaacgcaaggttaacttccctcccacctcctcttgtaggcacacagggtgccccttagccagcgaaatctccgcgcccgagatcctctcacaatttcaggctggtgaattgtagtaggagacatggtttagtttgatgtggttaagtcagtcatcatggcatcttcgtaccctcagccccaaaccgctctcctactcatcaccctcactttcatttctttggattatctttcatcggcttaccaccagccttcacagcctcacccaaggctgaagcagggctagcagggtggtgcgtttccttccctggttgagctggtgactgctgtgggtaagcaggtccaatgtgaactcaattttacattgagaaagagaaagcaagagtgagtgggctgctaagactgttgcttcatggtttcccctaagccccagaaatagaaaggcagacttccgactggcagagcccgtatgctaaccaccagaccacactgccagataagaaaaatgttcgattgtgtcatacttccctcattggctccagtgtctgaaaatggccctgaatttcagagagtcttaccatgacccagggatttagagaggatcgaagagggaggacaaaggaatcaggcaccttctctctctcttttctggggtaaatttattttcaaccacaaaagtaaaggaaagaaaaagtcacaacagatgagttatgagctaactttctgatttgcacatgtaagagaaagaaatgaactggatatcattagacattgagaaagggagtctgcaagctagcaatgtatcttcggcctttttgatttacacgtgtttatttatgagtacctactgtgtgccaggcatgatgcttggtgctgccaattcaaagagaaataagacacctccttgcaaagtgagaaggcagaactagattcagattcacctagatttcaactcttgtgctcaggccaccaccaccaccatggaaacaattttgcttgactctcccggcgcagccgcggcaggcgtgtgtgttgtcagacactgcaggaagagtgatggcctgggtgttgacaggctcctaattggaaggtaggaggtgccaccagagatcagctataaaagatatctttggactggggtgggctgctaatgcttggaagagacttgtgggtgaggcccggtgagctgtcacctcggaattgggccttgcccagcagacagacatgcatgcgggggaggtagctgacagacaggggcgcatggggaagcagccattccagagaactgcaacagcagattgcaaaccaggacttcaggactcagagggggacaaggaaaggagagcctatagtggccccaaagcccagggtcagaggcagggccaggagagcagctgacaagagctttatggtaaggacaaaagagaagacagccggagtctccttttattcagctcataaagacccaacttctgtgcacttataactgttcagaccctgaggggttcaaaaaaagaaccgtgttaggagaattcaatatttaattaagagatgatcagatccgtgcaccgaaattattgctgggtaagacaatactgtgtgtgttacatagcattggaacttaggaaagctctttccttgtgttgtttaatttaatccactcaacaaccctgcaaagtgggtaccattgtccctgttttttatgaatgagggggtgaggtgctgagaagctgtgtacgttatttgagtttgtctggctagtcagtggctgagccaagttccaatccaggtcatgtgagcctctgaactttctgataaaacctgcagacccccttaactgggataatatagtcatgcattaagcaagaaggagaagtaaatacaggctgatggtgtaggggagaaattcaaagggagaaggcctaggagggagagggagctatgtgtgaacagaaccaaagatggcctctgggaattggaaggtctcttggaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctggtgagtaggcttcattaattctctgatgaatggacgattgcaagggaacttttttcatcttcaaggagccagaagaagtggtgattaaattggtcttttaaaataaaaagactccaaaggggtacaagtcttcaagcttcccctgtggtgttccgggcactctggcttctctttcggagggaggaagagcatctattcataggctgtgacttggagaggccccacggtgagtcaggcgcttgctgtgtgagccgctggttgctaatgtcttcgggaactgctaatttacccatctaatttgttcctgtacactggccacaaagggagaccactcaattattctgatccaaaagagaggcttgtgtttaccatgatctccccagcaactgtgtgagtgtgtgtgctgtgtgtgtgtgtgtgtgtgtgtgtgtgtgtgtgtgtgtttgcctaacaaccttaggcaatgacgaagaggtggggctgctgcccttgttagcattttcaaacacattccagttctgagttgagggcaaagattgtaatggggtgcttcagagaagccttggctcccaaggaggttataacttcaaagggtgtttttgaaaaaccaaggcggatgaggaaagtggctacaagttccttccatcacagaggatcaatgaaggggaacaaagatttgggagcatctactttgtgccaggtactgtgcttgggttttacacgtcttctcttgttgactttgcataactcccctttgaagcagatattactccaggttcttgccgtaatgtttcagcttaaagaaaaccaacccatacttctttaggttgccctgaaaaggtgaatcttctgtgaagccttttctgtctttatctgttaaaattaattaagctcttgtttgtgctcccagaaaatcactttagaccttagaaagatggcagcctcagttttctcatttgtaatataggggtacccatagggtcattgtgagaaataatagaaataaatcatggaagtgcttggatagtagctggtacttagccctcatcagtcatcattgtcattgttgttaagagtaataataataataatatcacttattataattactcacctctaggtttttaaaaaacttacaggccgggcacattggctaacgcctgtaatcttagcactttgggaggccaaggcaggcagatcgcctgaggtcagcagttcaagaccagcttgggcaacatggtgaaaccctgtctctactaaaaatatgaaaattagccacgcgtggtggctcatgcctgtaatcccagctactcgggaggctgagagaggagaattgcttgaacccgggaggcggaggttgcagtgagccaagatggcactattgcactccagcctgggtgacgagaaactccatctcataaaaacaaaaacaaaaacaaaaaaacttacataaatttatggggaacaagtacaattttgtgacaagcgtaaattgcatagtcgtgaagtcagggcttctaaggtatctatcaccagattgatatctattggtatctatcaccagattgatatctattgatatctatcaccagattgatatcaccacattgtacctattaattaatttctcatcatcctccccccacccttctgagtctccagtgtatattattccataccctaatgccatgtgttcacattatttagctcccacttatgagtgaacaatgtgatatttgtctttcagtgtctgacttttttaacttaagataacagcttccagttctacccatgtggctgcgagagacatgatttcattcttttttatggctgaataatattccattgcatatatatacaccacagttttaaatccaatcatccattgatggacacttaggttgattccacatctttgctattgtgactagtgctacgataaacatacaagtgcaggtatctaattatttcttttcctttggatggatacccagtagtgggattgctggattgaatggtagttctaattttagttctctgacaaatctccatactgttcttcctagagattgtactaatttacattcccaccaacagcgtataagagtttccttttctccacatcgccactaggttgtaagttccttgaatgtagggatcatgtctcttttcttcattgttttataacaagagcctaggagtgtttggcacatggcaagtacttgttttctagctgacagatgaatgaacaaatgagtgaaggatgcttcctcctcactgctgtgagcttctgagaatggacccttgtctgacctgcttctgtatctctagtgtgactgctttgtctggcacaacagaactgctcagcgattctgttgaacggatgctgctgcctggcccgtatctggcctggagagtctggctgcgagctcatctgtgctctggtctggctaaggttagctgcagccctaggaactcagagagtgtgtcctggacatttcacccctagttggtgagctcctcaagggtagggacggtgtcttgtttatttttaaattcttagtgcccagtacagtgcctggtacacaggagatgctcaaatggctacccctagcctctgaggtcccactgcactcaaagaagagcagagctccaaatgaccttgtcatctttcccctattacccaaacctgttcaatttccccatttctgtttattaaagatccattttctcagttacaaagatccaagactcctcgagggtattctaccctaacggaaataggacaggctttgtagtcagacttgaaccctggctttggcgactactagctgtcctgcctggagaagttgcgtacccttcctgagcctcagttttccctttcattgaatcaggatgataatacacacttcattcatccactcagcaagtgtttactgggcgcctcatacacagcaggaactgttctaggcactgcggatacgtagacgtcaacaaaacaaacattgctcttgcctgaaaggggcttacaaacttgagagggggagacagacaccaatcaaataagcaagtacacatatagtatgccagatggcaatatgtgctagggagaaaaataacacagagtgagggaaaatggaatgcgctggcccgggttattagtgtcttactcaggtgatgaaggaagacctttctaataagaagaactcacatctggggaagaatgttcccggaagaaggagaagagcaaaggccctaaagcaagagtttgaagaatgacaaggggtcctgtgtggatgaagcagagggagggaaggaggaagggagtgtaagagaaggggacacagagatggctagagccagatatgcagggccttataggactttggctttttactctgggcaagaaggaaaccttgggagagcttcaagcagaggagcgaaatgatctgatgcaggttatgaaaggatccccctggcagtggcacagagtatggcccctgacctgtgtggatggggcagaagcataaggctggccatttgcatcccacaaatgacctcagtgtgagggatgagcgagatcatatacgaatgcgcttgcgtgagtatgcatagagcaagtgctcaagccatggcagcttctatcaatggccctgcagctgcctggctatagctccctggtctcctgcagacaagtcttggccagtcacgtgagtgcctctgtcattgcccactcagtcattccccctgcccccacctcctttcttcaacccttcactggtggttaagctcctagcacagcagcctcacctccagcctctccccaccccaacccaacccaaatgcaactccactcacatccttcccctgttcaagagtcttccatggactagtggctcattaaatccacattcttggctaggtgcagtggctcacacctgtaatcccatcactttgggaggccaaggcgggcagatggcttgagcccaggagtttgagatcagcctgagcaacatggcaaaaccccatctctacaaaaagccaacaaacaaacaaacaaaaaacaaaacaaaagaacaaaacaaaaattagccaagcgtggtggcacacacagctgcttgggaggttgaggtgggaggatcacctgaactcagaaggtcaaggctgcagtgaaccacagtatcaccactgcactccagcctgagcaacagagcaagaccctgtctcaaaaaaaaaaaaaaaaaatccacattcctggagacttgcagctaaggccttccacaataagatgctgcatttacgtttcccacccataatcaactgctatcccaaacatattgaatatctgtggagaagtatgggtgggtgcaatatgtcactcctagcagaatcactgaggaaactgaccacactcatgatggaaaattgacggtaatgagtccttccctcaggttccccaaccccacaatatgccctaaccatggtggacatgtattcctgtctgtcactggctcacttctcccaccaggctaccgcaaactccacaatgatgtatattctcttaaagctacaaaatggcttgtggtttccaaatcagttttccttactgctcttatctcccttgatacttgcccctatgggcccctcatccataataaaatgccctcattttacacttactagttctgacaagagtcccaggttccaagtcatggattcccatatgggattgctcctctgatccttcattcctatatcttttttcaatctatccacaattcacaaagcatcggtgtcagaccaatggcaaataataagtgggacctgctggctatggatggaagagcgaagtccctgacaacatgtttctaccagcctggaaatgaggctctcccatcccctaacacatctaccagttgtgatggatttaaaggctggctaatgttaagcttgttccacaggggatagaatattggcccctggactgacacctaccaccatgtggatcttggagcaagacaaaggagccccccaacattcgtgttctgaaataacaatgcctgaggctgtctattccccaccacggatgccaaagcacagacagccactcacagctgtgggatacagatgcccctgtcattataaaaggccagccctaaatgctattacagagtctaaaaactgaaaatgttattgtgaaacctttaggttttttatagctggctatgcctgatatagctggtggcctgggacacagtttccctactcagcgctgggacacctcggcaatactgcacccacagtgtcatccctatctgtttggaatgtacaattcttctacaacaccatgggccaggaatatcacatcatcctgagcagccatcaggacaaacaaaaaggaatgtggtcctgtatgtttagtcccacctcccctacaaactacttttatcatagaaatgatgcccaattgtcagcccagcgcatgtggtgtcctccagcaccccttctaaatgtgccctcaagcaccccttcttctttgtgcatctttgtgacacccttccagatgtcagcctatatctccatgacccaaatctgacttaagagttgtggccgggcatggtggctcatgcctgtaatcccagcactttgggaggccaaggcaggtggatcacctgaagtcaggagtttgagacgagcctggccaacatggtgaaaccccgtctctactaaaaatacaaaaaaattagccaagcttggtggtgggcacctgcaatcccagctacttgggaggctgaggcaggagaattgcttgaacctgggaggcagaggctgcaatgagccaagattgtgccattgcactccagcctaggtgacaagagcgaaactctggctcaaaaaaaaaaaaggtgtaccagcccagggagacaatggccacattgcaggtgatgaccacagcccagccaaccactgcatcctggaggctgcccaccagttacccacatcatctaccaagggacccccttgctggagcacaaacagcttcccttgggggatccctcaatcagcatttgtcacatacctgaaaagggtggccaccacccaggccaccaaagttataactctctcctctcacttcctccccattgggcacaataaacctcattgccattgtggctggaacttcccttcctgggcctcccaaagcaattctactgcctaaggctatctccgggctaacttgtatgtacacagagataaagccacatcccagtggctggacctcatgcaatgttgggcctcctatctgcccccatgagcaggccactcccttatttgcaccacaaaaccaccaacaccaaacacttctggtctaggctcctaggtcttgccctgtcctatgttggctcagatgttatccagtctggtccccggctcatgagtccagatcatacatctatccaaatgtataaatacatgcctatgcttgtatcttcctaggcccacacagcacaactagtgtcatggcccaccccagatattaaaggaacacaagagattggaagccccagagggaacctgcttcacctgttccactcctagataacttcttcctgacgtcccaaatacctaaactcacctgcacactgctaagtctgacaacccccttcacatttttctgactgttctgcaatttaaccctgctggtcacagtccccagtcagaggtgatgggcagtcttcctacccattgtcctgggtataagcatgacttggggccagaagagtgggactaaggtcttacaatatgatcacaccaggaaaactagcagatacttcagagaaagatctgaggtcctatcagcccacgtaacacaaaaaacagcagcactggaagctttcactgaagggcaaaaacccctaactgccagggtggcagataagagactagctccagatgatatgccagcttcccagaaggagtatatgctctcagagggcatagtgtatcctgctggacgtggataaatattgcaaggcaaagtaatccaaatagcccaatggatgtaccaccaaacagaaaccaaattctacatgtggtactctgaactccctaggacttggatgtcccctatagcctggggtgaccttgttttaggagccctcctgcccacaagtagacttacatactgcactggctatgtaaaattggtacagcctatatacaagtatattagctctttggatggtgaaccaaatgttagggagtgaattttgaagaaattgagttgagtgcaaaaagttgctcccagcaaaatgtcatttgtccaaatagttaacacccactggggcagaaaccatcagggcaccccacccctcaccacccactcagccccactcacctctgcagcacctagtaatcatatgcaagaaaactcacccttactctttttgattgaccacccccagcctgacccccaatggagcagatcactcaaaattaatcttcccccactacctcctctcggcattattcaacaggtgggcccctgtcctatatctacgtaggtccccagcaccaggctctttctcctccccagaagtcagggagtcctcttctcagtggggccctcaaccagtggcttccctcgctgcctatgcctgcataagtaatacacctttgaattgcctgtgatcaccgggtcaggtgtggtgcgttttggcatccaaggcttttaaatgggagagaacagcagatctggttcctttcactggaatattgttatggtccaattctgcaaccagctgacttcattactacctgtgaactgcacctccagctcctccaactgaccccatacccagacccttacttgggctgtttcctaccagacacacctgctctgttaagaaaaccattattgaaatcaccggctgttaattcctactcagtccttagtagctctgtgagctggagcaagttctgtaggctttctgtgactcagtttcatcacccataaaattatgattacaatacttacttcattagagtgttgcaagggcctaaaaaacactctatgtatagctcaaagtacaagcctgacaacaaaggaagtttccagataatcgctcatcaaggggcaactcgattttctgcttcctccagaaagccttccatgctgatgtccatccactctgatctctccctaatccaatctgattgcagttttgatcagcacctcactgttgaccatggatttcttctccattacaaatgtgttcattttgacttccaagtaagagataaaggtcttggaaagaagtgattgcattttacctggctctcctactgactttctgtgtcatcttcctcttaattttggggagactgagtttctttctctgggatggcaaatacatggcctatgtgccaacactttcccatcctgaaacctcaggacacacaccagtgttctcatcttctctccagaacctgggtccagactcacaattcttcttaacacaatactttggacagtgtctactaacttatctaataaatatgttttgagtacttcgtaggtaccatcccccttggtcagtttctagaagttaaaacgttggacatcttgtatctgcacttatggaactcatcccttagtggagaagaaagacaatatgcaaatacacaaataagaaaatatcaagtagtgacaaatataatgatgaaaattaaataacggtgtgttagtgcctggggaggaggctattttttagatcaggtatccagggaaaggccttctgaggtttctcccttgatctgggagattgggtgtgggcctaagaatatgtattcctaacatgcaaacgtaggaaatttgggaaacactggcatagtgaatgaggtgagggcatagtcagaagacctaggtctaaattccgtctcctacatttatgcagctgtatgaccctgggaaagttattgaaatttctctctcactttcctcctctgtaaaattggaataatattactgatctcaggaggttttttatcaggattgaataagatcaagtatttaaaatgcctggcacataataagtgctcaataaaaggtaggcattgtttgcaacaattaggtctatctatttataactgtaatcttttgtttgaatcactcaagagacaaatccaataaatgccgctaggtaatacggtgtctgcgtgttggcttttgcctcatgaagctcttcctcttgaaaaataaattttcaaaagacattcctgtgagcaagaatgcccgagtctaaggaacaagggtcatccagttctctagtttaggcatgtttgagatttgaaagggctttggcctaatttcctctcctatcaaatgggcaccaggctacctgccctttttcactcatgggggatttctgagactcagagggataagagatttgcaaagcgtgagacacaaacagttgcagatacagacagaacacttgctttctcagaccggcaggtgcatacaatggcaaggccacctgatacaccagtcctgttcatttggaaaagggacaactccttcacattcacaagctgggctggtaagtgaagaataagaagaaaaaaaaaagaagtcggcaggaagcagcctcttcaaccagcaaagaaaccgttagaatccatccctgcgccctgatgccaaagttccgcctgccccacccgtcacgctatcaaggacacccgcctgctatcagaaagccctgggggtctttttccctagtttatcaaggacctgtggaaacatttctctaactgaagataagaattttttttctctctctttctcctttctacttctagctgtctaaaccagagggttcctctcattttctttcagtaacaactgctctgaaaagaagatatttttcaacctgaacttgcagtagctagtggagaggcaggtaaggtgggtttcattaattcatttgttcattcattcattccttccattattgtatgcttcctgcatgccagaaactgggctaagaaggctcttggatttaatcctgggcagaatgagcttgaggtctttggggaagccagactgcacttaacaattacaaaatgcggaattgtaaattgtgatctgaacttggagtgagagcatacatatttgagctgagagacagtgtgtataataattttttagatttggctcttgccctccaagtggacgttttcagggttaaaaagatgcctcagagcctagatgacttgctaccattccgtgccagccccgtctcccaacccaagtcacaattgcttgacccttgtgaaggcgaggatggaaatgacttgttggagtgatagagaggctagcataaacctgccaagacctccttcaagatttggttcattttgcaaaagttgccagataaaagatatttccagatggagggccacgcaggaaatacaaatggaatatttgttaatagctcttcctttgcgagatatgacccaaggcggccttctgcaatgtgatgggaagcactgtagcttgaaagcgtgagaggagtcagcaggcccacggcagtctcgaagtctttggaaaggggctctggcctgagcaggcattaaagatgctctgctcatcagagacgcccccttttccaccaccaccatcccaaatggagatgggacctgctatactctaagtattggattctcagacaggaggccagatatctagaagaatattgagctccttaatgctgtggctttgcataataacaacctgcactctttttttctgtccttggagtcaaatgggcttctgcaaagaagtttatccagaagtcagggatgagcactattcgaaaagtcctaagtgggcagggattgccactgattgcactgaagaatgtgttggagctcatgagactggcttccccataacatttggttgtcgaatggttccacagatgaacctgagaagaccgtgagctccctggaacaatatgtaaaattttgcatgtaggaacagagctacacctagggaatggtctttaacttttgtcagatttgtttggggcgtgtgggggttaaatacgtacatcgtaaaatttaacatttaaccactcccaagggtacagttcagtggcattaagcacataaatattgttgggtgaccatcaccactatatagctctagaactttttaatgttttccaactgaaatgttttgtccattaaacaataactatcccctccccctagctcctggcaaccaccattcgactttctgtctctatgtatttgtttaagtacttcacaaaagtagaatcatatatagtctttgtcctctcaggactggcttatatcactcaatgtcttcaaatttctttcatgttgtagcttatgtcagaatttcctttctctttaaggtggaatcatatgtgtttgcatgtatatatatgatatgtatatatatgatatatatgatatatatcatgtgtatgtatgatatatatatcatgtgtatatatgatatatatatcatgtgtatatatgatatatatatcatgtgtatatatgatatatatatcatgtgtatatatgatatatatatcatgtgtatatatgatatatatatatcatgtgtatatatgatatatatatatcatgtgtatatatcatgtatatatatgtacacataaaatagtatgcgtatatcactttaaaaaatccatctgttgatagacacttggttgcttccactttctggctattgtgaatagtactgctgtgaacatgggtgtacaaatatttgtttgagttgctgttttcaattcttttgggtttatgtccagaatggaattgctagatcatatggtaattctgtttttaattttttgaggaaccggcataccgttttcaataatgcctgcaccattttacattcccaccagcaatacacaagtactccaaaccctccagatcctcaccagtacttgttaacacttgtgcattagccatcctaatgggtatgcagtagtatctcattgtagttttgatttgcatctctaataattagtgatgtagaacatcttttcatgtgcttattggccatttgtatgtcttttttggagaaatggagattcaagttctttgcccattttgaaactggattgtttaaatccagacagagcttgtcttgctctgtcgcccaggttggaagcgtgatcttggctctgtcgcccaggcagtggcacgatctcagctcactgcaacctctgtctcccttcctgggctcaagtgattctcctgcctcaggctcctgagtaactgcgattacaggcacacaccatcacgcccggctattttttttttttttttttttaagtagagacaggagtttcactatgttggccaggctggtctcgaactcctgaccgcaggtgatccacccacctcagcctcccaaagtgctgggattacaggtgtgagccacagtgcccggcctatatgttctagatcttaatctcttatcagatatatgatttgtaaatatattattccattctgtgggttgccctttcactctgttgatggtgtcttttgatgcaccaaagttttaaattttgatgtagtccaatttatctatttctaattttgttgcctgtgcctttagagtcatatccaagaaatcttgctaaatccaatgtcatgaagctgttcccctgtgttttctttaagaatgttatagttaccaggtttttaaaaggtttgtgacaatgcatgggctatcttcaataatgattctggagtggccttcctcaccaaagcaaagacactcagggctttgtaaatatcagtgtgaatctaggaactgggcaattgataacatggatgtgatatttgaaggcttcaattcaaaaggaatgattaagtatctccatatctatatcagtaccctgggagctagtgaagatgaaaaccatggtctctcttctccaaggacttaaggcaagatgttgcaggcacacacgtgaaattattgcattgcaaggcagaatctaatgaggcacctagctaggcactaggaccaagggctataagaactcagaaagggatcaccaccatgagcttcaggggacagagaaaccttcagggtaaagatgtagcttgatctgggtccacattggacaagatttggagaagcagagaagactggagaggaatttgtactaactgcaataatcattgccatttactgagcacctactatgttccaagcactgtgctctgcccactgcatacattatctcaatgactactcctaaccctacatttatcattgtctgtattttatcattcaaagcactgaagctcagagattttcctaagatgacccagatagtaagttgtaaagcagagacttgaagccaggtttatttatctcaaagcctctactcttaatcactctactattctagtaccaaagctttagaacagggagaaagcagacatccccgatagagagaaaagagtaacacagtgcacagaaatggcacaagcaggatatttaagatcagagaggagaacaggctggatgggaaggttcagggtccaggactgtgggatgtaaagttggatcaatggagtgagcaggattacagggtgcctttaatggaagcatgggaaatttggtctcgacctgctagaatgacagaatcacacatagaatttcagctctaaccttccagtctgcctcttttctctataaaatgagaaaattgaggtctcaagaggttaagcaacttgtggatggtcatggacgatagggaactattgcaaattcttgagcatggtgttgacagggaagaaaacagtattccagatcagttagtgtggcagtaaaacacatgaggggtgactgaagggaagcagcaaaaactggcagaaaaaacaagcagctctttctctgttttttttttgccaaaggatacctccctcaacaatgggcattcctagggagcatcattaacaagattccagctctactccttcctgctgaggtttgtcgcttaagaatctggagacaggtagggtgcagtggcttacacctgtaatcctagcactttgggaggccaaggcgtgtagatcacctgaggtcaggagttcaacaccagcctgaccaatatggtgaaaccctgactctactacaaatacaaaaattagccaggcgtggtagtgtgcacctatagtcccagctactcaggaggctgagacaggagaatcacttgaaaccgggaggcagaggttgcagtgagctgagatcacgccaccgcactccagcctgggtaacagagtgagacactgtctcaaaaaaaaaaaaaaaaaaaaaaagaatctggagacagcttgtaggggcaagtgctatcagaaaggtcagaatcaccttcccctgccaggctcagtgccctttgatggcccagatgccagaaaacacagctgccccagcagcgacctgtcctcatcctccccacttcctccaatagaaagcctgtctagggtgcaatggcttagatcagagacacgtgactctgaagagccaatggccaggaatggcttctggcaccttctttatgttgccttcctgaatgtgagcctgggccaggcctctgtgaacctaactcacctgtcccatggaggccaccataccaggagaggtaagacaagacactccgttccccaggcaagaatgttgaccccaccttacttgaactaagcccttgtagggcagaactccacttatccatctatgtccagccaagaaagccctgccctggttgactattgtcctctgaggttctctttgcttagttaattctaataatagctgccatccattgagcacttattctatgttgatcactgggctcagcatttggcatgcatgatttcattttattcctacaaccccataatgaagatattgttatccctgttttgcacatgatgaaactgaggttcagggctgttaaataatttgcctaaaaccatgtacttaaaggagccaagactcaaacacaagcctttctctctccaaagcctttgcttttactcatatgattgactgcattctacactttagtccttgtagagggtagaggttctgcagtggagagtcaggcttcaaagagtggccttgttaattccagacaccacctgtttctctgttcctgggagccaagagcctgatctctttcccaaaccaaactcttggttccaaatataaatggtatctggaccattattcttctcccagtaatgatgctcaagaaaaacaaaggaccttgaagttccttctacactttcacccagagggcatcatgcaggcatgctttggccaaggggaatggtgctgccatttgtacagtcattcttttaatgaatatttattgagggccagccacacgttaggcacgttctaggtgctgaagacacaactgggaacaggtcagaaagagtttccaccctcacagagtttacattctagctgggaggaaaggccaaaacaaaacacacaccaaaaccctgcacatacatctgtagtaaagagcaaatagtgatgatgctaggaagaaaaacaaagaaggataacggggatggagagtgaggagaagaaggattttataaagccctctgaggatgaaatatttgaacagagacctgaatgaagtacatgggagccatggggtgatccagggggaaagcattgcaagcagagaaaagggcaagtgcaaaagccttccagtaggagtcagcttggtttgttttaagaaccagaaagaaggccagtgtggttcaggcagacagagtgaaggggcatgctggagaaaaggacaggggggcagcagaggccagataatagggccttccaggccacagtgaatttggatctcaaatatactgtgccggggtcccaggcactgtggtgtgtcactcaggtgtggcacctctgcatagctacagagaggagacaggctgcctaaacaaagagcacaaagacagctcagtgagtcagctcacctggctctgactcccaccttgaacttgaagcagcaaataaagcccagggtttggtacccaaaggagaaggtgggggaaggtttgacaatggcctgaggtggaagaaggagctgttgaccctgtatgtctcatttgctttgtccatcaaagggtctgaattatcaatgggtgctcaaactttttttttttttttttttttgagaaggagttttgctcttatcgcccaggcttgagtgcaatggcacggtctcagttcactgcaacctctgcctcccaggttcaagcaattctcctgcctcagcctcccgggtagctgggattacaggcgtcagccacctcgcttggctagtttttgtatttttagtagagatagggtttcatcacgttggccaggctggtctcgaactcctgacatcaggtgatccacccacctcagcctccgaaagtgtcaggattataggcgtgagccacctcgcccggccgcccaaacattttaaagttagaatctctttttataagcaaaattttccatagaaggtgactgtgtgccactttcctctccaagcacctgatctgcttcatttcacagaatccttagaacagctccacgagtaggtactctgaatactcccgctttacagatgtggaagctcaaatgcagagaggttgggcaacatgcccaaggtcaatgaatgcagaactgctgcagtgggagcaggggtgggtgacacccactagggaggtgctttcaaactcctactgctccaaggagcaagctagaaaatcccacttctcaggccccttccactaggacacactatgagcttaacactgctaagaactcactgaggaatggtgacatttgggggcggctccttcagtgctttgtttggcttcttttttaaattataaatggtggtttgaaagttgttggaggggaaaatcagatgaaatcagggatgtggctgaagcagtcagtgtagcagtgtagcagagaagcagagaagctgtcagcagcctacccaggccccgaaatgggcacagccctgcatttctggcctgaggcttgccgaggtcttaggtgaacttcagctctttctacagcaccccagtctcagcactctttggtggatgtcctgattggctgggagattgttgcttcctgatacagtggtgattacttctgaaagatggggtaataccaacagctatcgtttctgaccatttactgtgcagcatcactgtgcaaagtatttttatacatatcctattgactcctctcaaaactcctgtgaggcaagcaggcaccccagtggcctcatcctagttctggccctggtgacattatgattgcctccatcctccatttgataggtacagaaactgaggttcagagaagtgaagtaaattcccccagatcacgcagctagcaaacagctgagcttctatgctcatcctaaggctcggttgaaatggattttttaaaagatgtattttgggctctttactatatagaaaaccgaatctgtttatcactaaggttactaataggccttacatctgtgaaaacttatctgtcagctggccctgaaatgttctgaaatgagtctgagcacaggatgcctgtgacaaccgaatagtttaaaaaaattctccatgggagccgaaaccctattaagacaggtctttatttttgttcctgaatgccacatttagaaacaaaatgtcatatttttgtatatgaatgtcacaagtgacaaagcatatgttgcaacttggcttctaatggttgaaaaaaaaagagaggtaaattatcataatgttgggatcttctcaattatatttgcattttcatttctatcagaagtccattttagcaaaggaatgtaaccttagtcacttgaaactgctgttcccttagaaaacaattgtaaatgtaataagcaaaaaggatagaaaatgcccacaggggaaaaaaatgatccatctggggtcagagccatcgtgtagattgattcattcttcttctagcattcttattcaggaaggaaaacttgaacattttctagattttaggatatttaagatttgcaaggaattgggggaaagggaaaaggaatgaaatttcagtcccactggcagggatcaaatagagattttctcaacttttaaaagaaccgttttacatgtcccaatcacctcatagttcctgagtctctcttctgcataaggcatgtactagttgttaagggaggatacaataaggtcatgattgctttaaaattattcataataaaaacacattttgagacttgattctaaatgttaaacttaaatttgagcaatttaattgcccgttgaataggaatgaaatcccaccggtaggcagttatttcttacaaccactgtgtgtgaaattgaaatcttaagataccatttcaaatattcaccttctctaaggaagttctccccaaagagttgtgaaagataagaaactgacccaaagtcatatgcagtaatctctttttctttacacactcaggtcaaagtagaagcatattattaaaaagaaacgttatgccctgaatttggctgttctgaggttacctcttggaacccaaggatatatttaatttaaaaactgacttgagccccatgcaaaactgtgacaaggaaagtaataatttatcagattaaataaaaacaagcagatgtggccaggcgcggtggctcatgcctgcaatcccagcactgtgggaggctgaggcagatggaccgcctgaggtcaggagtttcagaccagcctggccaacatggtgaaaccccgtctctactaaaaatacaaaaaattagctaggcgtggtggcgagcgcctgtaatcccagctactcgggaggctgaggcagggaaaatcgcttgaacccaggaggcagaggttgcagtgagctgagatcgcaccattgcactccagcctgggtatcagagcgagactccatctcaaaaaacaaacaaacaaacaaataacacccaagcagatgcaaacaggtcatttagtcaccacgataatgaacgttaaaatggaaaacacttacatgttttatttaggagaagaagggggtgaggtgaaggaatcctgtttcctgcttttaaaaaacaggaaatagtttccaaatttgggtgggcaattcttattttaaacccccatttcacctttaaatttaatttcaagctcttttaaaattatcttaatgatgccctttactataacatagcagctgccatttatgagtgcttactatataccagttgcttttcatgcaagcaacttcatatctgttattacccccatgccattacaaatctatgtgccacccttttgtgcactaactcatataatccccacaataacttaggcaataggttctgtcgtctccattttacagatgaggatactgggagtttatttgtttgtttgtttatttattttgagacggagtctcactctgtcacccaggctggagtgcaatggcgcgatctctgctcactgcaacctctgcctcctgggttcaagtgattctcctgcctcagcctcccgagtagctggggttacaggcatgtgccaccacacctggctaatttttgtatttttagtagagatggggtttcaccatgttgggcaggctggtcatgaactcctgacctcaagtgatccacccgcctcggcctctcaaagtgctgggatcgcctcggcctctcaaagtgctgggattacaggtgtgggccaccgagcccggccaggatactgggagtttaaattcctgctgtgagcccaggttgacacagctggtcaaggatgggttagaatccaggtagtctgactccagagctactaccgcatactgcctcctcagattaaataattttcctaggacatgctaactgataagtaagagtctaaatcaaacccaggcagttgggttccaaaattccagcgtttaaccaccacattgactggttataagtaggtaaactgttcatcacaacctatatatttattttcatttctgttagaaatgaaagtagtgtggtaggttacatatttatcacatagtttaggcttgcctaaattctaagtattttcttttttaaattaaaaacaagggtctatcggaaaaaaaaaacccaactttttttttttttttttttttttgagacagggtctcactctgttccccagactggggggcaatggtgcgatcatggctcactgcagcctcaacctcctgggctcaagcaatcctcccacctccgcctcccgagtagctaggatttcaggcaagcaccaccacgcccagctaattatttttattttttattttttgtagaaacagggtctcactgtgttgctcaggctagcctgggtctcccaaagtgctgggatcacaagcatgagccaccgagcacagccgaaaaagtctttttgtatactgaagtctccactaggacaaaaatttgctcttaaggcttcctttgggacacacacacacacacacacacacacacacacacacacagcttttgattatacccattagggacccaagccttgggacacagggaccagaaaatgacaagagcatgcaggcagtagtaaactctggttatacttaaaatgggaacagaaatgtatgcctatgatccagactgatcatataaaaccatggatcctgaaagtacgttccctctttacaagccttaatgactggcatcacgcacaaataggcctttcagcttctgaacgcagatattttcaaggaactctgaggcccaggagagcctaagtttttctccacggaagggcaaactactagcctcccccgcttcccctctgcgttcctgcctctttctagaaggaggctgagagggggaagcctgaacccccaaatcaagtccgccttctttctctgtgcctgacccagggcaaaataatctctctgatcctgttcttgaccattgaaaaagcactttctctggtcgggatactactggcactttacatggggggcagtttaaccgcaggagtccgctttctgaaaggtgcagagggaggggattccgccaccagccgactgagaggagccccggccccgcgtggtccctcccagccaccctccctctgggattagctgccctggctctgctctaggcgtccccagcccgtgcagtcccggctggcgcaccaccatcgcctctgcagagcgcggccgcagcccggagcccgcagcccggagcccgcagcctggggcccgcagcccgtagcccgcagcccgcagagccgcgctgtccggggcatcccagtgcacggcgtccgtggacctgggacctcgaacctgggacgggcggaaaatccactgggaacacttgcatttctgtaggtgcttatttcacattcttgtcttttcttgcttgctcgagctgttcgtgggttactttctgccttagttaaaccaaaagggaaaggcggaagaggggaagccctgaagaatgatttagtggttgcccagcctcctttccaaggagaggtgttcgctgagcggctctccccgtccccgacactggcccctttaagaagccaagtcagtcctgatgctgctgtttgtattgctaatccccaggagccccgtttaaaaaaaaaaaaaaaaaaaggaagaaaaaaggggaggtggggggaccgggcagctgtctctttaaatgtgatttccttctattgtatttgaatcgtgatcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccgggccgaaggtgcgaggggctccgggcggccgggcgggcgcacaccatccccgcgggcggcgcggagccggcgacagcgcgcgagagggaccgggcggtggcggcggcgggaccgggatggaaggttaagtcctgagcagcagcagcagctgcagccgcctggagccaggctgcgcgccccggcccccgcctcggccgcggcgcgcccgcagcccggtgattcgctctctctctttggcgtttgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagagtaagtgcggcccccctgcccctgccacccccggtgtccacggcctcgcgtcccggagcgtcggggggacccgggcggcccgcgagggggctccaggtgcgcgctcgcggcgtgcccttggccccctgtgccgagcgctgggctcctccttcctcccgggtgattccgggggctctgggagagggactgggcggcgggcggcagggacaggggtcggcccggcgcctctgcgggccactccaggctactgggacgctccccaaagccaccacgggccagaaagtttgcacgggagcaggcacgaggagagcctggaggcgcgcaggtgcagtccggagagcgttctgggcttgactctgctcccttcttccctctccttctcggtcctttctctttgtccatttggtcttggaaaggggaacattccaagtggcggcctccggggtccccaacggccgccttcccggtccgcaggtggagccgctgccagccttgcggataacgggcgggtgaggggtccgaccgtccacctcggagctggctctgggcctccagggatttctagagcagcgaaatccggagtaaatctgagtaggtgtacccctcctcggggtccaccgatggggacatgtgaacctcgaaagttaatgcaccattttgtgtataggtgaattattctggggagtagagtctcgtagtttttagcagagtcttaaaagggtttggggtcagggaaccagagctctaatgagcattggccgcatctgttttctgagccgcgtactggtttggaatgtttttctatccctcacccattcttcagcgttaacatggggagtaaggggtgtttaagatatcattttcctgtcaacgcaaatgcccttttaagagtcattagctgtctggttttgagaatttttattcctttgaagtccccctctaatcctttgaagggatttgttacacaagaccaaaggagctggttaatgacttgtccatttgtgcttttaagagacatttgttttgttttttcttttcctgctttaaaagaattgtgctttcctgcttgaaataccgcacacacacacatacacccttcaatttcggctttctatggtgtttatttacctgggttttaccctcagttaccagcataaaagctcaacatattctcataaaacacaggaagtaccaccatccaatgagaatataaacatcactattcagtcttgaaggttaagacaccagttctgtaatgagctaggtttgttataacaaaaacccccacttccttcaacaaattctcaggagaaaaataacattcctttttaaaagtatgtttatgcaaacaatgggtttaaagggtggtttgatcacttttttaaaataaacttaaaactgagctctgagtttcagagactgggcaagatcatagtaacacaataagggagtgaattggatgaattggtgcctcatgcctttttgatcagcagaatttagtcactaatcctttcaatagaagattaatctgaaggtttcatttccctgaaggaagtttgcttctttcaaagtttgtgctttttcactgaggttagaaactgaaacatcctaacttcctaatacaacagatatctactgctggaggctcaccagctccttccttcacttcactatttgcccaacgaagacagattctgatcaaagagggacaagccagttgagaaattgctgcagcacattctccccatgcccttagaaattgttatgattgtcccagaaatccaggcttaaatgatactcaggtgtaatattcaagataagggtctgggagaatataaaatattaatttgagggtgaatcaatctaattcagtcattgtcttggattgtccactaagtataatgtgatattatcattaattaagtatagaaagacagagccaatatcttatactttacttctccatctcatctcaggccatcaccgtaactcttttactttacattcctcctgttgtccagtatcctactagatgcttcattgtgtacttcctcaaatccagcttgggtcattacaatcagcatctccaaattacagatggagacttgcctagctatatgcaaatgaaacatttggacagaaagccagccagaattcatgaacacagattcccttgctgtgctactggtggcccccactgcctcccctgtgagtaacaagagcagttcatttgaattccaggcagttttgcaccagctaagggcaaattctcttctttcacagtcctttggcagcatcaacatcgggacatccaatgtgcgtccaggttccatgagtggttttgaaagcccagagtaagaccatgggctgtggaaagagaagagatgcaactctgagttgatacacatgaaaaagctagggtattagttattagaaggggaaatggcagtccttatatacaatctgtagaaacaaaggaaagaaagcaaggcttcagtgaatgaaacctcgtctctacttaaaataaaaaaaattagctgggcctggtggtggacacctgtaatcccagctattcgggaggctgaagcgggagaatcacttgaacccaggaggtggaggttgcagtgagccgagattgtgccattgcactccagcctgggcaataagagtgaaactgtgtctcaaaacaaacaaacaaaaaactatagttttgaatttttttgagctagggtctcactgtgttgtctagtctagagtgcagtgctcactgcagcctcaacttcctgggctcagatgatcctcccacctcagcctcctgggtagctgggactactggctcatgccaccaagcctgggcaattttttatatgttttgtagaaacaggattttgccacgttgcccaggctggcctcaaactcctgggctcaagtgatcctcctgccttggcctcccaaagtgctgggattacaagcgtgagccactgtacctggccattttttttccccagataaactaacttgagcttcccattttcttgttccaaagatgatagtctcatgaagtgctgttacactgtgtctagaaagtgtgggcatggctttagcactcctaaatattcataaggaacacttcatacttcacatgacgggatcacctgaagttgtcagagtgttatagacattgagccacctagcctcctgtccccaagtataatggctgctgggctttatgggcacagaccaattaggacacaaggtcgcctggtaagttagtaccagttagaaataggagacatggatttatacctgcagggtacccaggaggaaactccctttgggaattttacagatggaagaaggtctgttttttgaaacataatagatttttaagaaatagatttgtgtttaagtaaggttccagagaacacttgctaattattataaatcaacacgtattaagtgtttgctgtgtcccatgtgggggacactagaataattccttccactcctttattttcttttagcaaagttatttatttttaaatgtaaaaatgtattcagattccagtgaagcaaagtgaacaggagatgctatgcatggcgtattaacgaaagaacacgtgtcacagcctattaacaattgctggattgagatgtcagtgtctgtttaattgccttccactctctttgaaataatcattgcccccacttcattttcttcctcaaatcaactttatccaaatcaattttactcttataaaaatgttcaggtaaggaaagaaaggcctatttgatgtccttcgtgtaacaatggccttacgatatgggattttcctccaagtattccttcagtaggaagaatggaaaatggaatttctgtaaaaaagtaaaattaggagaattcctattatgtcctgatggaattttgattttggaaagagaaagcaacctaaaataatttttggtctcattcttctttcttcctcacctctgcttttgtgcagttggttagggctggagggaggatggcactggggatttgcagattcttagcactctgggtcatctgctgccctggcagtgagcgactcttttagtccagagtgcgtcctttgaggttaggcagtgcccttgggtgtccaggttatgggaggaggaaaatgagggagatctgtgaagatagagtcagcggggagagtgggaaaaagcagaaggagaccagaggtgcccaggtagtgctgggcatgggcaggggcacagtgccacctgcaattgcctttgatgcctcttggtgccctgtgtttacttcttagacatctagggagtaaggtctggctctttcccatcttaacccaaggttggttgggactctgcagtctggccaagggatgtgttgtcctgtcccttctcccttaggtcactgaaaggcagtcaggtgagatgccctgtctggcccaaaacgatctcggaccctcggtgctggtctcactctggtgaggctgtccctgatgcttggccttctctccagggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggtaccctccccggcactccactgggccctcggaagggaggctgggtggtccatggacatctgcagtcggtgtgtgttgccccttaccctgctccaggctcggacaccacctatagaaagaggtcagactgcagaggctgagtctcagctcctgtgctgagaagcagagggcatttcttcctgtttgagaagcatgttctcagggttacgttcctatgtggtaaaatactaatatctttaaaggcaagagaattgtatacccaaaattcagaaaagtgcttcccttggggagcgggagaagctaggggatgggattgaggaggagtacacacggaggatcagagggactgggagtgtttctaagtttggaggtgggctctgaggacctcatttgaatgcttcagaacatatatgtatgttataaattttttttgtatgactccagtattatatgatgagaaatttaaaaatagaaagcatatggagctccaagcattgactcatagcaggaaggcagtcttcgaagagcagaaaggcaaaggccctgtaggcagttggaggtttgagtcccaataccattgcttcccagcttggtggccttgggcaagttatttaaccttcctaagcctcgatttccttatctgtaaaatggggatgataatagcacctacctctaaggatgtggggaggatttgatggaataatgcagataaactacttggcttggtatggatcaaatagatgttagctgctcttacataatcattattttccaatctaatgagcaaagggatggaagaatggaagagtaaaataggaactcgacaacaccaagtaagacaggagctgaggacatctcccatgctctgggccatcctattggccatccgaattttccagcactgtgtgaaagcctttgcctagaatgtactagtgtttctagtttccgatgagctgctgtggaggtaactgtctctgtgccctctactgtcagatctgctcaactgtgtagctgtcagtatttctccgttttcctggagcagagggtctgtgaagcatgcttccctgatacaccaggaccatccaacccatggaagcttgttgagacctcagcgcccttggctgctgggccagcttttcctcccaaacctgccctcagagcattttacattatagaaacaaaacaaaaccaaaaaaactgcaggcagtttcacagtgaaggaagctttacctaaagactgttagaagaagctttttgtccttgaattcccagataaagttcttgcagtccttgcagatatggtggttccgagaaaataagtaggattttgcaatgatcatgcttataattttggtcagttttctttttttttaagtcacagaaaatagaacttggataaatacagacctggttttgctcactcccagtttgccaagtcagtgagaaggcagacgggtaaatgattcccatcggacccttgactccatccctgtcaaatcatttgaatcttattaactgaagtgcagatagagtaaggtcagaagagccccagcttctccctatctctaccgttttatataacattcaggaataaaaccagtgctgcctgggcttgttaatcctttccattttcaaaaaggagaggaaaaaaaaaacagtctgggagaacccaatgttaattaacttgtgtcttggtgacatgaaataattcttctccctgccacattcctaggcaacatgttaattaactctgcattagtgcaggcatttccagccattctttaatatttatattattgttattaaaatgggcagcagagagcttaagatgggacatctcttgacagaggagaaaaattgtcttttgcgtcagggatggtcctttagccaaggtcttgtttactggcattcttagtatatctggcaggatcttttaacaaggcaagttggaggagtaactgaacgggccctctaatgtgtttgagttcttcttcacccctaggataacttgtccccgtgaggatttccaatggctgagttgcctgttacagttcttttccgacatttagcttcaaatattcatgagacccccatgcagaacctcaactctgctgctgtgttgtattgttgggaacccaagagcagctgttcatgtctgtgctgagccagatctccttggatcccttttcactaattcttgtgtgctgggagtggtggggtggcggtgatggcagtggttttgcttttaacagccagcacctgaatctgttagagccagaagtatgcctgccccaactagacccccaacggaccttaaccagtgacagacatggtgggagtaccaagccccgcagccttgcctggagccaggcataacttatattccagggtccctcccctctgagggactttgcctgaggatacaacttggcttggcttcctccccttccctccagcctcccctgctgccttccaggtttttcctgagaatgcctcattcataaatcactggcacatcaatccttgcctcaggggctgcttctgggatatccagcctaagataccaattcttggtgccagaggttaatgctcaagttaggtgtcaagtcccggcttattttttactaatattagaatctccgaatcccagagctggaaggggctacagagaccttctttttcagttcccttgctttacggcttaagtcacagaagcctgtacaggggactccatttgctcaggtcacctggcaagttagaggtcatgctgggacctgaacttgtctcccacatattcgtcctttgtccttcccttcatagctgcctgatgtgggttgtaatttaccccctgacttccctttaataagctccctccttccttaaggatcgcacaccccaggcagttggattcattccatgcacactgttttctcagtcgttcatccttgctcaggcccaaacttaacttacagagcagtcaggaaaccagaactgtctttccactctgtgacctccaatgtggcggttacctgcagctccaccatctgctacgttgggataaaatgttctccccccagtaatgagtttgctcccaggcggtgctttgaaaacactcagagatcttcaaatggaaagcaggattcagaggcaaattagctggccctggcccgaacaatgagctctccactcacagaccacctcttgtcaattccattaatctcgcccaaatattgcaaaatgtgtcaactgcccttaggtcccctacaacctctcagaatgtacccactgattctctgatatcctgaaatcaaccagaacttccaataagagcaagcattcacctaaaactgtcctaaaggttttatgtagaaaccacctgctaacatgctatgttttcagccacgagtgaaaattacttcctgcagcaagactggcgcagctgggaatacacccaagatgtgttaaaacataaccagcgttggcttagcccttgaccatgggtgccctgacatgcttcgtttggttgttttaacagctgagtgaggtggagcctatgatggctgccatttcactgaggctcagagaatcagaggtctctccagggtcactcagggctggtccgggacattgaagctgggtcttctctgcttccggtacttgtgttactgcacttttgctgttgcttctcaaatgtcagcctgcaaccagtcccccggaagtgttcgttaacgcacagactgctgggccttctccccagggtgtctcagttgggtagggaaggaggagggctgagaatttgtttttttgtttgtttgtttagtttttgcttttcttttgagtcaaggtatggctctgtggcccaggctggagtgcagtggcatgatctcggctcactgcaacctccacctcccgggctaaagccatcctcccacctcagcctcccaagtattaatagctgagactagaggcatgcaccaccacacccggctaatttttgtattttttgtaaagacacagtttcaccatgttgcccagggtggtctcgaacttgtgagctcaagtgatttgcctgcctcagcctcccaaagtgttgggattacaggtgtgagccactgcgcccagcctgagaatttgtatttctgtcaggttcccaggcagtgctgatgtcgctggtcccaggaccaacactttgagaaccactgcactgagccctgccatgttctgtctcccaccttgacactgaatactgcctgaaataagtgactgatcaactgaggcttgggagagtcttgatttaaatgtcagaaaagaagtttcccttttgattcatgccagtgggcagcgagggccatgaattaagatcctcccttcatggtggagagatgctgttggtcctccatatctcagaggcacgattagctgcaccgcgtgttttctgtggaactccctgtctcccagcagctggggccccagcgaataatcagggggagatgtgctttgcagcttatggaggtattcaaggccagctctccccatgggtagaatcagtggctgttgacatgatagagtttgggagcctcagaagaatgcccgttttattgcattcctggtcagtaccctctcaaaggggcccctagggtctctctccagctgctcttctgaaatgagggttcccctgggaggggacaggtaatacttgcctaactccttatgatagatcacatcagctgagagccttgcccacagaggaggagccagggggcagcctaggggaatgatgagcggttgctgcagacaaggagagggctcagaaaagggaggagttatgccagatccaaatgccagtttcatctgagttccctctgcctgctggtgaagactgcactagccggccctccttctggagccgaccttccctggcttcctgacatcctgaaagttcggcctcctttctagggctcatccccgagccctgtcttccaggattgtccctttcactgtcttcttagcttttctttcttttgccccaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgtgtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaatacagtgttgtttatttgattacgacttataatttgggatggcggggaaatgctctgctttttcttttctaaaggagaagcaaataagcaatttactcttaggtcaaataaaaacttctgtgtattgcaagggtttgtatgaggcaggcacatttctatattactggcaattatgtaacaggtcatcatgtagctcagaggaatgtagaataattaaattgttattgtacaatatgcatttcacttcagcattgtatggagtgagtggaaggcaagatcattgcctttgggaaacttgtaacctagaaaggacacaaatacataaagcagattccctttgggagagaaggtaattacctagtttgaaatgtggcaaagatgctgagcttgacacttcgattttccaagacgggtgtctcagggtgttttatgacaagtggttaagaggacctttactttgcggatttaaagcaggcaccttggtttgtgtgtttgccttcccccgagtcaggccgcccccatgaactgatgcagagcgccaccttctggccatcaccttaaagcgcgctagcccaggagggtcccgacgtaggacaaacctagatgaagaagaatatgcttttcaatgatttccttagagtactcggaaatgcaagaagtctaaatgtgttcagttattaagacacaagaaacatgcagctaaggctgcatgttaactataagattcctttaaatcttcctaaggtttgtgatctttgttatttttaatttttttaaatccctggacagagagacaaatgattttttttcttctagaggagaaataatgaagtgatggctctcttggtctgtaaaatgctacaagtagttgggaaatttgactgcttaaggtggcctatttaaaacaaatccagttacattgcattccagctcaggtgatggaaaggcattaccagcgaggggatgtttgttctaagtcagtggttctcaaactctctggggaccagcagaatcaacatcacctggtaacttattataataaagaaacagattcatgggccccaccccagataccctaaatcagaaaatctggggatggggttcagcaatttgtgggttgtttgtttgtttctttgttttgagacaagatctctctctgtcccccaggctggagtgcagtgttatgatcctggctcgctgcagccttgacttcttgggctcaagcaatcctcccacctcagcctctgtagtagctgagactacaggctcacaccaccacgcccagctaatttttatctttttggtagagattgggtttccccatgttgctcaggctggtcttgaactcctggactcaagtaatccacctgcattggcctcccaaagtgttgggttatagacatgagccaccgtgccccacctgtgttttaatatgccttaaagatgattctgacgcatgctcaagtttgagaatggctattctaaaatatctcccagttaggaagatcaagcattctaagttattaatatttgatgcaaaggttaatcactgaaactcttccacatgtagatactgtctacccttggttcctaaactgaaaactttcacatacattcatcactcatttgttctgcacatcatcttcaaaatcaatcacaatttaattcaccattttaaaccatatttacagtaataatagtaatggtaatagattttatctatgcaattatcttataagcagtattaagtaaaaatacaaatgatcattgctttggaaatctaaactttattcttaatccccattgtagcacaacacacattaagattcaagaaatcagccaatatttttgtcatgctcaacaaagcaataattaaccttttccatttgtcaatggcaccatcttgcagaattgtggatgcgcaggcagtctttgtagcacgtcaccccaggggcccaaatatctaacccacaactgacttaagaggaaagacatgtaaagggactcagtgggaccagctcccaaggtctaccctggtggtccttgcatgaatgtgttactgtgtgtgctctagacctagggtcaggagaactgacatctgctctcttccctggtccgtgccttcattaaagcagttggctggaacattttgcatcctcttatctcttgaatgtcttttgccccaaaccagcttccttttattgctgcttctaaaataactactacttttcaggaaaacttggagtcctacaaagttaaaatagaacaagcatctaggagatttatcatctgaagacttggatttgaattccagtggacatgactttaattgcttaataaccatttacatagcacttaccatttgccaggcactcttctagttttacatacattaactccttgaggccacataacctgcctcggtggcagtttctacttcttatcacctgcattgtgctgccaaggaaaatgaagcacagatggttaagtaactaacttcctaaggtcctgcagctgagaagtgacagcagtcgctttaaccaaggcgcttcaccctgtgccctgctgctctctcgaagtctcacctcactgaacagcaggtttcccatctgcaaaagagggagaatgaacaccttccgtcccagattatttggggatatttgagtttaggcagaaatgtaaacaaagcacaatgatataggattagcaccacaataaagcaatgtaaaaagtgctctggaaacgcagataagggaacaattaaattggcccaagcatatctgtctggagtaaagagaaagagacatttgaaatggccttggacctggaagagcaaagacttggggaccttgacttgcagcatgagtatttcagtgagcccagtttgtgtatgggtgttggctggaggccagccagtgaagggtttaaattttgatgctgtcactttctggtggggtgcccttaattgccagtttctacaagatctgggccctgtggacattgctgacctgtgacttgaccttggaccctcagctcaagccccgcctcttccaggtagccccctcaatctctccaatttacagctgctcatccaatcattctcaagtactagaaatcttctaattaataggataaactattaatatgctggctcctggaccaaactgcaaatctacagaatcaggatctcttggatgggacccaggaatctacacattcatcaagcaactcctcttcctttgttgtcccctgacttcaatagaacattgctgctaaaccctgaaccctgagttccacaaaatcagggacactgtctctggtttacccttgccagactgtagcacctgcctggcacatagtgcccaatatatttccttccttcctttgttccttcctccttccgttcttcctccttccttcccttttcttcctttccttctcttccttccccccttcccttccctctctctttctccctttctttcctcctcttttttttttttttttttagagacagggtcttgctctgtctcccaggctggttttgaactcctgggctcaagcaatcctcttgcctcagtctcccaaagtgttgggattacaggtttgagccaccatgcccagcctgattgttatattttctttgttttatttaaaactttgttctctgcttttttctttctttctttctttcttttttttttttttgagatggagtctcagtctgtggcccagcctggagtgcagtggcatgatcttggctcactgcaacctccacctcctgggttcaagagattcttctgcctcagcctcccgactagctgggatgacaggcatgcaccaccacactaggttaatttttgtaaagacagggtttcaccaggctggtctcgaacttctgacctcaggtgatccgcccacctcgacctcccaaagtgctgggattacaggcatgagccgctgcgccccacctattctctactttaaaacttgatttgagaagaaggccttttctgaaactagcctttaagttctttatcatcgctcacagcatttaggccaatgtcatgcatgtggaaaagcaggaacaaatatttatggcatgagtagctaagagagagggccagtaagtaaataaataggggagatgaggttttctataattttaagaataaatggtaaatcaacatcaaagtaggaagtaaaacccaggaatttgcagggaaggggcaaggaagatagaagataagtctgcaacatcttgttattccagaaagtaaggaaatagtaaaaactaaataaataaatgaaatgaaatgaaaaaaatgatgtaaacatgtcataaagacaaaggagccagcttaaaggggctctcaatagccaaatctaagacaatttgattatcaaaacaattaaggacagtaacgaattaaggatagtaatgagttttaagcatggcagggggcagaattcatgagtttattccagtgataaataaatgagggagaaggaaggactcgtgtttacagcagaatcttggatgccaactggtaaatgggaagacagcatgagagctggaaaaatcattttgcaactgtgacagttaagatagaatcaagcaagcattatcaatagatgctaaatttcaacagagaaacaaagaacaagatatggatatttggatggtcttcaagtaccttcccatatattcctcactagctatgagaaggaaaaacgctaattacacagtagagaaattggatagcaccttgaccaggtgatctatgtggggcagatgagcatctcaggcctccagatgtgatatctgaaaaggacagagaggatcactctttttagtagttctgctgagaatatataacatgtctaattatgagacaaatcattagacaaacccaaaatgatgaacattctagttttaaaagttgatggggggggagtgtggactgtattctttgaaaatgttcatgtcatgaataataaagaaggctgtgggaatgtttcaggttaaagaaggctaaggagacctgacagctaaatccagcacctggcccctgtactcagtccagtgctggagggaacaaattctacaaagggcatcattgggtcaagtgataaagtcagaatatgaacggatagattagttaaaaagtattaggtgttaatgtaaatgttactgaaattggtaattgtactgtgtttatgtaagagaatgtccctattattaggaaatgcaccctgaaatatttaggagtaaagtgatagaggcaggaagaagagaaattctaggcagacaggggtgggtccctggcaaaaccccaccttccagccaaaaaccctgcaaccctctgcccaaagtgagaacttctatccctgtttgcccactctctccccattgattctttctgattaatgtctttttaccaatccaatgttgccttctctaaaactacctatggcccactccaccccccgccatcctgtgcctatatagaccccagactcagtcggtagaggagagaagcagcttgactggagagaggcgacttgacttcagagggagagctggacttcagaggagagattaacttcagagaagagccggctggagaacgccagatctcagggaagattatctgcttgtcccgtcccctctccagctcccctctccactgagagccatctccatcaataaatacaattctccacctccaccatccttcaagtatctgtgcgacctcattcttcttggatgctgaacaagagctcgggacccactgagtgatggtacccaaaaaaggctgtcacactggccctttgccctcactggtggagggcagcctccccatgcgatgaggcgagaggcccactgagctgacaacacaccactgtccacagacaccggagctaagagagcattgtaacatgccctctggggctttgggggtcacaggcattcccacctgggcactgctgcagggcctgcagggagcctactcttgccgctgcccaaagcagccggccagatcctgcacttgttcacccacgcgttcctcgcaagaagagcttgagcatggcgggccgagtgaacagggcacgcctatcgcaagtctgatgaaggggtggagaaaaactcctgcatcaaagagccattatatatgtaacttaaatagttgagaaaaaagttgtctctgtgtgtgtgtgtgtgtatgtgtgtgtgtgtgtgtttcaagagagggagagagagagagaggagagaggagaaatgataaagcaaatgagatgaacatattaacaacaggtgagtctaggtaaaggatgtactggtacactatttttattcttgcaacttttctgtaagtttgaaactatttccaaataaaaaggtatttttttttaactcacaaatctcggctttttcttgttttgggctttttggtttgattaggagaagaacaaggcagataaagagaggaaaaaatatagtgtagaattcagtaatgtactactgttcatttgtcacaactttaatgtacttttgaccttacaaatgtacctcaagcaagtaattcccctctccacacccactccccataatgggaagaatgtgtttagaagggttcacttagtgcttatttctgaagcaggttatttctcaaccttataaaatgagattaccagaaattctgcatttcctttgtaattaggatcaagatgtaatcatctggccctgaaatgtgtatattataggggtaggaatctaagctataatgttttgtatgtacatctaagaattgagttaaaagatgtttcaaagcaatgaagaagtcacatccattctctaccagtggccatgtattaattctcccggaaaatcatttctccgagttaatagaatctttgaagctaaatcaagtcaatttccattgtcacattgtgatgcttttgaactgggctcactgaattatcctatttgatgaccactttaaagatggctttgttgtgagcctcagcaaacccacagccgtatctctgtgtcagcctccccaccccaccccattcattcaaatcacttaatgagcagctcaaggcaaatgccccccgtaactacatcccaggcaaaatagatatatagtaggtaaaatagcctatgtgatgtgattgaaagaacactgaaatcaggaaacctgattttgccactaattagtggagtgtctttaggtaggtctcagtttcctcatttgcaaactgaggagcttacagtagatgatctctaggaatttggtagtcagactttggtttacagacaggtaagtatggaatttgggaggaagcatttgtggtagccactccccaaggtgaccctagtgattcttgtttcctggcttcacctcctgtgttgtctccattcacatggaatagggctaacttgtctaaccaataggatattgaaatgatggaatgtgacttctgaggctagatccagactgttgcttccaccttgctgtctcttggatcacttgttctggagaaaaaaaaacaaaaacaaaaacaaaaacaaaaaaacagctgtcatgccttgaagctgttcagacagctctacatggagctccatgtggtgaagaggaactgaggcctcctgccaccagccagcactcatctgcccatcttataaatgagccaccttgaaagcagagcctctggcccagtcaaagcctcagacaactgcagtcccagcttatatcttgaatataacctcgtgagaaacccccaagctggaatcagtcaaccaagctgttcttcaatttctgccctacagaagtgatacaagataaataattgttgttttaagccactgagttttggggcaatttgttatacaataagcttttattttgtatgcatttttaaattcttattttcccagtcatccactttttattatattgtacaaaagtgtcaatccatggtagattgaaagttaaaaactccagagttcgaaaagcgctgatcagaataatacaatcttagatgaaggctgaaaaagtttttgaaattatccagcccatcctctcactgagtgaataacttgtctcttacagttttctagcaataaaattctaattcttggcagcattatcaccattaatgttattaaacatgacttttattgagcatttgccaggtagatgcactatcctaagtattttatggtctttacaccaactctacacagcaaatatttctatcttaattttacagaagaggaaactgaagcttgggataaagtcaagactttaattcatcgaggtcatctcattctagactatattgcctctagcttcattaatttgtttatctcccaaaacttaattttatagaaccaaataacatatatatattttcagactgctggaaattactttctcacttattttaaggaaaaagagacagaattcaaatcctaggccaggtgcgctggctcatgcctgtaattccagcactttgggaggctgaggtgggattgcttgagcccaagagttcaagatgagcctgggaaacatagcaagaaccctgtctctataaaaaataaaacaagggctgggtgcggtggctcatgcctataatcccagcgctttgggtggccgagaggggtggatcacgaggtcaggagtccaagaccagcctggccaggatgctgaaaccctgtctctactaaaaatacaaaaattagccaggcatagtggcacatgcctgtaatcccagttactcaggaggctgaggcaggagattcgcttgaactccggcagcagaggttgcagtgagctgagattgtgccactgaactccagcctgggcaacagagaaagactccgtctcaaaaaaaaaaaaataaataaacaaaaaataaaataaaataattagccgggcctggtggcacacacctgtggtcccagctacttgagggactggggaggggaggctgaggtgggaagatagcttaagcctgagaggtcaaggctgcagtgagccaagattgtgtcactacattacagcctggatgacatagtaagaccctgtgtaaaacaaaaatattaatatagccaatgtaaaccaagtgttaaaagcatttgccaacaataaatgttttcattgcatttaatgttacctaacaaaatgggagggagtgtaaatgtataagagtcatctttggagacaaatggatgtggttctagttagtcttctcatttgtaaatgaagataatatacttacattagcatatcattgtaaaagttatgggtaatctacatgaagcaatgagaacagttgctggcattcatgcatgcatgcattcaataaatatgtattgagcgtttccaaaaggccaggcactgttcttggcaatggaaatacagtggtgagcaagatagcaaggtccctgttaccacagcacttacattctagtgggaggaaacaaaataaataaatacacaagtaaatgaacaaatttatttcagaaagtgatcaatgaattaggataaaatagagcaatgcgatagaatgtcaagagatgcagagagatgtcgttttagaggagggagggcgtggtcagggaaagcctttgtgaggcagtggctttgagctaggaccgaatgtcaggaaagattcagtcatacattcagaaacagaggaaacaggcaagtgaaagtcttaagtcaagaacccacttgtcgagcttaaagaacatcaagaagtccaaagtagctggaggaaaggtgatacatgagaccaaatcatgtaggatcttacaaggctgaagatgagctcagattttattctaactgcagtggcaagactttggaatcttttaagcaggagagtgacatacatactctgattagtgtgttgaaagatcactctgtgtgtgcatggaggaccctagagagacgagctgggaggctgttgcatgatccaggtgaga

SEQ ID NO: 1377 - DNA, 2304 bp, Homo sapiens
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgtaacaactgctctgaaaagaagatatttttcaacctgaacttgcagtagctagtggagaggcaggaaaaaggaaatgaaacagagacagagggaagcctgagccaaaatagaccttcccgagagaggaggaagcccggagagagacgcacggtcccctccccgcccctaggccgccgccccctctctgccctcggcggcgagcagggcgccgcgacccggggccggaaaggtgccaggggctccgggcggccgggcgggcgcacaccatccccgcgggcggcgcggagccggcgacagcgcgcgagagggaccgggcggtggcggcggcgggaccgggatggaagggagcgcggtgactgtccttgagcgcggaggggcgagctcgccggcggaggccgagcaagcggaggcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacatcggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaagggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaaaaaaaaaaa

SEQ ID NO: 1378 - DNA, 477 bp, Homo sapiens
atgtcctcggccatcgaaaggaagagcctggacccttcagaggaaccagtggatgaggtgctgcagatccccccatccctgctgacatgcggcggctgccagcagaacatcggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaagtgcgccgcctgtcagaagcatttctgtgtaggtgacagatacctcctcatcaactctgacatagtgtgcgaacaggacatctacgagtggactaagatcaatgggatgatatag

SEQ ID NO: 1379 - DNA, 96598 bp, Mus musculus
  misc_feature (16721)..(18461): "n" at positions 16721 thru 18461 can be any base
  misc_feature (21639)..(21658): "n" at positions 21639 thru 21658 can be any base
  misc_feature (31832)..(32269): "n" at positions 31832 thru 32269 can be any base
  misc_feature (48053)..(48314): "n" at positions 48053 thru 48314 can be any base
  misc_feature (53839)..(53964): "n" at positions 53839 thru 53964 can be any base
  misc_feature (58514)..(58548): "n" at positions 58514 thru 58548 can be any base
cgaactcagaaatccacctgcctctgccttccatgtactgagattaaaggtgtgcaccaccactgcccagctgagagagaggaactcttagctactgcttctggggatgcaagttattacagctatttggaaaccataagaagcttcttcaaaaacaattctcaaaaatattttatatatatatacacacacacacacacacacacacacacacacacacacatgtatatgtatgtgtatttaaacaggggactagaaaatgggttagtttttaagagcaatgtttgcttttccagagggcctgggttaaattcccagcaaccacattacagctcactattgtctaaaactctagccctggagaacccaacaccttcttctggtctctgttgacacttcatatgcatgatgtacagacatacatgtaggcagaacatccatacacataagcaaaaatgaagattaaaaactatttttaaaaacctccaaactacaattatcatatagtattggacaatatgatatcatattgagcaatctaagaactgatcatatcctggttgtggtggtgcatgctggtaggatttgctgaaggagatagaggcaggaggatcatgagtttgaggccagcctgggctacacattgaagaaaaataaaaagaaccaatcatatatccaaaggaaataagataagtttattggaaaaaaatgcctgcatgggccagggagctagctaaggtagtaagcatgcccattgctgacgtgcctaccaacctgactttgatccccaggaactatgtggtagatggagagaacaaactcccgaatctgatctcctttgatctctacatatatgctgtgtcttgaatatagcagacacacacacataaatgaaatgaaagaaaacagaaagaatgtacttgtacccctatttgaattgtagcattactcacaatagtcagaattcaataccaaacaacagatgaatggatagagaaaatgtgatacatatttgcaataggctattacttagccattaaaaaggatacaatcctgctgtttgctgcaacaagaatagaccaggaggacattctgtttagtaaaagagtctagacataaagcattgtagtatatgaccttgctcatatgtactacttgtggaaggtgaccagacataagcagtgttgggtggtgggcaattgtcagagagtgggaagaaaaggcagggaataggttagttaaggagtgtgagctggccttgaccctgaggcatggcaaagccttcctttggtccaagggtggatactggcagttcgtgcagaaaatgtctaccatagctttctccttctgagtgtttatggtctgaggactgtgcccttacagggactgcttctactgagattagctaaacctgttctttttttacagctgtataccataaaccttcttccttgttcatctgtatgtaataacaccatctctttgcacagctgtatgcaataaccaaccctgcgcccagtctggtcagccctgtttaacaaacctgctgacctttcaggatgctgaggcatctccagctgatagcccagatcaccaatcccaggtttctatctctgttccctctgttatttcttcattttcctcactaccctactctgtccctggacccctgctagataaatcaaagggggctggggctggggctggggaagataggacagggtaacagtgcttgctgctcctgcaaaggacctgggtgcagatctcagcacccacacagtgacttgcatgacctgcatgcaagtccagagccaggggattcaatgctctattgccctcttctggcttttgcggactcctgcacacacacacacacacacacacacacacacacacacacacacacacacacacacacaaaaaagtagagaggagagagagagagagagagagagagagagagagagagagaggagagagagagagagagagagagagagagagagaaaacagctgtgcattcggattgttcccactcttctcctattctgattgatgttgctatgaacattcacttacaagctgttgtgtgactgctatgctttcctttctcttgtgcagacatctagaaatgtatgtatgaagcttcttaattctgacctgcctggggttacaagtgacttagtactacaggctgtatcctaactcaatattttttttgaaatgaacgacttggtcttaatacatatagtttaatattaaatgacatcactgatgaatttgcttaaaatctatcaggtatctgtatactcaccttgtctgatctttagagacatggatattccacacagacaacagtgctaagaaatatgttggctccacattttaaaactatatatatatatacatacatacatacatatatatatatacaccccaagaatctgttatgtaccagatagagtgttcagactggaggacttaaagagcaaatgatctaacatcagaaatcattttaaattttgccctgtgcatgctaaattctactcaaacctctttatttgtgtatttgtggatgttactatttgctaaatacacacctcaaaaactgtgccctgtctgatgaacataaagttttcagaaccccacaaacaagtttcagctcttctagagaatcctagaagaccacaggcccctttatcagtaagcctttaaaatacactctacttttcccttgtctcaagaattttttgcttctacttcatttataaaagaaaacagacgatgagacttgtaatttaatggctgttattaatcaaatttacttgtggattgggcatttccccataagtgtatggaaagttgtttattttcctccacttcacagcatggattaacatgtcatcagacttattggttcaaaacgtagttcataaataggttagcagggtaccccctttcctttcaatattggtgcctcttcccttgtgatatgctctgaaaataagtgaagcagaggagaattaaaggctaatttaatccgagaacctactttctaatactggtttggggtcaggctgaacatattattctaaaaaaactttttttaaaaaatcagaagcaaggacagacagctaattaaacagcgagattttctattctaatgaacggctcctcccaagtctcaagtctaaagcagctgcactgaaagactttgccttttctgaaggtcaaactactattcaagagtgcccaagttaacagttaaacgtaattagcaaagtcttacaagactctttcttttcaaagaccaaacaaatttacttactattaaatggagtattttcattttgccatgcaatgttttctcccttttggacagaagagggtactcagacccttggggttgaaagggcctttttctaggagttgaagtctttgggaaacgatcatcatgttttcttaaaaacccttttcacgatacgagtatcatatgcctgtttaaaaacttcttcttctttacagaatggctcatttgattatggatagatgatgtagtctctttcttagagtgtaccagatgttgagtaaggcttagtctgtctttaaagagattcacttttccctcccctcctcacatctgccttctccccctccttgtcttcctccactcctggccccctttctcttcctcctcctaacaggtactacaagaggtacacacacaacacagcacaacagaacaaaacaaaaacaaaggctaattttgaaggaaaagttgactgaaaatacctgaactgccccttcactcgctgtattaaagttaatataaacggttgagtgacttagagccatgtagtatgtaatatattaatggagaaacatggctgcatgaagggacaggtgcctgttggaggtaagaagctgaggcaggcagagggcttgaaagcatctgggcggtttgctaggccacagctgcatactctgcactccacacctggaaggaaacccagagtatggggtgaaagaccagctggtgactgtggtttgtgagtgccaagcagcaagtcttggaactttgtgagttccaaacagaatgttgaaatgaagagaaaggcagacagcaaaagctctttgcattccactggcttccttcttccccagtgctccacagagctctgggtaaaacaggaggcgactcatccagtcagtaactgtctgatagtgatagcccaacattaactaaccaacgcctacactcccagtcctgcttctctgggctgttcctatcttaatgatccttattgtgaaccatgaacctcaagtgctgcatctgggctgaactcatcatataggttgatcatagcctgggaaggtaataattggagagaaaagcaagtagttgatttgcttcaatctgaaaacatcaccataggacaggaaaagtagaaaagttacaggcttcacttgattggtgactgatttaagtaaaatttaatgctgggttagtgactatatttactgtagtctgcaaaagttctcaagttttctactatcttttcctcatgcacaataccttttgcttttctggttgatttgggacacataaatagctttaagaagtattgccttaagaagtcttattgaaatacatagaattctcatagcctggagactattggcatgaaagttgctaggttattactagcttgtaagctaaataatttttaaaaaacaatttattgaaacctaactgtcttcaaaataactgcaaaaatattacaaaagagaatccactatcaataaatatttcacatagggttctcttcatggctttttaatgagattgttatatataaataaagaaatgtatactttttttttttaggttacatgatagtgtaggttttgagattgagtttcaaataccctgagacataactttgtggcattctaacctaaataaatcatttccctacaagctgcaaaataattaatttttaactatacctatatatgattttttaaaaaaacatggattcctgaattcttgcatacagtagagctccaggcgaggcatagtggaatatgactgtgttcacataaggaactgagggctcctgagttcaggtgagttgggttatttcgtgagacccccatctcaaaacaacaaagtagcttcccgaatctcctttgacaccaggatttcatttctgctgtaataatgatagtgtgataataaaaagtcggcaaggcatttcaaggctcctggtccagttcgcctgccctagcatgttaggataacagtcttatagatgggaggcaggaagtggggctggatggtctactttgtggtaaactcctaactttgcatgtttcacaggaaaataatgtgtaagaaattaataatccttatggttttgggattccagacagcatggacaataataccatcaggggtggcacagctgccttttccatatggaaaaaaagcagtagcaaatagtttttgtctatatttttaaaaagcatgctaagtgaatcctctactacagagctacaaacccaacccagtttttttgctgacttttgtaagttctgtgttgcctgcttggtgtggtcactgatacttcatcccagttccctctagtccccaggtgactaagtagcaggctcttctaaattctcgagatcagacaacaaacgaagagcctccaatttgtgatgttttctcttggcggaacaggatgtcctgggcctggatacaggaaatgccttccctttctaagcttcagactaacttctcctctttcctgttttttctttatttgtttttttaaattccagctctgtctcgtcttgtgtagactattgagggtctgcaggttatcgcttctcctggccatccttagaattctaagacctcatgactcaataagtgctgaacacccctctctttacccagtggccaagttagagctacaaacggtacacaaatactcatcttcaaagatcgtatcttagcctgtaagaacaaaaaccacacagaacgctcaaacacaatcgtcttgtgagtgtgcctatgactgagttttgggccattcagtgcaaaaactccaaggactgatgctactactatttggaatatctggtggtgtttagacatgtgtgtccaagagttttataaaattatccaaaagaactatatcctctttcttctaccatagaaggttaaaaaatggccaggaaagacaatctaggaactacatagacaatatcgatttctctttactgatatttctcatgctcaatggtagtccatcacaccaggtaaaaaagaagttctctccaggacagaatgaattccgatttgagtgtcagcttgttgtcttgccatttaagggggacttgaagaagctatttactgaagcattcaaggctcactatgatagtcatgtatgactgggctttgtgactagaggaaactagggatttgtgttccaacaagctgacacttggtttgtggccaggcacggtctcagggtgagctgctctattttcctggccttggtgctcatgtttttgttttggtaaagctcaggtaaggtttggaagctctttcgtgtcctgtaactcaatgactgtctgggccgacaaggctggagaggattagtcacatcactctctccacaagcacacaccttggatattaatggtgcagctggttgtcagccttgctttttctgaatcctgctttccttggcacatcttgctttctttagtaggaggggacctgagggtgggtttctcagcagatgaatttagaatttagtccaagtctgcagccatggactgctgacaaaaactgtttctatttgtggggtttccctggagtaagttgctgtgctagctttggactttcttcagactcagtctctaacactgtcctgactgcaaagtcctctgacctccctacgtgggcatttcaagggtaaagttacacatgggtacttttgtggcagattatctttttttttaaactaggcacatgtatggtatgtgtttatataaacatgtttgcatatgtatagggatatttgttcatggcacatatgtatgtataagcatgtcaaggcccagaggtgctagttgcagattaaatttttagtcaatttaaaaagtaaaaaaaaagtcaggaaaagtcatttcaagtgtgtggtccaacatatctgaagccttgcgtttgaagtttaggtgcttgaaactcactgtgtattttataagtacttcacatcttctttagaactagctgcatcctcggtgcatacatggctgatagctcctggattggagatgcatgtctagaaaaattcttcccaagaaaaattataacagagaagcagcagctcaccccccacagacacacacaccctctcttcagctcataaaggagtataagccactcattctagcatctatcaccgttagcattgccacacatcaactgtctgacacaaagaatctctttgagccatagtagaattagcaaaagtattttcctgtgatctggcagcttccagaacttgccaaacgttgaacagcactatgtgcacacactgacaaagcaaactgatctgagcagctaaacggcccaaatgctcagaaagacatgcttctgttgccttctgtatgctcaatgcaccttccattacaaggttgcaggaaactttttttttttttccaaatctgcaaaaatgtgcaaacagaagggtaagcctttttgagtcaaggggactggagtacacaaatgtaaggaagacatggtctctcattgaaacttccggctggggagggaagaccatggataaactacacaaagggcttgtgtctacagtgtggcgaggatgaaaatgagctgccggtgcctctcaactatggccaaggattcttttgcaaatccacattagaatatcatgaagcaacccccacccgttttgtgggctgatttgttgaaattgcttgaaagttagggtcaaagggacatggaaagtggatcaggttgtttttatcggggaaaggaaaaaacaacagatatgaaaggtgtggattcctctgtggtgacaagttggggtttttcccgaggacagacaggcagcttgaagcatccccacttgcctcctagattgccaacggtgccttttggatataacttaacctgcatgcctttagctttccatgtgctattgctgaaatgatctacttaaattacttagaaacaatgcctgggccacaggacgcacccgtgtgatgcccctaatggttaggttgagcactaaatatgcaataattgttacctattttgccctctattgttcttaaagtttcacgagaggaggcaaggctgttgaatcacgtaataggaaaagagaacaggcaaacattaatgagtatcgaatccctctctagatggcaaacctggggtaaagagttcaaggtgatttgcctaagggcttagaggctgctcctaaaataggaggggctcctttaaggaggtggtgatggaggtcccaatgggcaagtgcttagtataggtacaggttggagttgcaaaggagaccaaagttaacctgacttgtcctgttctttggccttatacctgctgtatacaaagaggttacaaacccagaatcagtgacactcaatagcatgctgtacagaaagcaggtaggctgagctctgtagaaccatttgttttcattacaaggattactgttaacaggtctttagcggtagcagacagacccccatttaggatgttatgatatattttggcgcgctctcatatcctggcacagtgcctggcctggcacccagatgacacccggggaacgtttgtggaatgaatacgtgcagtctagtttgtagggtgggatggggaaggagacagtaggataactttgcctgtgatgcaagctcttcttcccaagaccaaagttctatgcactttgcagcctggagcctacactattttctggtgtgtggaaatccatttcagcccagaggcttgggttgaagactcgcagcacgcctcgcctggacgcactcatcttagtataagcagttttctctgaagcccttatttttttggtttgcggtttatttactttagcgtttacagattccaggagcataggggtcttagaagcggggtcaggaccgaggtcgcggtttgtatttctttcctgcttcgcgatcacaacatcagcaagtcacaacatggttcctttatttgctcactcgtcagggtagcgtttcttttacctcctaccgggcgacgaaagacagacccagctcgaattcagaaaagggctctcacacgattaccccgcatcctcaatagcagggaccaccccatttccagacttagtttttcatgcagacactagcaggatccaataaaaaactagaccagatttaataaagacaaacttgtttctttaatccttgaccgcaaacactggcgtttttgtgcctcggatttctgaaattcttggctccaggacacagggcgcgcgggggtgggtaaatagcttgtaaaaacttcccgaagcagtaatccgagctcttcctctctctccggaccctagtgacacctgactttaggaagggaagatacaagtcaaaagagaagggttcacagaggtaggggacatacccagtgggtcgggcttgccaaacctggggagtccggtgttcagacacaagttcgcaacccgagccttcagcctgggcgcctcttccccctcccacccctggtcagcgcgcgggagtctatttagaacccagccccggagcccaggggattctgggacttgtagtccctctgcgcagccccaggcgccggcacgacctgggactcggactacattgcccagggagcttcccggcctatataagcggtcggcgctgcttcaaagtgcagtaaccatgtggatgttctgctgaagcgtttcctcaagcctgccggggtgggaggagaggaggaggtggtggtggtggaggaggtggaggcagagggtggagagagagaaagcgcacgccgagaggaggtgtgggtgttccgctcccatcctaacggaacgagctccctcttcgcggacatgggattgcccagcggctgctaacccctctcctggtcctgatcccccaaaccggcgtggctccccggtcaccaaggtagctgctggggccgggcagagggcgcggggagttggcactagctcccgtgcgcagaagtttttgccctgatcaccgggagttcttggtggctttggtggctttgcatgcacttggcgtgtattttggggcttctttccctgtgaacagttttggggggaggtatattttttttttcaggcttaagtaaccccaaacgtcctcgactctagtgaccggtttcaacctccttccccgtattgaaatggcattcccccaagttggaaacggttggagtgtctgcaggaaatagtttttttttccccctggggggggtatttgagggggtgtcatatgagttcgctcaaggaaataatctttctaaaaatgtagctagccctgttgcgctgctcagctggtaggataatgcatgcgtgggggtccccgtgggttaaaaaaaaaaaaaaggaagaaaaccggaggaaggggggggggcgatgaggaaagaagtgtggacggagctcgtgcccaatgaggacgcgggtttcacatacttggcctccacgcggggaaacaagtgctttgggatctcaacacgtcccttacttccatccaccttcaatccccatccggcgtgttcgaagtttctgcgtgtctgatctttctggccagctactgacgggaaataagcatgctgggtttgcttttatttgggggaaagagatccctctgacttagctgctaaatttggaggggagtgggatctgcaggaaaagcggaggctataaaagtcaaaacttggatttgagaatttctgatagaccctcgcgagatcccctactcagtcttctttctttgttaaatatttaggagctgattacaagggaccaggatttgcatccttggctgggcgtccattggctacagagtgcctgacctgggtcaggtgagtgtgcgagccgagtgctgtagtcaaaaatgggtttttgtcctaagcattttctaagtcctcttgtagctgccatagaggtaaagtagggaaaagaaagacaccgtggtcaaaattggtcatggtcttgggtgagtaaaggtctagtgacagccacttttgaaggtcgctcagaagtgaagcatggcgtggtgaggggggtggggtggggaagatatcggtaagcgaccacaatgtgcagttaaagggactgtaaagtgggtggtcccttaccagcctgagaggagccctcattagtttaattcccaaagatgcagaacttttcatctgccaagatccctaagcaagagtgagatacccctccctttcacaaactgtcactttgttctgttcggttgtgggcatgcctgtacccagagtgggctgggctgcaagaaatgaaagtgacaaattgaaagaatgagaacttaaaaaacgggaaggaagagcttaaagaatactacagtcgcttccagggtttcactggagccacctgaatgtcaaggaacccagcgggcttctcttgctttgggacctgttcctggatgaggagctgagggcaggcagcatttctgtcagtataatggcatatttaaaaccatcacagcccgtttctagaaaataaagcttctgtaggtacaggtgccactatggtttcaggtttggccattggattttgtttttgtttttgttttcctaaaatgtctgggaattgagtaaacaacaagttaataggggtgggtggtgagctgtgggcagctggtccttggtaacttctttaatgtcctaaatatttagctgttccctgggctacaatctttgggcttttctaattagtgaataaaagccagatacttcattatggtagtagaatgcttttgtttcctgttgataaggtcctcaggaatactggcagagcgggaaacatttggaagggaaggctagttcttctgtggacttaagtctatgttgattaaagcttggggtcagccttctctttgaagtacattacagacgaggttaactggtccacagactcttctctatcttttgcctaaaaataatgaggctgtcccattaggtagtagcaagccagctgcagagctgtatcacagaagaccttagatgtgggtaaagaaaccaagatacagaatgaagtcactgggcagcccgggcagtaatgtgtaccgcttgtgtttaagtttatggagaactgggcggggggtggggggagatgctaggaaaaatagtaaacatattgatcttaatgcattaacttatttatgtctcaccaacaatgtacaagctattcttagtttgatgtatgaagaaaattatagcgccattggcagggataaaagactgtaggtatttgtaggaggatttgacgttgggctgaattcattttggaaagctctgtgttgaaagcttgaatcaggacagttaaggaaaaccagaggaaagccagtgtctccgtgcagccttaggcctggctcatatctgaagtatagcgtggtcattcacatcacggcacctgagcaggtttgaaggagtcaggtgtgtctctacgtgaataattggagagcttaaaccgctttagttttacctgtggaatgttggtagcttgtcctgtggcctctggcttgcctggcaactagttgtatgcagtggttttcttctccattcctttctttctttccccatttctttcatggatgtgtgcattacatgagtatacggggcaagcacaatctgctcttgactaaatcaattcggaacagaaaatctcatcaagatttccttctaactaagcaagggaagttctttatgttccaaatgaatcactccggcctctccatcgaagcccgcccaggaaagtcactgaggcattattacccatgcaaaaaggtggctccttttgccagcctcccttgaggaatgggaggagcagtggtggcttagaagagaaataggttagtgccacaagaacaatctgttgactttgccctcaaagtggtttcagctgcaaaaacactagaccgtggaggtggggtgggaatgggacactctggaactaattcaatggtgtgcaaggaaaggacttgagaaaacttcacatggcttcttagctaataatgatctcatggagattctgttctactttttttttttttaaatacaggcagctcttttaaaacaaaccaaatgaaacaacagataccaaatacgaacaacagacaaaaaaaaaaaaaatcttccaaaatgaaagcagtcctggagttaggtttttaggtcaagctgtccttggatacttctaattaaggaatctacacaaggacagtgttctgtcttgtctgctattggtttgatgttttaaaataaaatgcattgcacttacagatccctgatacctagaattgcatgcagttgtgttagctttttttttttttttttttttttttttaatgttttgctgttgaagtttgaggactacacttaggcttgaagtcaatggtatgaattacagtacttgtgtgggtccttctacctgttagagtgtccaggagtgttctgagaagattcctagtgggaaaggagctaaatgaacacctgaagccgccacctggtagaccatgagattccctaggctgctcagagttgaaatcaaagctgtcggtgaacccgtggacctcactgactttcaccctgctacaattgttaccattcgtgtgtctctgtgttgctgagtccacagatttcttgaatacctgctacgtgccaactgtgctctaggtgccttgggtatggcaatgagcaatcaagttggttcctcggggctttagtaggagccagtgggaagtgatcagcgaaaacaaacaggtattgtagtatggcaggtgcagagagttgtggagcaaaagtcaacaaggaggggatgaacagagaataagcgagtggacaagatgtggaaaaatgggagtgcttgtgtattgttggtgggaatgcaagagatacgtcttagatacaacagcatggtagctcctgaaaatatgaaacagaattattatatgatttgacggttccatgtgtagttctctgaggaatttgaagcaagaactgaagcagttgtttgatattgaaagtgacctcactaatgttagcctaaaggccaaaatgaaaccccaaagtatctatggatatatgagcgaaaaccaaagtgctctttttatgttcagggagctgttagtaagcccagaaaaggaagaaacttggttcccagtgtattcaaaccaaggacacactttgtaactgaaagaagccaggcatcagcaggtacacattgcatgatacacatagtgtaaagtggccctcatgaatattcagattgatagagccagaatggggactgatgaagttctcaggagctacagaaaggggaaggtggattaaaggacacaggctttctgttttaaacattaaaaacgcctgcaaattgatatgtattatctaaataaaaaatgaaaaacaaaagtttgaagggtgttaagggtgtattagggttgggaggtaaggcagggttcttcactgtggtgacattgaggacagcgctgaaggaagtgagccagataaccatgtagatgttctaggagtccagagcagaaagtgcaaaaaccctgaggtggatggaggtgggcatgttggagacagggctcaggaggctggagtggctgcaggtaggcagcagggggaaggcttgaggtgggaggatggtcagggtccaggggcaaaggccggattttgcagatcagcgcttctgaggatttctgaaccctgacagggtcctcagtgtggttttcatttgcagcattgctgaactccactgtgctctctaaagggactggccaggctggcaagaccacataccagctggaaacttgatacagggggcatgagggagacctagatttctagactggtctgtcatgtgacatttcctggcactgaagtccgcttaagtaggaaaggagtctcctctgctgaagaatagagctggcctttgctttgctcatcatgtcctaagacccatctggtgggcctggggttcctgtggccgtgtggccaccctgctgcccaccagacttcacttggggaagtcctgacaatgagtgccatgttctcaccatccctaggtgtgagaagctccacattagtggattctccttgaaagagtcaccctcacaggggcagaactcaaacccctcgcttcatcactacagagattacgggttcattgtcaaacactgggaagcaatggccaagccacacagcaaaacaatgaatctgtcttagccatctgagactcagttcccaggcttttcaccatgtgtagaaattagggctggagagatggctcagcagttaagggacccaactgctcttttagaagatccaggttcaaatcccagcacctacatggcagctcacaactgcctataacttcaagatctgacactgtcacatagacaaacatgcaggcaaaacaccagtgcacataaagtaaagggaaataaataaatacatatttgaaaagttagatgagtgtttgaatctcttaatcacaacacctcccacttgctgctctctttccttttgttcacagttgcgcctcttttctcactagccggaagatacctgatacctgtattttttttttcctccaaaagtctgtccctctgatggtattttatttcattaaaaaaaaaaattgtattttgggagttttgcctgcatttatataagtgcactgcatacatgcccggtgccctcagaagccagagcaggcactggagcccctgaactggagttccagatgctgtgtgccatcgcgcaggtggtgggagcaaaacctcagtcccctggaaaaggagcaagtgctattgactgctgaaccatccctccagcccccgggaagagaatttaagttatgacatatatgggatgagtagagtacaaaaatactacatcctccagagttcgtcattgttgcacaatccaaattgtcctttggggaaaaagaaatgacagttgaaatgtatttcacttgtaaactctctcagttgttcagaataacctaatcctgtgaagtaaagaggtactctcttctgtttttttgtttgtttgtgtgtttgttcggtttttaaatatgtgtgttctagagattgaactaagaacgccatgcttgcaaagtgactattttcagctatttccctaccactgtttacttctaagaaaacttttaccatagaggagttcaaacataatttagcagtatgtgttgtggtgcctgcaaggactgggaaaggcttctggatttaatggaactggagttatcggcagttgtgagctgtacagtgtaggtgctgggaactgaacttgggtcttctgtaggagcagcaagtgttcttagccactgagttgtctctccaatactcgacagtagcttcttaccgcatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggaggatgcctgcccagttctattagtggccttttttagttgctgagttttcatggctcgttcttacccgttgaagctcatctttgaacatggccctggcagccttctctctttcagggagatagaaagacaggctaactcaccaggcagaattctgacaaaaacaacgccaagaccaaaaaaacccaaaaaccccccaagaaccctgtgtttacatttgaggatgcttttatggctgtggacctagaggtacaaagagaccacaggctacctgtgggccatgaagccacatggagaaacacgtgcagctgggttttaaacctactgttgttagacacttgggggaactgacattttagaaagtttgaagacttctttcctcacagaacttctgaactgctgggtagaaaaatgttctcatcagaaaaatctgagcaaggaaaaacagcccaggcctcctagtgtcctggttcatttgcattgggggaggagctttgtctggggaatagttttattttgtaaaggcagcttaaaagcattccatatctatttatgaatagaaaaagacttaggaacgttcatttatttgccttgtctcctgtgtgtgtgtgtgtgtgtgtgtgtgtgtgttatattctgcctgctgtgtacttcaccagtttctatatcttcaagtcgtcctcttccttaggatcttggccaaattcctcctcctctgagctgcttttccttttcctggaggcttctgtcatttgaaaactctgcctcttgagctcggttttcttcgtaggggttttttgttgttgttgtttgcttatccctcaagagtactgaacatattggaagagctcacaaaatatttgttgaatgaagtaatccatacttgagatccgctctgtctttgaaggttgcaggttacctctaagaagaaactaatgtttagtccctctctgctgattcaaccttttccgagttgtcccattactttggaaaacccttttggtgcacaaagagatgtgaaaaacatgtagaaatatattacgccgcacctttgggaggattttaagctgttgttcactacagctctctagaggatgctcggttggggaatgtctagcagtaggtagcagcagagtggaagtgagaactgggtagtgaaaccaactgttctcagactggttggctctgctctaccacaggatgggggctcctgcaccacactcctgtgtactgcatcttggatatcaccaaaataggcaacatctgtgtgtctttttcctcttttgtagactaggtataaaaatgcaggctgaggggtggggtggggctgggagacgcctcagtcagtaaagtgcttgctatggcaagaaggaagacctgagttcaatcccctgagccacacaaaaagtgaggtatcatgcttcatgttggcattcccaaagctggggagtgggagacagctcccaggaactcactggtcagtcagcgtgtcttggtcatcgatccccagattaaatggagagagcttctctcagaaacaaaacaaaacacccaacaaacccaaccagattgagtttcctggggagcagcactcaaggttgacctgtggcctctgcgcatgcgcacatgtcctttcttcccacctgctatggattgttgtgaccaacgatctatgtaagcagactgggaaaaaaaatgatttaaaaaaaaaaaaccaagataggtctcagctaggaggctcatttggccttgtcaggagacatttttcctagtcccaccggtggatcttgaggtgaggtgcgtgctagtacccaatatagaggcctctgttgaggttcattctgctatggtgctgaggaaaatgtctctattgtgaaaaaactgctccaaaagtcagtcatgccggggttgaggaaccaacccatggtctgagtagatttgtagatatagtaaaactcatctcttaggaaactgacttcactccatggctcaggttagacaggcagaggactttcttctgaggctagtgccaactttaaaaatgtttaagtcacatttctttcttctttccttcctttcttccttccttctgttctctttttctttctttcttttttctttcatatctgcatgtgcgagcgcctgcaatggcacgtgttcagaggtcagagaacaacttgaaataatcagttctctttccctgggggtctaatttgagttgtcagttgtggtaaaggcaaaaaacaccttgctaaccctttatactggctctacttgaccgtcgtaccaaaataaacaccctttctctcttctcccaagagctcatcttggtctctgaaggtctgaggtctggcactggcttctcataagctatatgaatgacatccataaactcactggacagttgaattgactggctgctttttcccatataaaatgaggactgttggctcaatgcttctacccacaaattctctgggactttaaagagccaagtctgagcttgtggctgccttcttttacagcggtccttgagggggcattagaacagatacgagtacaacatctttcttgaaaaataactttttgtaggaggtgtaccagtttccagtgtagactactttagcaaatgtgtgtggaaggccaaatagatttgtgagtgaaatatccgagggacagctcactggagatggaatccaggaattggtgtacgctaggaactgtggtgtagcctgggccctaagggacatcatttaaacttaacagttcctctgagcttcagatagagagtaactgtttctgagataatcttaaaggaccttggaacttctgagatggtcacttcctttgggatgggccaaaaacgaaagtatttgaatatggtttcctatgtcctgaacagtgtttttttttttttttttataacagaataaattctatggtggcaggaatgtggtgttcccaaggatggtttttgatgggacaagcctacgtgtgaatgtgtggtgaggctggggtggcattgtgtccaactcaaaagtcttctgaggctggttcaacgttcacagtacaaatcacattcagcatctctgcccagaggatgttcagaaattaaccgggagagagcccagaaacagaaacagaaaggaaacattttcctctatcttggggaaannnnnnnnnnnnnnnnnnnntcaaccataaatatgttggggctttctctaccctgggtttacagtcatattaccatatatgtacctgggtaaggacatggcggggagacttctgctcctctggacagagtttccttggcctctggccaggagattgatcacaggccagccactcttccttcttgggacattcccttttcttccctttcagagtccttatggcttgtctttgtctgattctgcccatcctttatccctcccacctggagactgcttaacctaaaagtgacatggtgccttttagtactggtccctgacctcagttctgagagatctgcttgcattccagatgctcttaaacatgcctttatgcaaaaggcccttcttaccgacctaccattagacaaatttgttgatgttgttattttttttaaatgagacaacaggaaatcagtgctagaggattttggcaagagctcattattttttgtgctgcagaagaggtatacaagcatcttccctcctcttctgtgcatggtacctttggttttattaggaatagcatggagaatattctgctggagtcggtgctggcaggcttttatatgtgtaacttgcagtgtgtccctttcctcagactcctcatcatttgaagttgcacggaaggacttatcctcaaccagttctaagaagcctgtaagcaagcagcagattagaaaggacagaaaacagagaccagcgctgtctcccctgttctctctgccgtgtgctaagcacacatgctattttcttcccttggtttaatctgcagcatgtcaccttcctacaggagaggaagctgcgggccaggaaactaagtaactgtcaaagtgaccatgagtagaggcaggagtggggctggactgtgcacaagggaagaacctgcaaaaaataaataaataaataaaataaaataaaataaaataaaataaaggcccatgcttcatgctggcttatgtccctgtggcctggctccattcgtctaaccttccccttccccattatagctgcatgctttatggccggctgtttggttttgaaccaccccaggccctttcctgcccctagggcctttgtatcatcactctttccttctaccatgctcttctgcctgactcctacccctccccctttccctaggatggcctctgtcttcactttaggatctcaacctaaatgtctcagctgggttttctctcaccagtcagaattaaactgctgccccattcgatgtcacctggttttaatttctgttctctctggaggtactgttgggggtgtgacccagggaattgtgactccgaggcagctgctctgctgacctacccccaaggctggctcgaattctttgcatggatgtatagtgaccaaattcaccctgttttgatcttgtgtgtttactgtctgcctggacttggatgtgtgccttaggacaggatcctaacgtgcgtgttgaatgtgtatgtctttaggacaggatcctaacgtgtgttgaatgtcaggacagagggtctttctaagttttgaccgtctttcattgtctttgtgggttgagtcacagccaatgtttggccaatgccagtcaaagagaaattcaactcagtattgttttcaaattcttgggtcccacaagttctttacatgcttaaaaacttttgagaaactccaaacacctccatagatatgagatatgatatatgttagcctatatctatcatattagaaaacatttttagaagttacacatgagcatagtaagattttttttaatgctaaaatgataataccctctagaacaaaacaaagcaaaatttaataagatggctgggtgtgatggagtatacctttaataccagcactccagaagtagacaggtagatctctgttgagtttctggccagtatgctctacataaaccccctctccctacgtctctggtgttgagtagatttatagagcactttaaggcctagttgaatggaagagtcacatagtgcacatctgcattggtctccagtctgtagtgatgccatgtcttacatcttctgagggtctctaatgtacacacaagggactagataaagagacagaacaaagaagtgccttggtaatattgtgaaactgattttgcccttggatcttgagagaaagggtcttggggaccccattgaagccactgaattatgggacaaatgaactctttgagatgttgggtatggcagggaccttctgaaagagggaggagctgaaggctttggtagcatgatacaacccaacatccctaaggctggaggctatatcatttcttccttaccaggaagaagtactttttagcattcttagcaaaacaaaattgctctgagttcttgtaagggggtagcgtgtgtctccgttcagtttctaaggagcagcagagcaaacagcctaggagctatgcagtgggcgccatcattcggggactgagaatagcagcttgaaaataaaacctcatcagctgccactccacagcgtctactggactcttcttgcagctctgggctacaatagtagtctactatagagattagattgtcttcgctgtaagtgtagctggctggtagggtgcttgccaacatgcatgggtcacagagttctgtccccaggactggggacaagaaatccagtgggaattaaatcgacttgaggttttgtgcttctcagtctctgctgcagtcggagctagaaggatcaaggtggacgctgttgataatacagtggcctgctgagatgtttaagaaggtttagacttgtgggggagtattttatgtgtctctgggctaaagcatgcaaggctgtcactggggaggtgcatatcagagcatctgtgagggacttggtcaccaggaaatgaatggtgtgctgaggaagcttctaaaagccccatgtttaaggtcaggttgtcagtggacttatgtcctccccagttactgaaaggcaactgttcagctccgatagccaggtgccttcatcttagcatagaaaatgcttgctattcttggcacaaatgtgcaaatatgtggttttttatttttttcttgttttgaaagtaggccttattttgtagcctacgtagacctaaaactcgtgctaaagtccaggctcgaacctgtggttttaaagtccacggactggtgctaagttggcttctgtgttccttgagcttcctgtccacttgtaaggatcttatgacagacgacaggtgtggtgttctggtgacttcgcggttaatgaaaagtgttctaatttagacttagtttgaggagttcccaacttttaaattctgagttgtgtgtgtaggcgaaagttaaaaaaatttttaaaggaaaagtaatgtaagtgctattaatttaagtgtgtgcaggagatgggaaaatgataataaatgagttttttttttgtcacccccccccatcccccaattggagcttttagaaaatgaaatgtaaaacctatctggagctgcttaaaattaaaggaacatagttcttctttcagtggggctgtgcttcagcctgtttttactgcaaaataggagaggtttttaaataattaaattatcagccctttgaagagctctctcccatccccccttcccagcagggcctctggtttgatgtgggaagaagagggagagggagtggagttgtgggttgactctctgggtggtgtgaattcgggtacctgggacatgctgtactggcaacagacaccccatgggcttgcagaggatttaaatattttcgggcctgtgggtcctccccccccccttgcattttttcttagcactagcagctaagtaagaagtgtatttcaaggggaatcatcacaaggtaagggcattggagaaagaacgttgaggtcagtgtttctgtttcagcttggttccgagatgcaagagtgactatcagagccaggcggtatgcttgagctcgttctgtggattgttggctttatgccccaaatactatggaaagttgcaaagaattcctccctccttccacctgcttagtataagggagctgtggatcagagaagctctattgcttaaggacacacagccagagtgctcgcatttgagctggtgtttctaagcacactcttgccagcactcaggagccattttggactcgaggagtagaggtcaacagggcagatctgagagcagttgtcccagattaaaaagaggttggtttcttgttcttttatttctcacagaaatctaaaaagtgccactagatttaagttctgtgtatcactgatccaagagtttacaaacttagctttaattaactttagaagataatcgcccccaaagagtatcagcaggcaactttggccacagatgagaggccaccctggtgacatggaatcccagtgaggctgatcaccacattccccggtgctaggctgttacagagtgaggccattgtggtcctctccttgtgagtttgcagagctgagagaacaagtcagacaagtgatggggagacacccaggaaggtgctcgggtgcagtggagggaagtgtgtatatgcaactcaggtttgggaggagagtggtagcagggcagcagaggtgtgggagttagccatgttagggagggaagggagtgccataggcagtaaggattctgggaaatgtgcattctgttgagggtgggcgggagggcaagcagggctgcagtagatttggggtatttgggtttttttttgaggtgggggtctctggtctaagttacaaggctgtctgcaaaggcttgcaccctcctgtttccgcctcatgaatagtttggactacaggtgtgcacgctgcacttgtctctgattttggagagttgtaagaaatgatctagttgctgggtgtggtggcgcacgcctttaatcccagcacttgggaggcagaggcaggcgaatttctgttcgaggccagccttgtctacaaagtgagttccaggacagccagtgctacacagaaaaaccctgtctcgaccccccccccaaaaaaaaagaaaagaaatgatctagttgatgtacctacaagattatgttgactgcgttcagaatagactaaggggaaacccatgtctttcgaaagataagtagatgtccaggtaagttggatccacatcccacatgtgcctcaagatagttatggctcaacacaaaattgtaaatttacttaaaacatgagggtttttttttttttcagttttgtttttgctataactcaattgtgtagttttggcatgtgaattttaaagatgccaatcataagttgaaatgtcagaaggctagacctttcaagaatctagttaagaaataaaagggacggggtctggagagatggctcagcagttaagagcactgcctattcttccaatggactcgggttggttcccagcatctccatggcagcttgcacctgtccttaagttcagttccaggggatctgagactctcacacataggatgcaagcaggcagaacactaatatgaataaaataaaaataagtcattaaaatgaaaaaaaaagaaagaaatgaaatatggggtggagggatggctttgtggttagagcacttgctgctctggcagaaaacccagtttcagttccagcacccacatggcagctcatgactgccaggaactcagccctagaggattcattgccctttcctggtctctgagggcactaaacgcatgtagcacacatgtggacaagctgtcacacatacatgcatattaataaaaaaataagttgaaaaatggtatttgggactggggagatagcttagtagttaaagtgcttgccattcggaggtacggatggcagttcaggttcctggagcccacatagccacctgcctacaactgcagccttgaaagatagagacagaagatccctgggcacagcttgtgagactagacatcctggagactctgggcttgatggtgattcctgatgtcaacctcatctgtggatgtgtacacacatgcatatgtgtgccctcacagtgctcccacatactcaaacttatgtacacacacacacaccccacaggcttacacacaagtgaaaatggggaaaaaaagaaatgaagctggctgagactgacggaagcgaggcgaggttaggagaaatgaagggcttagtaatgttgagatttaaaatcacgaggagtggatgttcaagccaagctcttcagtctttcatctgacagcacctactcttattctgtgagcacctactgtatgcaaggcattgctgttggagatacagttgtgtagtagagagcagagctctagaattgcctatccctcaagggtgtcagacaagcatcacaccgatagatgtgagcttgtgacagaagcaagctgaggagagaagatctcacaggcagagtttgtggaagttgcagaaggatttgtcttcacccagtgatcgtgggaataatgattgaactgagagccgaagggcttgctttcactgaagctaggcaggtgactgtgaatgccataaaacttgtgatgatgctgtgggcaaccaggagcagaaccctagatgctgttgccagtgacagatctgtggagatcctagttaggcaaaggggccagcagagcacacagagagtatctgggaggcagagaacaacatggacactgagtgccactccctctgctctgttctcagagtagatctctgtgtttgtgtgtttgttcttgccctgtccctaggagtgcagccaaacacccccttttctttacccatttcttaggcagtgagaagctcggacacagggggtgggaactccatctggctgctgtggccgcagtgtgcagaagcaccagggcagctatcctctactctggccagctattctggaaaaatcctgttctgacaggtgccttaggcagcaatcagccgggggtggtgatgggtggtggcgcttgtaggtcatagagatggtgacacagctttataccaggggcattgctggtgcttgtcacagtcatgtacccaaacctcaagatgtatatagtgtagagcgggggacagcagggtttagggaagttgtgaattcctacactgagtaactcgcagaactgggagtcagtgctggtgctttgagcccggagccttctgtcttcctgtacgctgagctttggagaccatactgtgtcagagtggaaggaaagtggtaagccattgtgagagagctatgcagccctcacagatttagaagccattgaaacttcagaagacaggtgagaaggaaaagttttgggaggtggctgcctccctgtggggacagcagtaattgctgtgtacttaagcaggagctgtgagcttccagaggagactttttttttttttttttttttttttgctggattccagcagtgcacaagagacatgcatgatgacatgcttagccagtggttcaagccactgtgtgtattcagtctatagttctgtgccttcagaaaggcctgcgggcctcatgattgggagttgagagtcgttctgtaccgttcagctttttcccagtagaggaattaggaaggataattatctttccctaaagtaaaatggatcatcacaggtcttacaggaggtcatttgtggcaacgcctagctgacattttattacagaggaaccccccccccccccttcatggaggtcgagatcttagattctttcagaattagtctttatcttttaactgaagaaaagagctagcagtgaacgctgaaagcatgtcagctcgtgtctcaggcactttgcattcatggcctcatcccttccctatgacatgtctctgaagtctatccccagtgtagagatatgtacagaggtccacatcagccgagaagtcttggtgggcttagcatacaaaaataccttacacatagagagtcaggatggagtcataggtcgacttagtcgactactaagcctgttttgtagagctgttggcatggagccctgggtgtccttgtagtgttgggagctgcagttatgacacagttaggacagcatggcaggttggtacctgctctgtttttctcacagtgaccgggtcattgtgtttgaggactactgggagccctgcgtgtggctggtagaggcatacaggcagaatggtcctcaatcagataaagaagtggcctcccacccagctccctaacaacaggaagtcttcctgatgattgctgccaggcctacttcctacctagtccctccagccccaaacgcctgttgttttgactctgctagccccggttttccctttcagtacacaactgataattgtttcagagtctctcctcctggccctctcctatccctgtgtgccattaaaggcagagcagcgggagacccaggtgtttccaatcagacctggaagtggttcacttactcaacttatccaaggagcaaatcactgcctgatgcccctggggatgaatctgccctaatgatccttaatttttttttttttttaaagttgggacctttggcagatggcccagttgaggatcattaactgtggtgggtgtactggcctctgttttcaggggaaatataaactatggcaaaaggttacttgttcaattatcttgtctacttaataagcatatgggcaagaaagaagacgcgcaacctttcttctgacttaacaaaagtgttatatttgactaaggtaggaaaatgaggaattcagcagtaggaaaaaaatgaattagaattgtccataaagaaaaaaaatgtggagggaggagagggtgtggcaggatgtattgtatgagagaagaataaattaaaaaaaaacattaaaagtgaacagttctccactgccacccagagaataagaacagtggacattttccattttcccagggattactgttgatgaagaagcccatgtaagaactcagtagatctctgtgcctcctgtctgactaattatctatgatgaacatgtgaacctttctgttcttcagtttccccaacaacaaaagaggggtggacctatgtcacgccgtgccacatgtctggaggattctgagacaatcttattctcagcacagaggtggacacgatagtccttgacaggcgttagctattcagcttaatggtggggctgaagcgttcaagctccaagctactcagagagtttctcatctgctctgatctcagaagctaagccgggtggggtcaggctggaacctggatgggacaaataggactgctgtagattcttagtgtcaactgaagtccaggaacctgttgtgattgtcaggttgcaggttcactcattctgtcatgtcttgccattgctgtcatgtcccaggccttacaggttatgtcacactctgctactacagaaccctgggttgtatctgctgctttacagtgagagaaactttcagtaagatacccagaagaggatgtagatttgaaggacaatatcatgctgctgctgtctggcttggccttcatcggagccaaatgccctttagaaggatacggcctgggaggagagctttagtcactccgaattggccctgcttgtcttgcctaagcacattcctgccctcctgcatccagcagctccccgttggtcctctgggaggcccgtatgtacagacacaaatttggcctgactcagaagtcagtcaaacagaacttcttttctaataaccagtcctacagccctacagccgggagatagctacataacagagcactggcttagcatatcaagatccgagattcgatcccctagcgcagaggaagcaaaacaatcatcttgtgcttttattatacatggtctctggcctcttcatgtaaaattatcacagtgtagggtggaggggatggcgccgaggtagagcactagcccagcatacatagagctctgggtttgatccctagtgaggtatggagtgccaactttaatctcggcagagaatctgagtcagtagtctctcttgtgttcacggccagcctgggctacgtcatatgatgctatctcaaaacgtttataacctctctctctcttcttttctccttccttccttcctccctccttccctccctccctccctccttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggcaggcgcttctccctaacggtttcccttgccgcatctggcattcctgccgaaggaggagagtgcttccagaagtttgcctgccgaggaaaacttggcacccagagaagagctgaaggggagagaggacattttccccttccgcatcattacaactcttgtggcctgtgcagtaaatgatttattggagtcagtagaaggggaaaggtttccagagggctctgggctgagaggaaacccccaacacttcatgcatcaacatcccagatgcagaggaaacgcagggaagctctgcaagccccaccagggccgctgctctcctcatagctgagcgcgtttgctaaaggtcagttcaacggcttgcagttggctcctgttcctccatggtcatggccggggtgaaagatgttgttaggaatcacttcaatatttttgtatatacattgtgtgtgtgtgtgtgtgtgtgtttaatagtttctgggctttgtagagatttcctggaatagaggaatatttttcttgaattacttctacctaatcccagccagggaatcttagtattgattagtgcctgaatcggcatgtttgggcctggacctggctgggcaggggtcttactacatccaggagtgtttcctggtagagaaggcaaaactgatgcagcatttgtgtggagtgtgggctatcggcctccgaggcattgtgattatcactcagtcccaggtttccttccattaacgtcatcttgttgctttgattccttaacccagcccccatggctttgccagagctaagtttttaccaggtgcttcctttgacttaccattccctgaggcacgttgaatatgttaatgtgtcacacgtcagacttcccagctccttaatcactacagagttcttggctgggttccctggtgtctgggcagttcagtattagggaagggtcctcaaagcgttgaatctgacctgggcgtggccttgttagaagccagtgctaatgtgattggaatacccagaactttaatatgcaggacagaatgtagttgcagatgtcctcacttggctcatggaatcgcctgccagtcaaacgcctatttaaatttgaattttaagtaatgcgctgggggaaattgagctaagccaaatcttagtgacattttttccccctcatcatgtctcttctgctaacagtgttgcatgttttactttgtctaggctttccaacacggacatgtctgacaaaatgtcgagtttcctacatattggagacatttgttctctgtatgcggagggatctacgaatggatttatcagcaccttagggtaagagcatggaagtcctgatgcgtcggggtttgtttaagacatcataacactgatttgtgtaagataagacagttatcacattaagtggcttttccaaggctgcttgaaagcacagttagcaaatcctgcgttagtcacttcacctttcacacagagacatttctgtcagtttcgaaagaacaaaacctttttagttaggtctctattcactttgaatgtattataatctactcttcttatgtaagagggaacgtacttaagaatagagaatttaaaaaaaagaatagggaataataaatatattgactaatatacacagatccaaagaagtgcctctggctttgtggaaaagccttttggcttgtcttttcacacaagtgcccgggtgtaatcggagccaagaccattactgctcctctgcccatctctcacctttgaagcagacccttttctgctaagtaaccaagcgcacttggaagtttcaaattgcactaagttccctaaaacgttttctcttcatttgtgcttcctccaatcagtcatcactcaacctgggagaatagaaacacatgtgtgcctctcggctcagtttcccttctccctcctgttcctgccatctgagggaggaagtgtaaagtgtagtagcccctgaagtcacgcagaggcagaatgcagcatcaagatggctcattccagaataggcaggagtggcctagcgtctttgtgtaggaaggagtagctaggcccgggtggcattgttgattttggcaagacgtagtctcaaataaatgggggcagaaggcaggctaacagattttccaaaaacctcattcttacagcagccagaatgtccgctgtaattacagctattactggaagcgtgcttattttctggtatttgtgcagagtgagtgttgttaagggctcattcagggtactctatccccactgaggaaattatttcagataacagaattatatctcagttagacctgtgttctcattctagagagtttattttcagaagtcaccatggcttcttcctatgccgggtctctgtgtgtagttgaccttaccctgaacgtttatctactgtggcttggggcaaacaggcttcctgctactctggcctctccagtgatggccatcttggctcccgccttcctctttttattccctgtggttaattcaccccgttcttatttttcagcattgacttcagtactgtacagcagtggtaagcactctgagcccggtgggtgttcactgtgtgctgttctgagtcctgggcctcccttattcccctaactcccaatcagccctcttcgtggtgagcactggggtcatctgtcatcagtgtgtgtggaaacgacacctgagtgcttcaggcaggtgcctgcctgcccaggtctcagagctccaaaggctcgggtctccaaggccagggatgctaacacataacctttgtagggcaggttttttctggtttccctgtgtgctccctgaggtctgggtgcctgtcagacctcagctccatcatatacctgcttttcctctggggcctctgaccttatagttaacttggctcagatgctgaggtcccccctcccccagcccctaaaatcttagcctcggtcacatcttccctttcagctccattattttattatcacattattattttgagcctagtctgaccttaaacttgtagtactcctgcctcggttttctgagtgccatgattataggtgtgcaccattcttaaaattcttaggtgtacatactctgctttgatatttttctcaagaatcatatgatgactccctcataaagctaggatgtatgttttttaaaactttggatgctaattcttccttcagtttttaccttcaggaatagcttgcataaaacctggcttggtttggggaaaaaaaaaccattgatttggaaagttaaatttgaaccctctttccccttctttgaaatgtgcttaacatttaaggaataccagtcatagacacaacgagtgactgtcagtcttagtgggatgtggtgtctggctcccagctctatcctgtttatatagactattgggggttgcctctcagtaacttgacgcctccattgaactttagaattctggcaggaccttggagagccagtgtatgtgtgtggatctacactaacctttggtgtgctgctgaaccacctctggagcttgttaagaacccaacttcttagatcacttcctagagcagagcttcagtatgcctgggcaggagggatgggttttgatggggccccctggaaccggtatatttagaatcagtatctaaatgttctctgagttgagaatccctgagaacaatttgttcgttttacagatgaaatattgagacaaggggagagtgaaatggcatactgtcatgccattagctggtatctcagtgttatttacaagctgtgatcaatgaggctgttcctcctagcatttcctcttattaggacttaaccattagtccagctttgcattatgtatgtcctgaggggccaagtccagtgtctgatacatagtaagtaagtattctaccactgaactatgtcactagcactggaatccgggcccaaccttttaaatattgggtcaactttggtgacctttctgaacttatgttctaattccagagcccagggtagagatttttcatatgtgcacattatacttttcatttttgtagaaaaccctcaggctgcttgctgaccacactgtatcctgtggctcttgtaggtgcatagtttgatcttgtattttgagggcaaaggtgggatactcttcatacttggattcacgtcccttgacagacactgagcatcacgatgccttgggcatcttctgagccacaaagtagggagcccattgcattgtctccatggagcttggttgggacagtggaggaggagaagcaggccatttttaggcaagaaaggcttgtgtggggtatagtttcctttctgaaatgaggattagaatcagggctttgaatgcagggcagttttggaggaggggtcaaagttgaatatttaatggcccctggcatttggaataagaggcagcataggccgaaggaagaagttccaaagatcctagcatggtacctgggacaaagtcccttggtaatgtgtaaaatgagctggctctcacagttttaggaacttggaaaagtcatgtaacttcatagtgtctcaaaagctcaatgatgtgcatatatttttagtgattctcctaaaaagaattatgcaaggtaaattggtttttagtgaaatcagaatttgagttatctgtctttatgtaatctgggactattacttatttgtaacttgattgtgcttttgaaactccaagctcttccaatttgcactgggttccctccacctaaagatgctctactcactgggtactctccacctaaagatgctccactcgctgggtactctccagctaaagatgctccactcactgggtactctccatctaaagatgctccactgactgggtactctccagctaaagatgctccagttttcatctccccacctttgttttggctctttcaacaattccgatacatcttcttccgtccaaagcttcagaaggcatctggcacagatgactcctgcctgttctttcttccttcctagattataccttatttatcagtttgcttttatggcttctatacttaggccttgagctctttcagggccgaggcctggctcactttagtcctcatgccaggacttggtacagtccctggcacagagttggctcctcgccaactgttaggcaaatgcattaacgtcttcctgtgtcttccagactcagcagtattgtatgctgtgcgcaaatctcccacagatgtggttctggggaaagtggctgcagagaacagtaacttgacctgcctatcacagagtgctggcccttgggttacgattatttcactccttgcacaggaaacctccttgtccaagagctccctgccagagggacatggcagtatcaattttgcataggaaaagccctggactcctccatttttacatactgtttattgagggttttattttcctaggcttgtttttgatacagcattgatttgtttttctttttgcagcttggttgatgaccgttgtgttgtacagccagaagccggggaccttaacaatccacccaagaaattcagaggtaaagttgtggctttgatggagcggtcaccttcacttacttgattatttagaaaggctgctgctgtgcctgtgaggccagctgccctctcccccgccttcgctccgcgcttccagtcctttatccttttctgtagcaaccttagggttatttacttgaaatctgattttgaaaaagatacttaagtcctggctttaaaacttctcgaaaaaatgtgtaaataaattctcagtcaagattggcatggcttttattagggccttagtttgtctacagaataagtattgccaagttctaattcatctgaaagcttttcatcagcatagctacgtctccaaaaaaaaaaaaaaaagggatttaagggtccagtcacaaggaacatgttttttttttcagcagatctcatgatccctcttggggccttgctaattcttagctgccttacctggaatgagacattcttgcttagtgtacttccacttgagctataaggtacagcagggcagtgttcctattaatgttgccttctatgaccctgaacttgtagtttttctcagaaggtatctcagcttattgcagggagtatttgaatggcattggcatcttagctgccacggctttgtttctgtctcctgttgtgacagtggtaggatgtggtcctctgttcgagccacatcttagaattatctggggaaggttttcagttctatagatgctctggactgatggtcgggaactgtttttgtttgtttgtttgtttgcttgcttgcttgcttgttttcagagtagaatgtcactgggtagttctggctgccctgaaattcactgtgtaggctagactggccttcaactccaccgccctcagtctcctgagtgctgggattgaaggtgtataccattgcacctcgctcagcactgacgtttttaaggcttccaaaatggtttaaaaattacattgttttgtttattaattttgcgtgtgtgcacttgtggccatctttgggtgaggccagaggacatcttgatggagttggttttctcctttcaccatgtgagtttcaaggattagactcaagtggttaggcagaaccagaaggcatttttttttaaaaatcccttacaaaaaggagaaatgcatgcttattggagtcccactgggagtgtatggttcagacccctgcagactaatgtctgttctattttgagtgcaatgccttaaccattgggccaccctgctgacaaaactgattcttcttgctagtgggcctacgcaccgacttgactggtggcctggtcacagagagttcagcttttgctgtttgcagactctctcatttgagttctagattctccatgttgactgatttagaaaatgtttgactcctctggatgaaagctaaagaaattaggatgcaatggaaggcagacgttcgggtggaaaggagccatctggatgcatggtggtgttgcgctgtatccagttggcacgaggctatcaggagaatattttcacctgaagatgagggaaaactatttttaaaaaagtgaatctcagaaacttgaaggagctcttgcttctgctgagtttttcttcacaacccttccccgtgtctccttctaaaacaaaatcttcagtggcgccgaaatgaaagatgttatctaacggccataatgtcacttagagagtcaattccccacccagtgttgaccatgttggtcactgggctgaaagaggatgctgcctgtgttagctcggttggaggtcagatctcctctctactgggaaaggattggctagattcttacctcgtgtgtcacctgaggtcacatggctagaggcaggagcgtgtaggggtttggatctcaaatttggctgcacagagaaatcacccagagagctatgaaaagcactgataactgctcccacccaccacgttcctgagttaattgggcattgggattttttttaaagctccctgggtaattctcttgtgcaaccacacttaagaaccattgctaatagctacaagctaccgacttccttgctgaggaaagggctaatctaagcttggcttttgcacctgggacattgagaagtgatgattgtcagagcaggtgctggatccagggggacctcttattccatcctagcctcgggggtcaagcaggaagagaatttaatgtaatgactaaagtaagccaatggctattcagtattgttttaaaaatattgttacatattaatgactttcatttctaagtcatcatgtatgatttgaaattggcagaccttgcagaatacctgatttggtctaactaacataggtttcttcaagtcacttttgtgttgtgaggcgtacaagtattcagtttgtgttgatgactattgttaccatgctgtgcaataaatcctcccatctaagtgagatgctgtagcttttgaccaatacccttgccaacctgccatcttaaccccaggtcttggtaacctctctcctactgtctgcctctctgagtttaagtttttaagatttcactaataagtgagattattatacagtatttttctatgcttgcctcatttcatttaacatcatgtcccccagggttggttggttggtttgtttgtttgttttatcacaaatgatcaagtggctgtttggatgcagggtgaggacattaaagtaaataggactgctgcaaaggatgtcagaaggtgtgtgtgttccctggtactagggtcagtgtgggtctcacttggatgtgtctctggtgtctgatttgaagagactgttttgaaatcaaagcattagtctggtggaggccatttggaaacagtcaatctcctttcatgtcttgacttagttctacaggtaggaaccaggcagtgacttggcttattgactttctaggtagtttctaggctgtgaactgctttgtgatagtagggacatctggttcaaaatcagttgtgctgcaggcatcatgaatataggtcagaagttcctaagctctgagtgctaaggttgattgccctgcatgtaggtaagaagcctgggaaatctgcctctgcaggctgtgggagtgctggagtcttctccaccatgggacttgggcaggaaacattttcaacgtttttgaaaacatctcttcagctgtggtgtagcttgtctatgtcaagaagtcctccacgtccccacatgaaggaaaaagatctctcttttggaagagattgttgtctttctaactataagtacattttgacgaacgagatcattttgctggcttagaaactgcgcctgggcagatgagtcgtttgcagacggatctggtcatggtttcgctcatggagcctttgcaactgcagttgaaacaaacacgtatggaaaaagagatgctggcgagcagcttgatgggatgatgaagtctttatccaagtaatcagcagagctatgctgagtcacttgggtctgtgctggttctcattgctggctcaccaactgatttcccatcctgagaaccattataaactgtgctgcagtaaatggggattggaaggagcctgtctgttgtctgctccccttcacttctgactttggggagttccttctgagatttgcagccctgatgtttatccatacagaaccttagaccaacgagcctttctgggttcagagcaaagttccaccgatttttgcctgtatgaccctgactaaagtcacctctgtgtacctggctacaacaattttaataaaagatagatgtgtgtgaagaatgcagtactagtcagaatgttaccagttgtgacaaggtaggtggacctggaagacactggggcaatgaagcaagccagggacagacagagagacatgatgcttttactcatggggaatcctaaaaaattacctcataaaaatttagtgtaatgagctgttggagggcaacccgggagggggataatgattggactgttaaaaaaagattaaagataatttttaaaacattgagagtaaaacagtggttaccagaggccgcagaggggttaaaggaggaaagatgagagcgattagttagtgggtacaaggttaggagaaacaggttctgttgtattttagcatagactagggtagctatggctaattatcacatagaaagcatttagaaccacctagaagagatgattttgaatatttgcatcacaaagaagttataaaggggtagggcatgaccccatggtagaattcttgcctcagatgtgagggcgtggatttgacctgttgtagcacaaaaagaagagagtaaggaaaccataactatgtaaggtgacagataagctaagggcactgattagagtcctataaacatgagttgaaacatcacattgtatacctgctaggtgtcaaagagaaagcaaagcagaaacataaaatgagaagaagaaaaaaagagtaatgcagtacttagtaagtcttcatcatgcttaccttgtctgtcttaccttatccagtccctagatggaacccataatcataaatggcatcagaaggcatgactccttcagtgacatgagcattgtctaccattcgtctgtctgtctttccctgtctcgggcctagggtgtacacaggacttcccagcctagattccagggccattgctgctgtacaggttgagtgtacttgagagactaattttctgagcttgtttgcccatctgtagaatggggccgtcgatgtttccttccttacaaaggtaatagaattgaaggtagtgtggctaaacatagtgcgtaggacggatggtcccctggtccagtcccatagcttctcttttggacagtagatgcagaaggagttaagcacggagtgcccttgcttctctctgatgctttcaagtacatttccaaaatgaatttctcctttcatgtagtgatttccttgtccatatctcctgaccccctccccaacccccaaactgtgtgtgtgtgtgagggaaacttgtacatctgtttcctattaggcaaatctttctcatcatctgcatgattatgaattgtgtcattctctgtgatgacaagaaatagctgagatctggagtcgttagggtaccttgtttttgtttttgttttgttttgtcagtatgctaccatatgaaagtgctagagtctatgcacagtggggcagaatcactgttttctctgatgggagttagctttgcccataatatagaaagaataaggaagacaaacatcagattgaaaccaggaatagaaactttgtggtcagtgaattcctttctctgtattatcttttgctcttcccatccctccacatttctcccccttgaagatactaaatataaaaagcactttctctaagggaagatggaaactgacagccagaccccattttcctctcaggcctctgctcctttcacagtaataacctccagggttgttggagtagaaagaagggattgcaggctttgagggaatcaaacaggcttgtagaattggttacaccatctattgtgtaatctcttttctacactggggcaatggtcaagtttttgtccttaaacttttcactgtactggaaccaccttggcctcagagccttgaccttggacatatgttaccgtatcagcatcaactgaactgcagcgtttagatttctagaaactgttgagcttctgaaagaagctgttagaagtttacatttgaggtgggaagccagccatggtggtgctacatactggactccagcactcaggagactgagggaggaggatggtgagttcaggcctgccaggactacagagggagaccctggcccacagaaggggagggagaagaaggacagccgggtaagaaggggtagggtaggagaaaggggagttggaaagggaagagttgtagtgaaggagacaaactcatatccatgaatggggcgggggggggggctgcatcaggctgcagtgtgcaagcaggttctgggtgtcttccctgcccttgggttcctttgttgtcccacagtgtcacagatctcaaaacctgttattccacctaagctggtgtatgactaaggcaacattgtgcagcagctgatggcttgcctggtcgggtcaggtggtacaaacagcaagttgagttgaacagtcgttgccttagctgggtgtgctagtgcaagttttaatcccagaacatgggaggaagaaggtagcaggtttatgtgggtttgaggcctacctggtctacaaatcaagtcctggatagctagggctgttacatagagtacatagagaaacccagtctggcagaaacaaaaaaatacccccacccccaaacaaacaaaaccaacccaaaaaagagccttagggttttctggagagactgacccactacatttatcacactgatagatcatccagttggtacaaagcattgtcctgatgaatgacttctttctaatcttgctgtgcaatccacttccttgcggcaggtctttatgttcccattatgcagatgagaagatggaggctccaagaagttgagtaactgtctcatagacagtcacttgcccatcctaggctggttatcatttactccacaaacatttattggtttccttctacatgcagctacaggccatttattctccagggacaagagttaccagaattctctgggaaggcatctgttcccacaccacagcagttatatatgcaaggggaagagagccggcagagtactttcctatgggacgggggcagagtagatgatgctctacatatgtgccttctctctggctctgcagcacctccccagatcaggacacatctgtttcatacctaatgctatttgggttaacagatgttaggaactggtccagtgtcatgtcacgcctgaatgccagagtcctgagggctgaccctgtcctttcccaccatttgccctatagattgtcttaaacccctggcctgagggttctgtaagggcatggcctttgtcactggcatagcttctaattgagactagacaaaatgttacttctctgttcttgaattctacctagcttttattcagacttatttcaatgaaaagctaagaaggaaggaaaaaagaaggaagggagggagggagggagggaggcaggcaggcaggcaggcaggcaggcaggcaggcaggcaggctggctggctggctggctgccttggaccctttgttacaatgaatcttcagctgttcccaacactagctcaggaatatgcataatgtccacatgattgggacatgtttgtggagccattaagggtctagcccaaggcagtgtaaccagtgtctgagcatttcaagttgggtgtgagctgaaagtctctggttcctcagcctgggctccgagacacgacagcctgcgagtctagctcttgcaatgagcatgggagaagcgttactttcctctgtgagttggactgaggcccagtgcatagctatggatttgagggctaagcctctggcctttttccttttgccagacctttgttctccttttctagagtgcttgcagaatgtcagtccctctctgaggggtcttggagatttaataagctgtcttaatgggggaaggactgaagtgttttatatttggtccatccactttgtaattagccttgaaacttcctggcaacgttggtaggtgtctccaccagggagtggcctatttcagggtcagtgatacaaatagtcaaaacctacttactggatcatagacttgcttgtggtttaggcctaggtaggacactgagaaaaggatgtcatgtgaggccagagctggaggctggttggctactgcaaacggcttcattatcttggagaaaccaccgtgtctttatgtgtctgtttccccattcgttaagtgcaggtttagtgaaatatctccccatatccattccagctctagacactgcagccggccgggactggaaatgggcaggttcatatttcacaagaaagcattggtattcaggagcctggagctgcctagaagtagatctccttttccctgggattacaagttgtctctgtctagataaaaaggaaacagacagactttcaccctgaggccagaaggagacacagccaggatcttgggtcacaaaggtctttcagggtgactctaacaagcctgctggcttagctttctttcaaaccctgttcctttgctgcacattgttttaattgttgctaagcaacattctctcctaccccctccccccccttctttttggcaaggcatccaaggaatgaacccatatcttatttagttttaaatacccacatgcaaaggggagggcctaacttaaattttgtttgttcttctgattttaatccatgacaggaatgcagagcttactctttgcctgtcttgttaggtaagggaaaaaaaaacccatcagtctgttgaaggtacgcgtcagaatcatgccgtggggcatattgaagatattgcctatgtgtgaagctgccttgcaggagaggctcttgcaacgtgttctttattcacaaagtcaattcaaatttaatgaaaagattagtaggtttttataatcttcatttcagatttgctggcttatctcaatcttgcaccaacagactccattgaaagggaacaaagctgtaatttaaatcaattccctgggcaacctagaatgcttccagggtgttacacaatcagtggggctggttcctgtagcttgattattgcaggagtcccacacacttcttccagtagctccctgtgtgtttctgcccactttcttgacgatatgagatgtgtgcctgtggcctctcgtataatgaatggacacaagtactctcctgctctgagtccatttatttttgaatatttgagtcacccttggcaaatagaactcaagtgtctgtttcacattcacttaccctaatagttaatttacttgttaatgggattaattttcagctgttttatcctgaaaatgttcccagcaaaataaatatgattaccgtgtcctctaattcaatcccgctgatgtgatgtggcttctcccattctagaacaaatggattttgaaatcccagccagaagtaattgggtcaattgtcatatcattgtatggtccttctgacagcagaatgtagtggttgattaaggacttttcttttggcaaagggtttttatagtcctgtcttaagggcatcaatgaagatgaacatgcggtgaatcacttgagcctatgataactttgtctcttcctcgtttgccaagtgagaaaatcggactgggataactagggtgctggagacagagaatgatgctgtgtcagaattgggattggattgtacccaaagcttccctttgttctttggggtcatggattaaagcaaaataaagttttgtcccgttttcctgtgttaataacctgccttctgtaaacacaaataggtggttgtgaatactttgttcagtctttacttaaattagttaaatcaatttattgaatcttatagtttcctttatatacatctgtttatttagtcttagaacaattctagaaggaagttgctcttctatggatggagacgctgatatacaagaggtacagtgcttggtttaaggtcatacagctagcaatgatagaaccagaatggaaatccaagcagtctggccccaacacaactactttgcccatttttgtgtccttcccaaatatgtcaatcagagctgcgttcatagactagagatatatgctaactataaccctgaccttctagtgtggtgtttattacagctgccttctacttttgtcttttcacctagacatgggacatgtagaagtaccacagattgccctgcctgtctggcccccacgcctgtagtgttgatccttagcaaaagccagttgtagaagagtcagtgtttttcctggtatgatattttgtggttcccagcccaactgtgttttcattgatgacatttcaagtcaactggcctctggtcttctcagtatgctgtctcatgctgtaatctttttccaaactacacaagtctggtactctataagaaggttgtcttctccctggaactttgggctgtgtttggtctcattttttgctacatgttggattttgattagcccccaaaggctcatatttgaaaggcttgggcaacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcactctcctttgtttcctgctgagttgactgtcccaccacaagctcttactcttactggaaagtactgctccgctgcagggacaaccaaccagtcatgagctccataactgagccaaacagttctttctctttataaattgattatctcaagcatttcttttcatgagaggaagttgatccatcctcagaaggaatttgtttgtttgtttggtttttcttctttttttgaaccattatgttgactcttcattgcccctttgatgtttacagtttcaagatgtcttggctgccttgtatctggtctgatatggtcataggtgcaaccctgtgattgttgctatttgacagctgggcagctgttgagagggtaaggaaaccaggccggacttggatttgaacccacatctggaaaactgcagtgtctgtctgtagagtgaatttatagagttgtgtttctcagggactatctggggcctcttgcttacctatcaaattgagcaggcatattgctcagtgaaaattaacacagggccatcaagaggttaggtctcagataaactctagcaacacttctcattcctggccacacacccctcccttgttgggcgctcccaccgttgtgcctgtgggtggaccctgtttcattcctcccccctgcccctagaggagtcacagtcgagctgagggtgcacttgggtacttggagctagatggttacttgctaactccagtttgaattgatattttgtgtctcaaggacagtatatctgaagtgggacctggggctttgtgtttttaacagattcttgagctcctgcaggatgcctacagagacagtgataggtgccttcccctagtcgggtctgtgggacttggttaagagtgagcagagtgctttaactgtacagagcttgggcctgaacaagtcctgatttgttattcctgcatccagttgtttcctttgattcaaaagggactgaacatctgttgaggatgcagaaagaatgtctgctctgggacagaggttaggtagttgtcctcttttgacaggctctgtttttgcaccaaaggaccccagctgtttttctgtttggcttcccgtggaaaccctatggttgggacatgcgtctgcaaacagctggagagagtgcagatcgagcggtcatgctgagaggctcttgggaaaccaaatgggttcagtctagtggtggagagggttgcagaggaatggagaggtgggattactgaggatgtgaaccgataagcgaatggcagagccaaagccttccaagttaaggtcctgctgagggtgtttgtagtgagtgagaacgttgctgtggacaccagtagagcagagtctgtcggagtcccagcgatgggctcagctgtggattcaagcctttgccttgactctttaccagccaggtggctatggacaagcctggtaagctttccaagccttggcttccctacctggtgttggtaataattaatagtacagacatagtggtactgtttcaggacgagctagttagtgtgtgtgagatcctgtccacgtgggcagcacgggttaagtgtcacatacctagaaatgaccgaatatgtggttagcagctttcaggggatctctcagaatgacccaacatagctcttgctgtcttctaaaacactgatctgttttaaaggctctattcatgaacccatagaccaaatttttttttttttttgagacaggattttctgtgtagccttcgctgccctcgctctgtagaccaggctgggcttgaattcacagagatcctcctgcctctgcctcccctgtgctgaaatcaaaggtgtaccaccattattacctggctatgcagaccagctctaatctttctgaattttattgatttttattgaaaatggcagtcgataggaaggacattttagacggacactggcctttaggaaagaagtcaactggcatttccttccacaagtcttgatcagcctcagtacatgatacgtcattcacttgtggcagtaatcctgtcttctttgtggacttacaaacttagcagagagagaagaggaagcagaatttctcttgtctgagcagcaggccaatctgctctttctccagagccaccaggggctgcaaatttagagaggtgtaggccatttggcttgctctatctggctccaagggcaatcacacttctaaaagggttgttgactgattacttcttctgcagtattgaccataagttgacaactctctctcagagctgtgtgtggctcatacacgtggccaaacttacgctcctctcaatagcgttggtttggagatattttaggaagagcatccaccggtgaggaaaacaagccccagctcttcggagagccattcttttctccctttctccttgtgagaccaatagctggtcatcaatatgaagaaaactaatctgagtagttgtgcaaattacgacaataaactcagcaattattccttttactaatgtgtaatttttttcctggacttgtatttttccaggtacatttctgttctactttgggtgcctctgaaatgtctggatgttttatgctgctaaaattatatgggtctaaaaatgttactagtgatgacacttacatagaagctcacttgggctcatgctagcaaattgctgcaactgggccctctacccacccctctgccatcccactaatgtggtatttgaggcaaagggaagaaagagaattatcgagttcaggtgcagccagcaagcctgtcatgagaattttgttttagtcttgtcggcagaaaagtagtggggtgttgttgccatagtttcagtgaaaaatttgaccttcgctataataacatacagttagagagaaccagctaactggttttctaaaattagtattctctagtacataaggcagtcagaacagagtttttaattaaatattatccaaggccataaaagcccgagggaatgcagtcctctgacctgggcaggggaggacggaaacccgtaatccctcttgattggtcttttggaagctaggagaactggagtggggtattgggttgtttgtttttgtcttgttttttgaatatcctcattggttttattcttgagagctgtcagaagcgagtttatacagcttgttgagagagcccaacaacaccctacaactcacagagcaacccggcagggtctggcagtgctgccgggctggactggggtgctggcaaggtcactccttcaggtcagggagtgtttgcagtgaaggttgagacttcctgagtgaaatcttggtgttttgagcagttccaacttgtttctaaactcatactcctttgaatgcttaatgtgtcattaaatggagtcagcatctctgtgttctaagtagagctgtgttctgcctcctccagctctgtagtccttccctcactgagctgtgatccagtcccaaaccgtgatctgtacacagattagataatatttggtatctctcaccaattccagttaagagctacacgagtttgtttgtttatttatttatttatttattgaacttgactggaaatattgaaaataccattattccatgttttgtagttcagaatgaggtttctctaatccgttgctgcctttctcgccctttctccttggcatggtcatcccagtgtaagcctagcaatggtggaagtcggaccttgagttcacaggcctccctattcctgagattacggcctaggccagcaggtccagaccaggcgcagttgagtgctggagttatccccagggtttgatgaatttctcttgtgaccgaccgttccacaccagttgcctttagtaagttttctcccctatactttttatggtttagctttgtaattttaccttcggatggttattagtagaatctgaaggatggagtgtacatgtgggaagatggatcacctgtttgcctctcctctctcttgcgatttgcttgtttctgtactggtgtctcagctgtggtaatggcacattcatccctaggaagacttgcagaaaagcagccccataggtgagtggattgtaaaagcgcctgcctgctcctgaggctgtctacctgaatcgttcggaattgcctctgccctgcaggaattagagtcttagggcaagagacaagccggaagtgctcagtggattgttcttgggagtgctggagctcaaccatgcttttattccattaggtcattgtgtccaaataatttgaatccatctcagtaataatagcttaaaaatgcaattagagcgctcactggaaaagctaggcatgcattctaaagcacttcctggtttccattatgcacacgtcctcaggcccttctgttaatatggataacagagttgctattccgtaaaccatccaagaggtagcttgtaacaggctggctggtggaatgttcaactagaaagcactcttgatttgagggtgataggcctgacccagagactttattggctcagataatctccactgagtgacatgaggtactggaagttaatgatctccccatacacccttactttctgtggccttactctcttcggtgtccttgtccaacttttcctttgttcctttgtcctgtgtgcttgtggttttggggaatggaatcttgcaggtaagtccaaagacgcctgcctcagctgttcagtttgaccccatgtgaagacttactactggctgagagtctctctgtctttaaagggctgtctcattttaagtcaatatcgtacgtttattctgctttttgaaaatgtactgtcatcttaagcgttatttctttaattcctgaaggaacttgtttgttccccaacttccctcaatgacatcctgctaccaaatccccagagcctgtgattatgtctctcctgtggtaaaagaaacgtcacagatatgataaggaccctgagatgggaagttctctcctatttccagttgttctccggaaatcacaaggggcgctgaaggtgtagagttggtgaggatcagaagtctgaagtttgtggccctcaagcaacagagtgagtggtacacagaaagcctgaggaaactttctcctgaagcttcataaggaactcccctgcctactttcaaatttaatgtgtgtgtgtgtgtgtgtgtgtgtgtgtatgtgtgtgtgtgtgtgtgtatgtgtgtgtgtgtgtgtgatgtgcaccagtgcatgcatgcacttgggaaaagcagaggtcagatgttaagtattccttggtagcttcctaccttatggtgtgagatgggggtctctcagtgagcccctgggatactcctgcttctccggctctgttctaggattacagctgcagcatgcagcttgagagactaagtagtctttcagcctcttaatgttctctcaagttgaataattaatttgtaaattaatttactcttcaaattaagttgttaagcatcataaactatcaagtgccctctaaatatcgctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgcccaacatcctaattgcagtagtgatggcatggtatttatgtgtgtgctcaggttcacaaaactatggaccaagcaagaacagtgaatggccctacacataacatttgtaaaaagttaaatttcaacagtggattatgtcagtttgccctacagttttttttttcttttatgtatggggaggttatactaatgcctgataagactgaaactgtttgtcattgggaaggctgtttgttgttgttgttgttgttaatgctttatatactaaagcttattttggcttatgctaaataaaacattggcatcaaccctttttgtatttttgtgggtaaaacttaaatggcctgccagattttagaaatatgtctcataagctatatctgagcaaatatttagacgccatcccatctttgcctgctcagtaaaatctttagttcatttccatttgttgaggacatcagcatatttagagttaactttttgtatgtgttccctttgtttgttttcttgctctccttctttgaagattttttttaaaattgctatttcacctattccatgcgtttaagctgtgttggatgggggtttagactctgtgtgtttgccttagagattgcccaaatgttttactgtgcacgtctcattaagccctgaagttggtgggcagtcactctttcctacaatgtcaggacagtgaggacgcttatgctactgtcccccactcagaatatgcttttattgttcctaatgatagggcttgttgttgtttgcttggccttgcagagtaagtataattttgttttatattgccattttaaaaagttggcctgacttttgtttttactaaagctgtgtctcagataattcttttctgcttcaagaagatcccacagctctggggaatcctgaaagtacagtcatttctttgtgtctttctcttttatccttaagtggcagtttgcttggtagagatttgtagattaagaatgccccacaccccccccccatcgcctctcccagatttggcctagaacctcccttgtcttttctctttgctgaccttcagagcttctctcttcctgtgatttttgcagtcttcctcctgcgactccaagggctcacttccctccatttgttatgtacactgctggggagatctccagatcccaggttggtttttgtaaacaatcctggagaactaagaaccatgcaaatgctctctagttttaggatatcttttttttttaaatttctcatttttgctatctagtttgaactttcctatttcacataatctattcttgtttactaagtctatcctatgatcattagagaaattaattttgtatatatttttatttaaaaaaaatacatttttgtcttctccagatgttgatcattcttgttcctccatgcttcaagccttcactttattttctgttccataaagatttcctaaagtagtttatttgtcacagttgtactagttaatatagggtatttatgttgcaattttaaagcgttgtgttgtgcttttgatcacttgcttgtgcattttttgcatttcatctatgagccctggcttgaacttatactccttcagaaggaatgattttcttcgcctgttgcctgaagtgctgccaccaaaagatttgttgaaatcaagtttttaggtttttaatgtttttttttattttgtttattttctatctaagaaatctacagatttccaatggggcatgaattcttgtgacaaaccaatatgagggcgcactctggttctaaattattataactgttgtccccccccccccctcgtgggcacactgaatgtaaaaagtaagttactattatatacggcagacttgtttggtatttatcatataaactgagtctatatactcaagggttgctcctcagaatttgaccttgagtggggctgaagacagccagagatacctagggtttctagaatcccttagaagtaatgcttgcctaagggtagacttgagcccctaacagcttctctggatgcttttaaagtgtgttttactatttcctcaagctttttgtttgagttgagaggcccattcagggttccccatctgttacactccaaggaaaggaaatgcaaacctgtcaagtcttttgttcacaacaagttcgttatctgtatgaaggaaggcagagttaccaggatcgcctccaatgaagcactgtaaagatagaatctttagaaagagtctggtctcttgtttttgaatattcaaattataggaaagggactcaagttagtcttgggttagatttactccactaaatcagtctcacttcaggctcaaggattatggtgttttgtggtaatatggaagctcacatggaaactctgcactaataccaggtcaaactaaactaaacaagcagataaaagagtgactagcttacaaaaggtgctatgcagataagatatcccctgccgtggattagggctctagaaggtttcttttatctgctaggggtgcttttcattacagtcaaagaggtctatccatctaactatagcagcataggggctgttaactgttaggcagaaagctacagtgataccctcagtattcgttttaacttctctattggccaggtctgagttcttttcatagccttgtcacttcgtggcttacagaatggctgtggcaggtccaggttgtgtttattttcctggcaaggagtgagaggggagagctgcagcctgagttctggtctcactcctctctcttccgaggcccgtcgtccgtccatccgtccatccgtctgtccgtccgtcccgccctccctcccagccagctacttccacaggtcaaagctgtgtttccttctctctctctttcaaagagtgtgggggaagtgaggtgctctttctctcacagggttaagaagccacgaatcagaaaggtattggaagtttttagcatagacaacagggtacatcttgttacattattgattgcacacggaggagcccacccgagtttacaggttttagtgtttttcttttttcctgttgaagaacagtggcttttagcagcagcatctgttaggaacaagcagttctctatctagttgaagctgtctgtgaaaagggatcataaatgaatacaggcaactgtatgtttccccagtggttttgtcttgtcacttttctattgctgtgacaaaacaggatagcaaagctttgaaagaatgcgatagatgtgggactcatggctcaagagcattggagcaattcgcagcacatttgaatgtgcggtccccactcagcaatgaccaaggtgatcatgaggttaatctccccctctctttttgtgttcttcctgagttggaagaaggaactctccaacgggctcagaagggctcaggtagctagcaggagtatcgtgtctaggagctgttagaagatgcagttgctgatacattagagcatgcgtgtactggaaccttccacttagctctctgtcttccagttttcctcatctcagcttggtggaatttccccctactaggtgtggggtgatggtgaacaatattttgtgacacttgagtcagctaaaaattataacaaaaacttgagtatttgacccatgttccgctgccctgcccggcagtggcgtgcgtgcactctgccctcagcaccagaagccttcgggccttattgtgttctgctgttgttgccttgtttcaaacatcacacactatctaaaaagattgtgaggtttttctaaagaatggaaaattaattgaatggtgcatgtataggatggtgtttaaaagtcaataaaataaaccagtcccggagaggactaggcctctttgttgtcttagacttgctgtgtgctatattctgatctaagtcttgcatgactaccccaaggaagtgctatgtgaggaagtatgagcgtggcagataggacaaggaaaccagagagctgactatcagtgttctggaaacagttttgcctcaggagctggacaacttgagtccatactttgctttgcctgttactaccaacttgacctcctggaatgccattgccctatctggacccttggttcttcatccatgatgtgatagtctattaggcttgatagtaaagcacagcccagcttcctgcaagtctatgccatgcaggcctgagccaggaataatttacattgtgatagtatttacagtcattcttatctcttggtaaaatttaatctctggattatgaaagagtaggcctgacattttgttcttgtttcttatctttaagaatcatacaatcagatggatagtggtggcacacacctttaaactgagctctcagaaggcagaggtagagaggcaggcaggtctctgagttcaaggccagcctgctctactgtgagttccagaacagccaaggctatacagagaaaccctgtctcagaaaaaaaaaaaatcacacaatctttaaattagagtagcccatttctcttcatatttatgtatatgagtcaccaacatnnnnnnnnnnnnnnnnnnnnnnnnnnnnnnnnnnnaagttaaaacatttttctatacttacccacaatgggaagctctaacataagcaacgaaaagactggttaatgctctcagaagccctctttcagtttttctctaaatagcatggatttggctttcttgcttgtatgtcaattcatggcttcaaatgacgtttgcatgtagggaggcgaaacgacacagtaatgatatcatggtaagactcagttaaattctagtcaccacttactgtaagcgagggctgttgaagagtagtcaccctgtaaaataccattcccagcagagttggtcttttatgtatcttataggtacacagtaattgttcattcccgtataattacactagcaatataattcatttacctgccacgggcattagctttgatctccccagagttggggcagtattttgatagatagggccgaagaaaaggtacaagaccatttatttaaaaatattaagttcatgtttttaatgaactcattaaaattctgcatgtgcacaggagtgggcatgtgcacctgtgtacatgtggcagccagagaggcttttcattggttctgcaagatggagttagaaacactcgcaggaagcgtgtacgcagatctgaactctggtcctcacgattgtgtagcaagcattcttaactgctgaaccagctcctcctgcctaattagaaaattaaaatttatgtatgtgtctgtatgagtgtttgtgtttgtgtgactagcacatttcttgacttgctattcttctcagtgccaggcgttgaatccatgactttttagatgctaggcaagcacccgaccatggagccacttccttagcccagctatttcagggcaaggggacaaattatattgttttgtttcattctgctattttagattgtttttcaatactccacctatgaagtaaagctacaagtcttttttttttttttggttttttgatacagggtttctctgtgtagccctggctgtcctgaaactcactctttagaccaggctggcctcgaactcagaaatctacctgcctctgtctacggagtgctgggattaaaggcgtgcaccaccatcgccctgctcaaagctacaagtctttgaccttctgccaaacgcactcagttacttctcatttgaattcaaacatcagactctatcttgactcccagcgtaggtcagaaccttgaagagtgattgaataaggataggcaaaaaggcttttagaagtcatcattaaaaactgtttgcggatggagtctctccttggctcagcccaggtttgttttcagtagtgggtaaagttaataagactttaatctgactgtaagtggaaagacactgccaagattaaattgaagttgaattaaaaccagggcaattgaatttgtctaattaattgagaattacgtctcagtctgtgttcgtcttcagttttttcacctctgtgccaggcaaacacccagtttggattagttacacatttggatgaactttcccagaggtatctgtagcaacgtcatccaagaactgcatgagtatctagttgtacgcgtgtgtgggaaataaggatgttcttatcgttttagtaaatagtcagccccgcatctctcatcctttgatggtgtttaacttagtccaccaggcttagcagatgtttaatttccgtcacgaagaaaataaggttcagtacctttccctgcagttatttacctcttcatgaaatgtacaggcagcgatgaatgcattctttgtcctgttgactgggccagtgccagtgactatattccatgtcctctcaaggggacgtgaaaggcatttcatggagggggaatcttacttaggttatgaatctcattttagggctatggctaagtggactttcagatttggttagagtttagagccccacattatctctctaaaaccagagaaacagttcccagctgcgaaatttgcacttgacagtggtgggtagctggtccagttctcaccaccccttgggacatttgggttgtttatttcccctctcagccaaaaaggactgctcaattcagaagctcctgtctgctctcctgttgttattcagacatcacttgcagaaacacgggctggcttttcctagagtgcagatagcgttgctgaggagtccgggctggaaagtcagcatataaaaccttagtgtgcctgagttgtttgttgttgtttctttgagactaggtctcactatgtagccctggtagggctcaaactctgtatgaacaccaaactagcctcagactcagagacctacctgcctctgcctcttgactgctgggattaaatatgtatgccactgtgtctgatttaaacatttacttatctatctatctatctatctatctatccttatagaaacggttggctgttagaagaagtatagtgtgtaaatatttcatatgtttattccaaatatcagtttgcttaactagtttaaataaatatcatgagggctgctaagatagctgccttgggtaaaggtacttcctgccaacctgggctctgtcgccatttctcacatggtggaagaagaagatggactattcaaagtcgtctgttgacctgtgtgtgtgtgtctctgtgtgtgtgtacacaaataaatgtaaaaataatggagtttgctttttgtgtgtgttaacatgcttatatgtaggtttggggatgtgtgtgtgtgtgtgtgtgtgtgtgtgtgtgtgtgtgtgtgtttctcagttgctctccacctttggtttttaggacaggtctctcactgaacctggagctcatggatttgactggactaactagatggcgagcttcaggcatccacctgcccctgagccctcagagctgagctaacagatgcatgctgccacactggcttctgacatgagtgcttgagatctgaactcacaggtcctcctgtcctgcaggtactctacagatagatccatctctctagctcccaaagcaatggctctccaccttcctgatgctgtgaccctttaatatacttacttcctcatgtggtactgatccccagtcccaaccataaaattattttagttgctgtttcgtaactagttttgctactgttatgaatcctaattaaatatctgtgttttttgatggtcttaagtgacccctgtgaaaggttgtcgctccaccccatccacactcacagaatgacaaccataggatgagacccactgtcctagattaaatatactggcttaatgcattgacaggaaaagtttatgacatttagttgtgtatgaggagattgaaatcaaagtcacaagtgaccttcaaagtcactatggctatttaaataaagggggtatgtatttttctttcttctagctaaaaaccaaatcaactatttttctttagtatgacataataaagaaataataaaaaacaattaaaagacccccttgagttgttaagcccctaccagttccatcctgaatgaagcccagaagctttgttccttgtgagcatcagtgtgccttttgcctccttccctcttgccccatcccgactttggagcctctgaacaggtgattttcttaagggtcttcttaaagtgttgtctttcattactccacaaaatagggttcttgcactcccctctgttgagatttgaaagtctaatcgaatcaaaacataatctcgctcatcctgggttttcatcaatagcttctggctctttcttcgccacggggtagtgtcagttgccggagaagcaacatagttttaactctcactctgtttctctccacccgttgttgtcgtctctcctcctgtgaagtgggtgatttttatgtagaaaaggtccagtgccacgatagcctgggtctttctattaatggaaggtccagactgagtctttcttcccttcccccaagaaaacgatgtgcttccctggagacaaccattccgtgctctgcttttccctggagggctgctcctactcctctaatcaaggctgaagcatttccggtgctctctcaatctactgttaacagccatcacctgccggaggatctgctgacagcttggcaccagcaggcctttgtgggcttcattgcctgtgcttaagttttttttttctaagaccccaggtccctttaagaagatactggagatatctagcccatgggttatttattttaaccgatttattttttattatttttccatactatatattcatatgggctatttaaagacacccagaggctgcagcaaactaggcccttgagcaagaacactatctgtgcatagatcccagtgtaactgccctacttatagacatactgacatgtacctgctaccactgtggtaactatgttattgggggctttgtgtaaatcatgtagtctctggtacataattgcaaaccaacattatctttgtgctttggcatgtcgtatatgttcctaaagcattaaatgaaaacaacaaaaacaaaaaatgaaaacacttgagactgtaatgagaccaattaacttcacccatgctatgacttgcatgttttgccaatacatgatggaaggggttaacaggaagccctgtttggctcaagagtaaaatgactccacaaagacccgaagtggctgaagaagagaaagattgctagactttgtgttcgcatggtctctggtgttgcggtctactgcacacagcaggcagtagaagtgctgtgtggaagtgctggcctatggagagggatggaccacagcagcacgggggatggaccacagtacgggagacgattccagctggggcttctcacagtggatgtctggaggccaaggctgcagggaaggaccttatgtgctgcatgtgtttagctgctctcctgattttgttctacatgtatcaaaaacacaaaaaagaccatctggtgtcttgaaaggaaaaataatgggaacagagggtggtaggatcgtgccagcattgctgtatttatggggtggactcttttactcgcctctcgtttgggggactgacgttgagggttgagcaatcatgaacccagaaaggttattttttaatgaacacagcctcatgatagcttttatgtataggacttttttttttcacttttaaaccagaatgcttagctttgccaagaactgcccatgcttcttatctcgagagcatagtttgcattttagttatgaagtgtctagtagatgtctcagggttggactaaggtcatagcaaagctagccttggctttggtcagtggcttaacattcctttagcaaaaataccactaacatttgcaatatctatagactgtgctctttgtggtgcggtaggcagaaagataataccccacctatagtgattttgatagtttgtaaatgtttcttctcttatttaagtgtaaaccctgaaaactgggaaggtcaggtcatggctgtgttattcctcctcttcgctgtctgacacgtggattgtactctcaaacaatttttagtagaaaagacaatttggtagatccaactgaactcttatcgagtagattttggaggtgctgtgttgagatagatttgccattgtatcctaacatagcagaaataatcccatgtatcttttttgaaaaatgttttaaaaattcttttctttgcatgggtatagttgttcgtatatgtgcatgtataccacatgcaagcagtgcccatgagatcagggtaccctggaactggagttaaggagtggttctaagcctccgtgtggggccttgaaatcaaacctggccttctgcaagagcagcttgtagttttatacagagtcatatattcagccctctttgaatcttttaaattctgttttaagttgcttattgtaatctaaaggaagacattgtttgaaggatgctttgttctttcctacctcccctggtagactgtgggcagagacgttatctttcttgttgtcctctgcatctccgctacaaaagggagcatctttctgaaaactctggcagtcatcaaaagcttgttgaatgagtgtgctataaaagcaaagaccagcactatttcattcatgtatgaactgtcatagaacatgcctaaagtctacttggagacagacagggtcattattagagaacttacaaagattaagttgggccatgaaagatgagtaagagataaagataagaagagccagtgaggctggaatgagggaccattctcatacagaaatcttttccttcttctttcttcttccctccttccttccctccctccctccctgccatttgccctagttacccgagattaaaccttttaggcaagcattcagccactgagctatattcccaggctattataagactatagtcacagatggatgaagtacaaatgtactatattttaccaataaactctgtgtgatgctgaggttggagcaggtgatgggtgtcagatctgaaggctcttaatggataaggacaatttgcttttgttgataatagtattactgttaatttaaagatggcctttcatggtaagttcttatgatgaatgaattccatacaatcaccttatttagccaacagagcaatcttattacagtgagcatgtcctagcttaaaagtttgacgagtgtgtgaaacctgttcagcctcatagtcagcaatggattctattcttggtaggaacagaggtccactgagcccagggtttctctgtgactgtggaagtgggatgtatccccctttgtttgctgttgtatgcatgtctgtgggggtgttggctggtatgtgtttatgtgtttgcatgtatgtgtgtgtgtgtgtgtgtgtgtacatgggtgttactttaactatatgtgcactcctgcatgtggaagcctgagactaataccaggcatcttcctccatcactaatttattcattgaggcagggtttctcggttgaacttaaagtctgaaaatacagctaatctagctaaccaactggccctggggatcccttttcttcctctgagccctgaatttcaggtgggttgttatgcccacctggcaatcgtaagtaagtggtcatgtaagtgtggtctttgctttcctcacatttgcgtcctccggctttagggtgttcttcatactgagataaatgggcaccatgtttgccacattccaggtgctctaaggtttgggaagaagaatgttgcccacttacaggtctggtcactgcatctcttttaagatgagtctggtgtcataagcattaactctattgataaatttggtgaggcttggatcaatgaataattctcgtgtcagctgaatgcaggcagtgttttggagctgatctacagtgatgcaatcagtggtagattgggggaggggcaggggaagaggaggaggtggtgagaacaggatgctgattaaacagtaagttcttgtgttcctgtttgtgggttgctgacttggattgcctgtgtttatgaatgataggataaacatgtttctgatgacaatccagagagggagcaaaaatggcagcaaaacaaggaactgttgctcatgcatcaactggtaagcagcgctcctcggtagcagcgcatggcagtcttgtgggcgttgggaaggagggaaggaagagtctgttactgagagcacggtccgggatggagctgtacccacgcaaagtatacccaccatctggcctgggctgtgcttccgaaacaatggcccacggcttatagagtctgataaatcctgagccgaatggcagcatcgagtttttagtgtatttagttatagaatgcactggtcctgttagggagaatggtggcagttacaggaattgctgaatcctagtatccctaagatgcgtgagccaccttaagcaggtctaagttaggggacttagccaagacagacagctagttagtatggagacaggactacggcctttgagagacatctgatgatcatgcttagcagtttgctgtctacctttctcaaagatctcctgcccatctgaaggctgataggaatcagcctaagagcacagttttaggagttttcttgccccgtaatgactcttctggaccttgctcttgacacgacagtacttctcggccttccccgtctctcttggagttggtatctgtatctacacgtttactacctagctctttttaagtgttgcagattattcgttttatagtataattatgccagagtggaattgtctacactcggtggtatatatacatttaagttattcatttattactgttaggagtagtattactaagttactaagcaaaaaattgtacagctcttctcttcatgtgctttgcttttctaaaggctggataaatattaactttttttttttaattgcatcatgatctttgttggtcttacaggaaaataagttgagtcagggaagaagttaacgaattacctaatgtcccataagcatgctgttaggatttcaagccaggctgatttcagcactgtcactgtgccctgagcattgtgctgcatttgagcagtcacagccttcccctagctctttgttcactcgtccaagtgctgatatgccgggtgagtggcacagccatggagttaccaaagctttgttttcctaatacagttttaaaaaaaatgaactctgttttgtcaattcgagttcttaggaaaagagttgagagaaatttacagtgttttctcattgactccgtgccccacaacccctatgcagtttcctgttgtgctgacaccatctaccagagtggcggaccattaggatagatgagtgacatcattgttactcgaagctcatagtgtgagtatttcaccctggacacgatgtatagaaagtggtgttgggcatatttgtgatagtgtgtccactattgcagcatctcacagaacacttgaactgttgtgacagcccctctgctcttgctgtctagcctcccaagtccctgactcttggaagccatcagtctttgaactgtttctatgttgttgtttcccaccaggaagacatgtagttaggataacaatgcttcttccacattgacttttttttagttactaatacactttttaatttcctctttatctcttcctggcttgataggtcatttccgttttagcactgaataatactttggatagacccaaatctctatccttatctctatcactctctaaagacatacaggctgcattcaagttttgccagttgtaaataaagctgctatagacacccataagcaggttttgtgtggatatgttttcagcacctttgggtaaacactcagaaacatcaagatggcttctgttgaaaatcgtcttcaatggtgtactccttacttagtgcatccagcctcttgtcagatagaaaccatcaataatttagtaaagtgtttggttccagtttactcatttagtgagtggcagttagtgacttgaacccagagcctcaactttgaaatcacccttcagtttctttttgactgtgttcagttccttctcattgggatgaactatgttagcaggtggtttgatgagacctgcaaatagtgaagtgtttatttccagctgaaagaagagtgtgtgtgtgttttgtttatgtatgtgtgtggaggctgaaaactgaagttatcgtcttcgaatttgctttttttcttcacattaatttgacttatggtgtccttttctcctctaccagaggagccgtacaggactgtgactcagcccaggaacggtgggacagtcccggttctaaatgtgactctgaatttggggtttcaagtggtgattttggcctgagtgtaatttcagcaacagtcacacgttcacagcataaactcatctaaatttatcagtcactgcatcgtaacaaatccatgtctcattccgttctctgttttctttcctacaagaatattctgcactcctgagtaagttctgagtagcattggactatcctcaaattggccaatttattaattcatcttgaaaacttggaaaaagatgcttcggagtggatgttctgaatgagatttttcttttatttggcaggcagagttatgtaaatacaaagatagtgtaactgaagtaaagtaattctaatagggtaggcgatcggatgatgagtttcaacaatgctgaggacgcactacggcagatgggacaagaagaactaaaagcaacagcaaactcagggcaggggtcaagatggagctaaaggaaattcctgaatttattttatattaaaatatgtgtaaatattaattgatttaaaccttataatttgaaaaggaaatgtactcacattatattcctttgtatacattaagggaaagcggccagattcagaacaataattgccacatttttttccctttatatatggaatctaatttaaacaagcaaaaaagcaaaaaacccagaaggtaaaaagaggaaaccacgtgggatggaggaggaatgagggagggtaatgatggcaggactcgaaaagagggcatggtgcaggcacagggaaatgccataacaaacctgccattttgtccagtgaatgcacaaacttaatatacgcaataaagcaaatgttgttactgaaaaacagaaatgtagccatactatattacttgatatgcacagaacaatactttcatgatgctagttatataaactaccaaccagctcatggttagaaagcagtaaatcagccttgactatgaaaaagaaagacacagacttgagataatcaggcatagaaggatgtggagatgtgtgtgtgtggtggtggggtggggggggaggggcactaagagcttggagtttagtggctgagagttactgtaccacaggtaaaaccctatgagttacatgggctcctaaaaggctgttaccatgttaaacttcctctgaaattatagctgggtccgtgcttttctgtcagagagagcagcagaaacttcgttctcctaaagccctcaaaactaacaagagtctgggtggacagagtagctttacctcacaggttggacaaacaggagatttccttgccccgtgtaaactatcccatagtctctgcagaggagaagtggtggtggattgtggcaatatggccaagcgactggtggtagctccagattccctatcttggtctaactgttgatattgtggttgtttaaagttcagcagactagagagcttggagacctggaatcacttggcagctttgaggattcagggtattattgtcttagctgtggtattcattgatatgactggaaatgtccacaggatgaagtggacttgttccaaatgcctccccggacattttctgcacctgacctggttggctacgatgtgctgattattctcctgtagtggtggttttggttgaagagtctcaaaagagtggagatgctctgccgggctaggtattggattttcttataacgataagtcagtgaaattctgttttattgaagaacttccctagttgagaaggactgtgtcaaacttcctaggttctcttaaaaattttcagccagttctagcaactgataatgataatggtgggtcaagaaatcttggcacgattttttactttttaatctagatatttgcaggtgaacaatttgccagaatttatgtacctttgtgatccacaagtcattataatacctttttgggcttaaatgttttgattttgggaagatagtgtgataaccttcactgactgtaacagagggggaaaataatctttattacatacttttatttctgacttttgaatccgaaatgggttttggaaaatgctatattttcctaggagtggcagctataatcactattgctgccttcccacccctcctaccctacctgccttccttcccgttcccaaccacccgtttctgtcacagcattagattataatatttatcatctagcttgaataacttaaaggctttaaaaaatgaacttggcttaaaagaacatgagtaagcagataactgtttgttttcctgtaaaggtcacatccaaaattcagtgctcctgacttttagaatggccatttttcttagaggaataatttagacaagttgaattgaatagctctagcatctttggcatttattcaactttgtctttaactcccgttgtctgaacaaatcttttacagagaatggatcgtaaatacacatcacaggatccctaaaagaaaagaaaagaaaacaaaacaaaacaaaaagaaaacctatttcattttgtcttttgtaagaaaaattatgagattgtaatgttaagttgcattaagtaggcttgcattttgaatgatgataatcccattcgtcttaaaatcttgacttgtggtaaccatagatttttagttttcgttttactgatagtgtgtaggagtagggggaaggaggaggcactgagtgggtgcagcagttggcctaattgtttaaactgagattacttaggaaaagatatctgacatgtttactttacacggagcaagttgtttacagtagagatcatttaaatgtgagttaccaatatctcaagttttacatttgccaaccctgtatgttgagattttccagaatcttacagtgacagccggtcctctaatagacagtaggactttgcacttagctaaaaatagctcacctttggaggtagaactccttttccaaaaaatatttagcgcccacagtgaagtatgctaagcatgggagaggcgagggtaggttgtctctgccctactagggcttgctctcttggcaggtgggataagaaaccatacaagtaaacagtggcttgtaagatcgcacccaacacagacaaatgcctggagtgtggagtatggagatagtttacagtggtgctggaggcaatgtgctagaccagcactaacttggctgatgagggaagtcttctacagaggtatcacctaggctggggtttgccttaggcagctgcccatatgagcttatataagaaggatgtgcaaggccccacgaaccacaaacataaaagccaggtcatgaacacattagcactggagaaaggaggagagcatcagggaaccaaacggtgactccaactcagtcatactgcatggagtccagctgtgtccagctgttttcctcctctagtcagggaatcagaatcatttgatgaatttgagttttctaaagccatgtaaagttaaggtgaagaaaatcccgatttcctcttggtctcggagttgtacccatgctccacacatttatgctgctcctccttcccttacctgccctttttgtcatcatggatctcacaggatcctttaggctcctgcgtgcgggccaataaatgaatacgcatacacttagaatgcgggtgcatgtgctcatgtctgtttgttaaatggaaaaaaaaggtattgtttaggtgttggttcacttgcttatgctgatagaaggtttgaaagacagaaaatgtctcgaaggctttgtaggcaagcttgtactttagggcagagagcatcaccggatcctggctgtgggctggctggcggtagtcccggtggcggctttgttattcattgctttgcctacttttaatcatcatctacccttgatagtcatgtgacacgtccacttactaaagaattattaaagacttcattaagctttttttttttttgtaatttttatttttgtgtgtctatgtgtaagtcagaggacacttggctggagtgcattttctgatttccccttgcaccgtctgagtcggggattgaactcaattgttgttgggcttgatgccaagtgcctttacccactgagccgtctcactggccctgcaactatttacaaagatttatttttattttttaattgtgtatatgtggatggatgcgtgtgaggatgcccacggaagtgttggattccctacagctggagttaaaggaagttgagagctgccctgttctgggaaatgaactctggtccaccacaagaacagtacaagttcgttaccatggatctttctctccattcccaattatagttattttaaagccatcatataaagtagggtgtactctgcattggtgtacactcatctatagtgaccctgtaatgtcacatttttatgtactgtatatagttttatatgaagtaattctttctatggaacttaagatctgtggcatcaggacaggatgcctttgggaagtgattcggtcatgaaggttctgctgtggtatgggtgagattggtactcagtgtgcttgatgtgacggaatacctgtttggttcattggctttggctcctttgtaccattagtcttcttgatattcatgtgacatgttactctccaaatgtacctcaaatatggaattatagctaaaatcgtattacaacttaagggaggaagagtttgttacgatcattggtgttaaggaatagagtttgtccttgtgggcaaggcatggtggcatatcatgttggaaggaatgtggtggtaggaactagcccttactgtgtgtcacatcttagtaaattaggaagcaaaatgtgtgggcaggaacaagaagcagatatcagtactaagacataggcccatgaaagaactcctcattggcaagattgacagagcttctataaccttctaaaacagagctatactttgaggacgacaagttcaagcacaggagcctacggggacatttcacatttataccataatggtcttcattataaaaagaagcctgttggtttagagttttcaaaatctacttcaataagggttcttacatgctttaacctcccttctagcctaccgccctgcagaggtagtagaaaagagaggttattagtccctgggggaagtggacctgcttagaactagttcttctggagatgccaatctttgatatcaaaatatcagcagttcagtctactagcaaaccagcaaacatgaatcagcagcttcattccagtccacttggcagacaccacacattagccgcagtccactcaacagacaccatgcataaattggcagtggcagctggatccagaataccatgagaggttcattggcaagttactgtctatgaagtcatgtcaagcaaagatcagcaatggggtataagactccgggacccagagcatcattatcagacactaacaagttggtgcaaggtgaaccaaagcacaagccttgttccaccagctgtggtcatatttatattctttctaagcatcacatatcctttcacgtgtctgcttcagcaaaacattatctcacctgtttctgcttcagtaaaacaccctttcacctctctgccccagcaaaacatcattatgacctaactgaatctccaaagaaaccataaatttccacttcagagacccatggggatggagtagtggctcactagttcagagcactggctcctcttctagaaaacttgcattagattgctagtacctacatggcagctcacaactgctgtaactccagttccaggggaatataaggttctgacctctatgtgtccaaagcacacacctatgcccatccacagcttcccccaccctacacagaaagaaagagacagagacaaagaaagaaagaaaaaaagaaagaaagaaaggaagagaaaggaaggaaggaagaaagatagctacattgatcgataaggtaaagcctgagagagaaaccttgtcttttttttttttttttagtacctagcaaagaaggtcctttgtgtccatgggcaactgggctctcagtaaactaaaatttccagcaattttattgtacacttttcagagtttgcttatcaaccatcttgaatatggtgttttgttgtgtggttcaaccttcaaccaaagcgtgtgtaatctgacagagttcacagtttcctacaaatacctgccaattcctcggagcccttgatcctatttttgagggtaagtatctgggaaataagtctcctttctactcagtagcaactaatgtttactgcgctgtagcagactcaggggtccttggctatttgtaaatcacccaaagcatcctttggaggtggctctaagctctttgtctttgcacttgagggaacccagcctgacttctgtgaggaaactttgccctcaccaccatatggattctagtttcaacactgttcttcaagctgagctttaattggtaggtggatgaagtatccaaaactactagcaggagagtccgtagtcaccaatccattaagcgttagagaagaagtttcttgttctgcccctggcttctttagtgaaccctgtggaccttatcccaggaagataatgtgatgtatagtagcactgtatgacttaaccttcaggttatgacattactatttctgaagcactctgaagatgaaatacttgtgatcacttaaattgaattttgtaccctactgccaagaagtacacaggctatctccatccttttgcagctctcttacatgcaggacagcgttctcccaaggtgagaggctgcattgctcatcctccctggtgctcagtagggacacttctgagtggttactgcttgactaggcaggattctgtaggccattgaactgtagatactatagactggagatgtgctgtcgaaacaggttttaaattcaaacttttaagaaattaagttgaatgtaatgagatttggcgatcaatgccaaagtcatttgaaaagcagttcttaacattttgctaggtattttaacttggaaattgatatcagtattcaggaatgttggggtaggggaggtaatttcctcactcttctcctgtcttttcattttgtcttaatatgtgtaccaggaagtccagagttgcctatcatgaatccaaacagcataatggctgactgtatcctgtcattgctctggtcgacaaatccctgcacaatagtttgtggcatgctctcagtgaacttcgggaaagtgtcttggaggtaggagaggataccagaaacccacaggacaaatacataaagaagtcaatgctttataagaattatgaaccaagaggatttctgagttcgaggccagcttggtctacaaagtgagttccaggacagccagggctatacagagaaaccctgtctcgaaaaacaaacaaacaaataaacaaacaaaaaagaattataaaccaaattggaaattgatcttcaatcttttaaagtttgttcatccagttcgagagagttaacaattgcttttcaaatttcccattaaggaacaccgactgtgtgtgtgatcagggtgttgtgacatcatacttgctttctccagaatgcaggaaccatcattcctgtctcccctgggagtgggcttgtgtccaattgcattcacgtctagaacctcagctccaaataaatacagctgaaaggtaggatacagatgggccatttgaggcaagaatgagcctagacactgttatagttcaaggcaggaagggaaagaaataccattgtctggtccaggacacacatatgtagaacttttaaatacactaaagaagcagagctgcttcctaagttacttgtgcccaaattatcttccctctccactccgcgtcctgaggtgatccatctctcgggcctgcatgactatggaccggacagtaaccagcctgaccagggccatgagtagtgctaggtgcttttctgcaccaggagctgcggaggtggttttcttttctccatgtcctctgttgtcaggagacttgagagtttagcaggtgacatcttcccctccattttcccctcctttccaatctcttctttcaggatgtgcatttcgagcagcaagacaaggtagattacatctgagtgtctacatttgaatcctgcctctgccactcatgacccaggaaggtatttcatttcctactcatctgtgttggtatgaagtattgataccagtaatacctatttcgttagtctgctgtgtaaagtgagttagcacatggcgaactcttaaaccacacttgctaatgtcttcagttagcattacgtgaagatgagaagtactcttgtcagttcttccctgagtgacagacgagtgagtatctcaccctcattatttttgctcatcattattctatagtagagtggtaagacataacagagctggttgccaacagaatcgttcctggttgaacttcctgagatgctacaggttggaggtagaaagatggaaaagtataatgagataaattcctttctcttggaacttaaactgttgtaggaaagccgactaatcaacaagagattgcagtagagtgtagagaatgttaggcatcatgaataaatcaagattcaagccaggaaaagaagaacagattagctaaatggaatgggcttggtcacaggagccatcacagaggagatggaacttgagagagagcccgtgaaaggtgtgtcaaaagacaaaattaacaatgaatttagttgttagatctgataggctttttatctctgagtcataactctgggcagcatccatcctacaaatagaatgccattgatcaataatagaacaatggcttttacaaagtatgaataagagaaaaataataactagtgattatcattatttaatccacgttgctgcatgtaacagttaagatagagggacttgcttataaagtcagctataattggcatggctgggaatttggccattatttctcctttagcatgaatgactgtacaattggcctaggacaggtgcttagaccaaaccaatttttatttgttttgtctgtgttgtgtgtgttcattaatcttaattcttaatgagtaagggcatagatagtggaatatttccttgactctattgctcctaacaagtcaattatgttgagataagaaagctgactgttggttatagcaggtacatggtcactggaaatctgcaaggtcaatgcagtgggtgggatgaatcagagccctaagaagagttgatcctgatgagatttttacaataaaatgaccagtgatgttgcttagggtaactagagagcacaaggcagtactctacctgtggtccccctctgttgctggtgtccacattgtccctcagggtgtgtgcacacactttctttttctagttcagtcagggtgtgtgtacactttcctctttttcaatttcagcttctattcttgtccttttcacttcccgttccacagagctctgctgttacctgccactcctgtgcaggcaaagatcccagcacagatgaaggtgcctttcctgcctcttccccaggcagggaggtccctggtgagcaagttcagtgttgactgtgggtggtcatggggagaacagcgtgaggaagagcttgaaagggcctttggctgagagatgggcagagctccaggggcgtgaagtcctacacatgcaccaggattattctgttggataaagtcactctagccaacgcagggagcttacaaaaaggagatcgaaaaggccatagctgaagtgatgagtgttctcagtgtgtggctggagtgaagggagacccaaggattgggcaggacacggtccagatgagactggaaatgttgatgaaggctctgtagagaaaggtttttttttttttttttttctttctgtatttaaatgatatgggcctctatgttattctggggatggtgaaagatgtgtttccttaccttcagtttttcatgcaaaatccaaattttgtttttaacatttctttttgtttaattctaatgttataagagtgttggagcatatctatatttctaatggtatactgtgaataaattatcacagtgatttttagaaatgtacaagcaaatcaccttttaggttcctagaactactgttacttttgtgtccatactttgtctgggatagagattgctgtcgtctgccactgaccagaacttagtgtgtgagaaggtttgctttacttgtcgtccatgttgacccctccagaagctgtagggcaatagtaaacccctggtcccttctaaacgcatctctgagaacacactttcttgtgtatcagtaggattcatggactctatagtcccccagccgtgaattccagatgagggaagtctacagagctgttttacagcatctttcaatggagacgtggatattttggtatttgagaataggtcttgaagcttgtcatgggagtttccaaagaccagctgttgaatgcatttatacatacttaatgaggatttttatgaatggctattaaaagatctgagggcagttatattcaggttcaaagaaaggatgtcctatgggaatttaatatttttgaactgttggcagaccacaaactggtatttactggcattcttgtgttcacgggtctaacataacagctgaaggttgcattgccatgcatttcctctcctcttaactctacttttgtgttcctttttaatgtgaagcatcaaatatttccacacacttgaaaaaaatggaactctttacgttttgtgcctgtaatgatgaatgtacatgcctgatagtttgtgtgggtgcacacggagctcagcatgtatggaggttaacggacagctttgtggagtcagttctgtttaaccttatgtgagcccccaaggattgaagtcaggccactaggtctgtgtggcaatccctacgcccacagaacatctccccagccctgcactcacgtttggaggcttgcttactgtctcactgtacaacacaagatacagttggtagaagaacgtgaccagatgcccagctctgtctcaggtgactctgaggttgttagttaggtgacttaactttcataagctcagcagcacagtaaccattaaatgaatgggccagctcactcgtggcagtttattgacaattttaacacttcttgaggagtagtggcactcttcaaaatttgttctagtgtgtgagcagcatttatgaaagctgtgctaacacgagcacatttagcacggtctgagagtcatgtcacctaaaaggacaagcagggctactataagcactctttgaagaagaatgatgtgtctatgaggtaagaattaaagaccttttaaaagaaaagaaaggttttgaatattctagccacttggatagcaagtcttaaataggagagagtctgaatgcctgataggcttttgcttcattttgtttgtctattacagtgattgatcaatcaactgtatcttgtatcatctatccagtatgcccagccttttgacgttgtgacatgaccctgtcatctacaaagttcatgactgagaactgcccagttgagttgcaaaacaacaataacaaactaaaatacaaacgaaactcaaaatcttatataacagtttaagaattttgtgttggtctacctttatagtttaatcttggctgcaggttagacatgttcatattcttgtggtgcaaattacttttagcccatatggggaaaggggtttgcctagcttttctgctttttctacagagtaataaaactaaatattaaaaatattatcccatagaggtgtcaaaagtgcatatgaaatataaatttctataaaatctcaaaattataaaaaattcttcatgacataattacgagtaggaaacaagttaagcacatccattcactattattatctttgacatacggtgattacaaaacgttagtagtgtgtagtgttaggctcattgttaaagtgtctgggtttgcagaggctctgctcagcttgcacaagtctgtccatgtgccttggggttgactgactacttaccaggtgacctattcaactgatccaaagcatgtccctttgggcagaacacacagtcaagggcagacaaggcactccacccaatagcaatttggcactgaaaagttacaaggcaaagggcatggacacaggaaggaatgagacctgggaccaaaagcagttcattgtacaagagccccttttcaattttatgttatagtcttggcggtttaacacaggcctcaaacatgttagacaagttctgtatcattgaactgtaccccagtctatcttgtaagactgacaaattttatacgtacagctgatttcatatcttaatatcatacttgcagtgttgcttttccttagctctttatcaggaattatctgatgatcagaaaaagttagcttcaagattactatatacatgatagataaggtaacaactgtatggcaccagagagtagacggggaacaccagaaaggacacagatgtgttagactccatcgattgtctcttgtgcagtagagttcatgaacattcttttctttctgctcttggctcttctctttccatctttattgtatgtaggactcaacgtggtcgcctcagtctcaattctgtcaagaattgagctctggggaaaaagaaaaaagaaaaaagaatttgagctcaaccctcacagttacctcattgtctgggtctaaattcatatccccaactccacatggactttttatttcccagtccactcttgagtagagcagagttttgtcttcatctttttctttttagtcactcattctatagtagaagacttttgactttatgttaccatgatgacaaaggcttacaagtttctgcctctagcctggacttctccctccaaccacagactcagcatacagtaaggtgcatatcttgtagacatctcaaacttataccttacctggacaacttgaattcctcttcataaacctgcatttatcagtcatgtcaatgttttgcttgtgtaagccttgggattcttggctaaatggtttttttgttagattggttctgtttgttttgttttgtttgtttgtgctgtgtggctcttgagtctttcccagtcagtctttattaatatcaaatacaaaatgattatagaaagagcaacgaagtccagtaataggaacatgctgtgccccaaattttgttcagccttcagccagctgtggtttaagaaaaaggacatctcagagtggctaagaggattacgactagttttggataattcaaacactaaaacgttgctaactggaatttaaaggggcataggcttattgtgatacttcttaaaggcaatttcaatgaatgtttacagaaaaaaaaagaagttagcaacttcttttcccatttattgctaaatcatttgtaatatgcatatattatagtgttaatatactgtgtatgtattataaaggaaaacagattggaaaacataatctaatgcagatgaaataaaatagttttagatttctgttctttaccatgttttgtgttctcatttcctggcatcttaaacaaaatggatacatattatcatcttatttatatttgtgttgttttttaaaagtatgttgaaattttccagtttgtactcaaaattccatctaacaactcggttttctttattctttttccttgtttgagtagccacagttctgcttctgtttctatgaatttgcttactttgtgtttaggcaggattttgctatgtggcccagaatggcttctaaattccccttgctgctccagcctcagcctcctgagtgctggacttgtggttgtcacagaatgcctagctaatttaggttccacgtgtgcctaagatcagaaaatatctgtggtttatgactgattaatttcacatagtaatcctgtggagcttatctatgttgtagcacataacaggatttcttcctcttcatgggcaaattgctttcattgtttattcatctgccagtcacaccatttaaacagtgtgactattgctgctgaggccatggtggttacacagatatcctttcaaagatatctctcactgcatcctgctttcaattatttgaacatttatccagaagtgggctttgcaggatcataatttttatttttaattttattttaaaagtagtcttcatagttcttccatagttgttttataatcccaataacagtgtacaaggattctaacgtctacacattaagccaaaccttgagatcttagctattgtctgtctgtctgtctgtctacctatctatctatagacaggctctcgcatagaaaataggatttttttgtttgtttgtttgttttggctttctttttcttttcttcctttttaactgtcaatgccagagctcacacagattgctttgcacatacaaggtagtgcaaaactgtatccctagtcccctccaccccttcacgtttcctaaacttggtccataagcaagcccactggctttagatacatagtctatctgtcacttgattgctttttatcctgcacatacatcactgctccacttcccccatccccgtcaactctttttggactgctaccctggtcttctagctgggactttctgtttgcacccttgcacagtgataaattgaacaaatagtctggcactctcctgtcctctatttaaaacccagttgacaaccatcactctgcagagaaggcctgacattttttccttggtttgcagcattcaaagcatcccaccccataagaacttgcttccttgtcacctgccttaagcatagtagataagattttttttcctgcttgcatctggtgtgccctcaatgtgaggggctgtgttcatggacattccttgactcacaccttcctacaattcaagtgctactgagtttaacctcttcagagtgttcccaacccccttctctgaaaagacaatgtctgtgaactgcttctagcttctctgctttctttggtgtaagtactttctcccttcaaagatatcagactgtttatatttgtgactttccttgctgtgttcccctgagcaaatgtaagccttacatatgcagaaattccatctcggtatctgaaagatggcctgctcagaaaatattcatgtgataagcgaataaaagaatatatgtgtgtgctcttacacctgaacagcgcttggcatagaggtagcgatcctgtgggcacatgtgcgattgtcagtagtgttagttttcagggagaacgcctttcactgggctccacttcttgctggactccacttcttggtgatttctgcagctcatgagttctagaccattgtcaagaactttgagcagaaaagtagagatgcctcatctaactgaaaacaactcagggattgatgacagctgtctgtctaggttcccttggccccagatcaccttacctaacttgaatcttggctgcttgttattacctgcaatcctgcttcctattgtcctgtgagagcagagcctcatttgtccacagattgcttgttggaagcgagcatcacagcacaaagccagaaattcctcctgcaggggatggttcattgacaagtctgtggattatacaatggaatttcctcttacctcccttttaatgacaccataatataaaactgtaaacaatgggcttttcttccccatttgtttgggatacttctgaaattctcccatctgctgttcagaactttggggggctgtgggattagaatcatgtatacttgcattgttttctcatggctttgttcactgatggagacatccatttagatatgagggcttttatggtgttgtgagaacagctcttctaccttacatggtcttccccactggggcaaaatgctgctgctgcctcagtcccagtgattgtgtcataggcctggagcatggtctctgcctgttctgcctcctctcggcatggagctatttcagtcttaccagtcctggtgtttaaaacagaactgcaggttgctagggccttgataggtaaccaggtgcctactgattgcaagagacccatggatgtttggacatcagagctggagggatactcctagggtaccagtgtcatttaacttggtctgggggctatttgtataaatgagtttcctttgaaaatcaatgctctctactttatgatgagtatacatgctacaaactcgttttgcctcagtaaacaaaaatctattccccctttaaaaatactgtatgattattgtgtgattattgtgtgtctgtgcatggtatttgagaatgtgtgtgatacagcacacatctagaagcgtgaacacaagcatacacgtctgtggagttggtcctttctttcctcctctgtgtggtttctcggcttgtcaggcttgcttgattacccactgaggtttctcaccactctcttcccccctctttctaggacaggagtcttaccgtgtagcccaggctatgcttgagcttacagacctcttggcttgtcctccaaaatgcttagatcagcatcatgcaccatctgattaaagacgttttcatgagaaaagaaaccaaccacagtccatacttacgaggtctcctgctgttgaagagaatcaaagctcatatgggctcagactactgttaagagttaaaggcagaatattataggaaggcaaattagatggcatcaaactcatcatttaaaggaggattgagagaagtcagctaaaatttaaatatgatttgtctgttcactaccttttcttggcctctacagtagaaagattgggatgatgaagccagaataagccagttacatttgagagctgtaatagtacaatacaatctcatcgcctgaaaggcatcctatccatgctccaggagtgtgttgcttgtcatctctccagacttcacgttagcatagacagcttagtgaatgtgtggataatagaaaccaagagtgggttttgactattgctgtactgtgttattagtgtattattgatatctttaagattgaatggtgggctgcagagatggctcagcaaggaagaagaagcgtgtttgctgctcttccagagtacccaagttcaattcccagatccataggtctatattgtggttcacttctggagatacagcttcctcttctgaactccatgggccccagcgacacacatggtccatataggttagaaaaatactcttacttatcctaaaatctaaaaatactcatacttaaatcttaaaaaacaaaacaaaacaaaacaaaacaacagccaggcagtggtggcacatgcctttaatcccagcacttgggaggcagaggcaggcggatttctgagttcgaggccagcctggtctacagagtgagttccagaacagccagggttatacagagaaaccctgtcttgaaaaaaacaaaacaaaacaaaacaagccaaaacaaacaaacagaaaaacaaacgaaaaaacccaaagcaattaaaagattgaacagtgactttgtattggagaagagtggtgttggtgtttctgtgtgtgtatcaagaatggtggagtggaaatgtctaaaacccctgctgctgctgctgctgctgctgctgctgctgctgctgcttcttctccttctccttctccttctccttctccttctccttctccttctccttctccttctccttctccttctccttctccttctccttcttcttcttcttcttctctctctctctctctctcttttcccccttttatttgatattttctttatttacatttcaagtgttacccctctccaggtctccactctgaaacctcctatcctttctccttccctctgcctctgtgaggatcctctcccacctacccacccactcccaccttcccgccctggcattcccctactctggggcatcaaatcctctcaaacccaagagctgctctcccaccgatgttcatcaagaccatcttctgccacataagtggccagagccctgggtacctccatgtgtattctttggttggtggtccagtccctgggagctctgaggggtctggcctcttgacactgttgctcgtgcccccccccccctcattgggactgcaaaccccttcagctccttcagtcccttctccaactcctccattggggaccccatgctcagtccaatggttggctgtaagcatctgcctctgcacttgtcaggctctgatagagactctcaggagacagctatatcaggctcctgtcagcaagcacttcctggcatctgcaatagtgtctgggtttggagactgtatatgggatggatccccaggtggggcagtctctggatggcctttccttcagtctctgctccacacttggtctccatatttcctcccgtgagtattttgtttctccctctaagaaggactgaagcatccacactttggtcttccttcttcttgagttttatgtggtctgtgaattatatcttgggtatccgagctattgtgttcttttgtgaccgggttacctcactcaggatgatattttctagttctatccacttgcctaagaatttcatgaagtcattgtttttaatagctgagtagtactccattgtagtactccgttgtgtaaatgtaccacattttctgtatccattcctctgttgaggatgtttctttttcaaaatggtgctggtcacagtctggggagatagcttataggcaaggtgcatgctgggcaagcatggagacttgagctcagctcctgagcaacgatgtataagcttgagctgttcatttatacctgtaactgcagtactgggccagcgaagggtaggaagagacagatctagggaccagctatggggctgaaatggtcatctcctggttcagtgaggaatggtctcagaaaatacggtgaatatgtatcacagtttcagctgaggaacatttttattgtttctatttcttatctactgtggattgtgaagagatgagcatggccgagcaagtacctgtgggggagaatgactagatctttggacatatgacaagaaatggtatagctggaacatatggtagattatatttttagatgatttatcattgctcaagctgattgaattcagaaaagggagcaaggtgggagcatggaaggggttgagggaggaaagggaaagtgatgtaattatatttgaattaaaaataaaaaaataaaatttatctccagggtataatagtagtaataataataataacaaaaacaacaacaataataattgaagaaaacatctcagtgtcacctctgacctcagcattctgctacatgggtgagcacacctgcacatatctgtgtatgcaacacacacagacaacacagagtgctggttgggtttatagtctagggtgttacagaatgttttaattgctcatattttgtcttgatataaataatattatactaggtagaggctagcatgtagaaactgaagttctttgctgaaatgcaaggaacaattgtatctacaaatagaggattggtggatgaacactgagacccttggcatcacccaggcaggactgagagtgactcgggggcaagtgagaaaaaaaaccctgctggtcataagtcaacagtgggattccagtccaagcagatgtgagtggatcatagataggtcatgcagaaaggatttctggggagaatccacaccagatagggaaaacacatacctgtcaggaagaacgggtggcattctgagagaaagcagataaatttctgagacagaagagggacctgaaaggagcaagtgcagaaggactcgtagggcaggtctggtaagaccggagcttgctgcccacccttcttcattgctccgctaatgtttttatctgaaggtgggttcagtacttaaatgaaaactgctcttggcggggatttttgtccattcgtaagatcaggaacaaaccttatagatgacttcttccacctgccatgtaggagaggcgtcttgctgaggggtgagcagaggctgctttgctttgtttggtgctttctttcttgagacagagttttgctatgtagcctaggtggtctcagtactaggattgtaggtgtgcgccaccatgctcacctttagaacttcttgatgggaaaatatttcagttaattcatatgttcatcaagtactgtttaagcatgtagctcctatgggcttagctctgggctcagccttgaaatgttgctgcagcaaggatcccttccctgtcagaaccacccttggctacctctcagagtctatacatcacaggggtttctactgcagtgagtgccgtttgcaagatgctagctaaatgtgacaaggtttgggttccataaatccctcctgtgtttttagtattactgaaatggggacttgaggacacagagagccattcagctgaactgtgtgagatgcaggctgctatctgcccttgagctctttcatgccatgtcatctgcactggtgttatttggatgatgtagactgttggtttgaaactttaccgtgcaaggctgtcttgttcacagtgtagattctgcagatctacggtgcgagttgaggtctcacatcttgagcaaactaccggtatcactgatgccagagagtgggccatccagcatagcgccgttatagatgcctaaatctgcaaggctgtctttggctcagtaaggagctctttggtggtagcttgattttcattagtttgggttatcttatttgaacttttctagcttatcatgaaaagatataatctaatacattatatacttatatctgtacattaagcaagattgcccacttgaatccagagcttgacagtttgcctagttcagacagaggacttattccaagcatcccctgtctgtgctccagagcactggattgaaggtggccacacccaccctgcatgtatgtgaacgctaggcatgtgcactctatccctcatgcttttctagcaagtgcttacccactgagcccctctgcagtcacactccagacttacagtagtaattaaaccattctgtgctggctcagagactcgaagggtggtaaccttcttatctgaagctcatacaataaccagtgacagcaaaattatacattttacaaacatcttgaaatattagcccttccgactcataatttgtttatggcatgtagaacgagaaaaattattattttcgcattgctctactccttgacaacccttgggccttttaaaggttgcaaagtacgtaggtgtgtttctttttacaaaaattatttgatatgggtttaaaaattttaattacgtaagagcttatagaaaacagctcttttaggtgattttttttcaaaaaagtttctaaagtgatttgattgttgttgttttcttttgagtgacagtattggggaattcagcaacgttggagcaaacagttcagattcaacctttttcagttaatatcctacctttctggtgcttagtaatatcacctgtctgtgaagtttctagatgaagttaactgtgataggaagaaccaccctaattgtgggtgaaactttcccaaggcagagacctcaaactatataaaaacaagaaagcagggactgaaggagctgaaggggtttgcaaccccataggaagaacagcaatatcaacaaccagactccccagagctcccagggactaaaccaccagagtacacatgaaaggatctatggctccagctgcatatgtagcagaggatggccttgttgggcatcaatgggaggagaagcccttggtcctgtgaaggctcgatgcccaagtgtaggggaatgtcagggcgaggaggcaggagcaccctcatagaagcaagaggagaggggatgggatagggggtttccagagaggaaaccgggataggggataacagttgaaatgtaaataagtaaaataaccaattaataaaaaaatcaagaaagcaaatttgagtgtcagcattcctccagcactgcatcttaaactgttaaagcaatataaccagattccccaaactgcatgctgtccttgacaggattggccccatgctctttaactataagcccaattacacccttttctgtttaatctgctctccttgggtacttttgtcacagctggaatgtaactgacacctcctgggcttacccgtggaagtccctcaaataacaagactgcaaattgtctctctagtccagattgccctgccagtgagaattggggagtttgagatctgctcagagctaggaaaggtagctctaagtacctgcagtctgggctgagcttctctagggtttgagtccttgttgctaatggagcctttcgtgccatgatcttcccttcgacatttgtgcatgaggtacaagcgttgagatgtccctgagacagttatggtgaaaggtagagttcctgtcctggttagtgtttggttgacttgacacaaatctagacatatacgggaagattgacatgacaaaatgcctccataagattggtctgtaggaaatcctgtattcacgtgtgatgtggagggcagtgccatcccttggcaggtggtcctggatagaatgaaaaagcatgctaaactagccatgaggataagccataagcagcggtcctctatgtcttctgcttcagttcctattccaggttcctgccttgagttcctgtcctgacttccctgatggtggattgcaaggctgtgagctgaaataaaccctttgctccccaagttgtttggtgttttatcccagcaacaagagaaaccctaagatgttcccaagaacaactgttacagataacgtatctcagaaggtttgctgtgttgaaggttttctgtctcttagattttatatgtaagactactcagtctttgtgtaaccttgtgctggaagacatttctgtgaactactgattttagcatattgtaacattatgtttagctccatgtagtcagtacagtgagtggctctatgaccactgctgtctgaactttcagactcaaatgcagtagctttgagagctttggaaggcatggtggggtcaaattgccatgggttagttcctggctgtgtgatactatgaaattccttaagttcttgcagtcttagattttgctaaaggatgtttgttttgataattaaatgagacaattactgtgaagtatttatatagctcataaaacattgccggaaataaattaaagtacaagtaggtacttttagcattgtaattattagttatataatgataataccttttaatgccaataactctttataaatagagctatagcttggtagccacagagaattaattctaggaccattagaggtagcaaaagcagccactgctcaaggctttatataaaatggcatagtatcttcatgtaaactaggcataatctcctatatactttaatcatctcgaatttatttgtaagacctaatatctcatcaatgctatacattagtgataaaatttagataacaataagcaaactagctttacatgttcattataagcacaactttctttcctcaaaggttgtttctgccagtgtttgatttatgcatatggaatccctggatacagagggctgactgcacttgttatttccattagcttaatgtgtgtatgtgtgggtgtgtgtgtatagtcatatcacatgtatcatatgtgttgtatagcaccaaagttaagaataatagaggaaggatcatatagattatgtaatgacccagaggtgactttacggaaaattactgggaggttctagggaggttatggacagctccagggagtgatcgccctcactgttacagctcgtgtctgtgatgccgctgccccataagtgtgttttccacaaccacccttgttctccttccctttgcctatggggtgagtttgggtggggcgctcatcacagaagcctctctcatcagacagcttgcagagactgagctaagcatgcacagacttggcagtcattggacagagctgcctttcactgagaagaattgagcagacgcacagaaaccaggactggtggccttgaaggtagatcctcctcactatgggagacgtcagcaaaaaggagtgaaggtttcctcttccagccagcaaaccccatttcctatgaacagcaagcattatgtcagctgccagagcagcttgaatttacctctcttccctggattacgtaacgcataggattcaactgtgaggaccctggggtgtaaagcagtctttttcagggtaaaaccactcagagtttcagaaaaggaaaataaccacctatatcaagtagacaaaatttccaagtaattctatggagaaactttggaaggggctcagcaaccatgacagcctggctaccttggagactgcctttgtggttgcagctagaggcaggttagccagaccagtgctaaaggcagcaactgcagtaaccagaggctccaaggtccagtcccaggaggaacccttgtatgggtgaagctcatccccggagaggatgcgtttgttattcctgagctgtgctgtctttaggattcatagctcctggcaccagggctctcggctcctagacaagcgtggtgtatgccgtttcttgtgttcagattgcttgccatgttctacataagtctcttttagaaagatgggagatgatagtggtaatctatattgggatcatctcaattcagtattaaataagtctgggacaacaagtaacgcccaccccattacaagctttatatgaagcaaacatctatttttgctttgtgcagactccactgtatgaagtgctaaaaataagccaatgctcagaaatcatttgcgatgcaaaaatgactgtggtggtggtggtggtggtggggggaaccatgttgttttctgtcctggatataagttaatcttacaggtcagaaatcgtgccctagaactgtatctgctaggtcattgcaaggctttgctgggttggagggacctacactgctccctgtggactagaaatgccatctcgtcaacagaagctgctatcagattctctttccgctattttttattatctaaaagaaatctacttgagtcttgggttttaaaggttttatttttgttattgttgttccccctttttgaaaagtaggataggagctagatgtttataagtagagcacaggttagagtcactgaacatcaggatcataggagcttttaaagggctctgttcatttcctaattctgacagtgtcccttaaacttatgctctatgccaggcctcaaaagatccaatcctggccttaatgcattgacaaatactgagctgtcaagtcagatcaagtgtgctccatgcagtcacacaactaaccttagataccaatctccgaacctagagattggacacctctttgcttttgtcaagtaccccttccatccccgtaatgagctttctgatgtagcaacgttggaacgcgccagagaagtagctgggtagtttacagcctgagggctgggtttccgctgagagtgagacacctcctacctccctcagtgtgtccagggtgagccagctgacccagttttgagtctatttaggagatagatggccactttctcctctcccaccagcctgtatatcttgctgcttctgccttcggtcagggtcaagatgcagatagccttgagcatcttcctacactgctgaggttggcaagattctttccagactcccgaaacataactaatgccggagaatgagtgagagagggcattgcacagaaaggaagtggataggccggactctgatcctggaaggcagacactgttaactaggtgacagactgttttctgagcacttaaccctttacaaacctctcttcccgactgatggtttgttaatggtttgttacagtttccagtgagccgctttgcttttagaaatctacatggctcaaggagaggaaaagcagggctaggtttttctggaaaaatctatggaatgtgctctcctcccatctgtctgggtgcttctgtcttctcttgtcatatgcccacactctggcttggtgacatttctaaaaacccacaggagacagtggcagaatctaagcttgaaccctgtattagagagttttgttttcctcccccacagccaacctttattataacaacagcaatcatcccctctgctatttattgtaaattttctcagcatataaaggactcttggcataagggaggaggaaaatatagtttaaagaaccgagttgtttcttctataaggagagttcctaaaacatgaactttggacttagtttggaaggaaaaaaagtgaaataaacacttagatgaaatcagccttgtaaatgtttttatttgaaagatggaaattgattgtgtaggttcatatgtaacacccgaggtcctatataagctgtagactaggtcctatttaagctgtagactatgagtctgtacttggggatttgaaaaaagcagttacttttgaattctagtgccagactctgcccgtttgcacagtttcacagggtctgtgcacagcagcgcacagtgtctgaaggttcccaggccaagcctgttccccggctggaaacagcgcaccccggcttctcctttggctccctccgtgttttcgcttttgtagctcttagcattttctcttcctgtccacaatccagacagtccaggctcgagttggggtgtgtgtccctgtcccttatccggctgctccgaggaagagcctccctggccttttgctttcatttgccttatatggtcagctgtggagttcgttattcctggaaagggccttttcactgtttcaagcactattgccctccaccatctcctgaggagaactagagcttgctggaagcttggggttcctggttctaatggggatcctaatggattctcactggttccagggcaggtgatgtttggacctcaggctaatgagatgtttaacaataggtgtatagttaagaataaacttccttttgaaaccagggactccagagtgttccggtgttttgtttgtttggtttctgttgttgtttgtttgtttggtttctgttgtttgtttgtttgtttttcctttcttccgagccccaagtgggctggtccttctcatttcccaggatcctgctgcctagattgcctttcccctcgttattctctctggctctgcttcttggagggctttatctaccacaggatagatgacattgatttcagtcagatccatgtcctcagttatcttctgaagtacggcttccggtgtcataaagaaacagtcatcttagtggttcccactcaggcggctgcccctccccttcctgctcctcttcctggtgggatctagcctcccgacctgggcaagccgagcagcagcactttaaaaataattagactgaacacaagagtgacaagaaggtgtggtttatctttcaggccatggttagtttgtgctttagcctaaaaaggaagtttgtagtgtgttgaatgcaagttagatgtttctggatgaaaggtggagctgaagatgagggtggagttaatggagtagtccttgctcctggctcagacaggaacatttctctaaaaaacttttatttatttttaaaaagggaagttgaatttggtaatggtttgaggcggctgcctagctaccctgagaccggtttttccctcccatctttcatggcctgcctctccatggtggtgaggattgggcaagctttgaagtcactttcgttttctagaacttgttggtgaagcctaccccccacaccccctacccccggtcacccctctttttttaaagcatgcctacatttctctcttccagctctgcctgtccaaaatgacttccctcttttcccaaatccccagcagttcactgtctggcaaaggagtgacatctggcagcttgctagggtagagggagagagatgtagaagggaagactgcgcgtgttcaataccacaattaccctgagctccatgctgtcaggatgtattacccacccacccaagccaggggaggcacactggagtgacccacctgcacgattgtgtgtgcatgcctgcgtgcctgcgtgcctgcttgcctgctct

SEQ ID NO: 1380 - DNA, 9841 bp, Mus musculus
gctgaagcgtttcctcaagcctgccggggtgggaggagaggaggaggtggtggtggtggaggaggtggaggcagagggtggagagagagaaagcgcacgccgagaggaggtgtgggtgttccgctcccatcctaacggaacgagctccctcttcgcggacatgggattgcccagcggctgctaacccctctcctggtcctgatcccccaaaccggcgtggctccccggtcaccaaggagctgattacaagggaccaggatttgcatccttggctgggcgtccattggctacagagtgcctgacctgggtcaggctttccaacacggacatgtctgacaaaatgtcgagtttcctacatattggagacatttgttctctgtatgcggagggatctacgaatggatttatcagcaccttaggcttggttgatgaccgttgtgttgtacagccagaagccggggaccttaacaatccacccaagaaattcagagactgcctctttaagctatgtcctatgaatcgatactccgcacagaaacagttctggaaagctgctaagcccggggccaacagcactacagatgcagtgctgctcaacaaattgcatcatgctgcagacttggaaaagaagcagaatgagacagaaaacaggaaattgttggggaccgtcatccaatatggcaacgtgatccagctcctgcatttgaaaagcaataaatacctgactgtgaataagaggctcccagccttgctagagaagaatgccatgagggtgacgttggacgaggctggaaatgaagggtcctggttttacattcaaccattttacaagcttcgctccatcggagacagtgtggtcataggcgacaaggtagttttgaatcctgtcaatgctggccagcctctacatgccagcagtcatcagctggtggataacccaggctgcaatgaggtcaactccgtcaactgtaatacaagctggaagatagtgcttttcatgaaatggagtgataacaaagacgacattctcaaaggaggtgatgtggtgaggctcttccatgccgagcaagagaagtttctcacctgtgatgagcaccggaagaagcagcatgtgttcctgaggaccaccggcaggcagtcagccacgtcggccaccagttctaaagccctgtgggaagtggaggtagtccagcacgacccatgtcggggtggagctgggtactggaatagcctcttccggttcaagcacctggctacagggcattacttggctgcagaggtagaccctgactttgaggaagaatgcctggagtttcagccctcagtggaccctgatcaggatgcatctcggagtaggttgagaaacgcgcaagaaaaaatggtatactctctggtctccgtgcctgaaggcaacgacatctcctccatctttgagctagaccccacgactctgcgtggaggtgacagccttgtcccaaggaactcctatgtccgtctcagacacctgtgcaccaacacctgggtacacagcacaaacatccccatcgacaaggaagaggagaagcctgtgatgctgaaaattggtacctctcccctgaaggaggacaaggaagcatttgccatagttcctgtttcccctgctgaggttcgggacctggactttgccaatgatgccagcaaggtgctgggctccatcgctgggaagttggaaaagggcaccatcacccagaatgagagaaggtctgtcacgaagcttttggaagacttggtttactttgtcacgggtggaactaactctggccaagacgtgcttgaagttgtcttctctaagcccaatcgagagcggcagaagctgatgagggaacagaatattctcaagcagatcttcaagctgttgcaggcccccttcacggactgcggggatggcccgatgcttcggctggaggagctgggggatcagcgccatgctcctttcagacatatttgccgactctgctacagggtcctgcgacactcacagcaagactacaggaagaaccaggagtacatagccaagcagtttggcttcatgcagaagcagattggctatgacgtgctggccgaagacaccatcactgccctgctccacaacaaccggaaactcctggagaagcacatcaccgcggcagagattgacacgtttgtcagcctggtgcgaaagaacagggagcccaggttcttggattacctctctgacctctgcgtatccatgaacaagtcaatccctgtgacacaggagctcatctgtaaagctgtgctcaatcccaccaatgctgacatcctgattgagaccaagctggttctttctcgttttgagtttgaaggcgtttccactggagagaatgctctggaagccggggaggatgaggaagaggtgtggctgttctggagggacagcaacaaagagatccgtagtaagagtgtccgggaattggcgcaagatgctaaagagggacagaaggaagacagggacatcctcagctactacagatatcagctgaacctctttgcaaggatgtgtctggaccgccagtacctggccatcaatgaaatctccgggcagctggatgttgatctcattctccgctgcatgtctgacgagaacctcccctacgacctcagggcatccttttgccgcctcatgcttcacatgcatgtggaccgagatccccaagagcaggtgacacctgtgaaatatgcccgactgtggtcagaaattccctctgagatcgccattgatgactatgacagcagtggaacatccaaagatgaaattaaggagaggtttgcacagacgatggagtttgtggaggagtacctaagagatgtggtttgtcaaagattccccttctctgataaggagaaaaataagctcacgtttgaggttgtgaacttagccaggaatctcatatactttggtttctacaacttttctgaccttctccgattaaccaagatcctcttggcaatcttagactgtgtccatgtgaccactatcttccccattagcaagatgacaaaaggagaagagaataaaggcagtaacgtgatgaggtctatccatggcgttggggagctgatgacccaggtggtgctgcggggaggaggcttcttgcccatgactcccatggctgcggcccctgaaggaaatgtgaagcaggcagagccagagaaagaggacatcatggtcatggacaccaagttgaagatcattgaaatactccagtttattttgaatgtgagattggattataggatctcctgcctcctgtgtatatttaagcgagagtttgatgaaagcaattcccagtcatcagaaacatcctccggaaacagcagccaggaagggccaagtaatgtgccaggtgctcttgactttgaacacattgaagaacaagcggaaggcatctttggaggaagtgaggagaacacacctttggacctggatgaccatggtggcagaaccttcctcagggtcctgctccacttgacaatgcatgactacccacccctggtgtctggggccctgcagctcctctttcggcacttcagccagaggcaggaggtccttcaggccttcaaacaggttcaactgctggttactagccaagatgtggacaactacaaacagatcaagcaagacttggaccaactaaggtccattgtggagaagtctgagctctgggtgtacaaaggccaaggtcccgatgagcctatggacggagcctccggtgaaaatgagcataagaaaaccgaggaggggacgagcaagccactgaagcacgagagcaccagcagctacaactaccgagtggtgaaagagattttgattcgacttagcaagctctgcgtgcaggagagcgcgtcggtgaggaagagccggaagcagcagcaacgactgctgaggaacatgggcgcacacgctgtggtgctggagctgctgcagatcccctacgagaaggccgaagacacaaagatgcaagagatcatgcggctggctcatgaatttttgcagaatttctgtgcaggcaaccagcagaatcaagctttgctgcataaacacataaacctgtttctcaagccagggatcctggaggcagtgacgatgcagcacatcttcatgaacaacttccagctgtgcagtgagatcaacgagagagtggtccagcactttgttcactgcatagagacccacggtcgaaacgtccagtatatcaagtttctccagacgattgtcaaggcagaagggaaattcattaaaaagtgccaagacatggtcatggctgagcttgtcaactctggagaggacgtcctcgtgttctacaatgacagagcctctttccagactctgatccagatgatgcggtccgagcgtgaccggatggatgagaacagccctctcatgtaccacatccatctggtggagctcttggccgtgtgcacagagggcaagaatgtgtacacggagatcaagtgcaactccttgctcccgctcgatgacatcgttcgtgtggtcactcatgaagactgcatccccgaggttaagatcgcttacattaacttcctgaatcactgctatgtggatacggaggtggagatgaaggagatttacacaagcaaccacatgtggaagttgtttgagaatttcctcgtggacatctgcagggcctgtaacaacacaagcgacaggaagcacgcagactccattctggagaagtacgtcactgaaatcgtgatgagcatcgtcaccaccttcttcagctctcccttctcagaccagagcaccactctgcagacccgccagcctgtctttgtgcaactcctgcaaggcgtgttccgagtttaccactgcaactggctgatgccgagccaaaaagcctcggtggagagctgcatccgggtgctctctgacgtagccaagagccgggccatagccattcctgttgacctggacagccaagtcaacaacctcttcctgaagtcccacaacattgtgcagaaaacagccctgaactggcggttatcagcccgaaacgccgctcgcagagactctgtactggcagcatccagagactaccgaaatatcattgagaggttacaggacatcgtgtctgccctagaggaccggctcaggcccctggtgcaggctgagctgtctgtgctcgtggatgttctacacagaccagaactgctcttccccgagaacacggatgccaggaggaaatgtgagagtggaggtttcatctgcaagctaataaaacataccaagcaactgctggaggagaatgaagagaaactatgcattaaagtcttacagaccctcagggaaatgatgaccaaagacagaggctatggagagaagcaaatttccattgatgaatcggaaaatgccgagctgccacaggcaccggaagctgagaactccacagagcaggagcttgaaccaagtccacccctgaggcaactggaagaccataaaaggggtgaggcactccgacaaattttggtcaaccgttactatggaaacatcagaccttcaggaagaagagagagccttaccagctttggcaatggcccactatcaccaggaggacccagcaagcctggtggaggagggggaggtcctggatctagttccacaagcaggggtgagatgagcctggctgaggttcagtgtcacctcgacaaggagggggcctccaacctggtcatcgatctcataatgaatgcatccagtgaccgagtattccatgaaagcattctgctggccatcgcacttctggaaggaggcaacaccaccatccagcactcgtttttctgccggctgacagaagataagaaatcagagaagttcttcaaggttttttacgatcgaatgaaggtggcccagcaggaaatcaaggcgacagtgacagtgaacaccagcgacttgggaaacaaaaagaaagatgatgaagtggacagggatgccccgtctcggaagaaagccaaagagcccacaacacagataacagaagaggtccgggatcagctcctggaagcatctgctgccaccaggaaagcctttaccaccttccggagggaggccgaccctgatgaccattaccagtctggggagggcacccaggctacaaccgacaaagccaaggatgacctagagatgagcgctgtcatcaccatcatgcagcctatcctgcgcttcctgcagctgctgtgtgaaaaccacaaccgagatctgcagaatttccttcgttgccaaaataataagaccaactacaatttggtgtgtgagacactgcagtttctggactgtatttgtgggagcacaaccggaggccttggtcttcttggactgtacataaatgaaaagaatgtagcacttatcaaccaaaccctggagagtctgacggagtactgtcaagggccttgccatgagaaccagaactgcatcgccacccacgagtccaatggcatcgatatcatcacagccctcatcctcaatgatatcaaccctctgggaaagaagcggatggacctggtgttagaactgaagaacaatgcttcgaagctgctactggccatcatggaaagcagacacgatagtgaaaatgcagagaggatcctgtacaacatgaggcccaaggagctggtggaagtgatcaagaaggcctacatgcaaggtgaagtggaatttgaggatggggagaacggtgaggatggagctgcctcacccaggaacgtgggccacaacatctacatcctcgctcaccagttggctcggcataacaaagaacttcaaaccatgctgaaacctggaggccaggtggatggggatgaagctctggagttctacgcgaagcacacagcacaaattgagattgtcagactggaccggacaatggaacagatcgtcttccctgtgcccagcatctgtgaattcctgactaaggaatcgaaacttcgaatatattacaccacagagcgggatgagcaaggtagcaagatcaatgacttcttcctgcgctccgaggacctctttaacgagatgaactggcagaagaaacttcgagcccagcctgtcttgtactggtgtgcccgaaacatgtctttctggagcagcatctccttcaacctggccgtcctgatgaacctgctggtggcgtttttctatccatttaaaggagtgaggggaggaacactagagccacactggtcaggcctcctgtggacagccatgctcatctctctggccattgtcattgctctgcccaagccccacggcatccgggccttaattgcttctacaatcctacgactgatattttcagttgggttgcagcccacactgtttctgctgggagctttcaatgtctgcaataaaatcatcttcctgatgagctttgtgggcaactgtgggaccttcaccagaggctaccgggccatggttctggatgtggagttcctctatcatttgctgtatctactcatctgtgccatgggcctcttcgtacatgagttcttctatagcttgctgctttttgatttagtgtacagagaggagactttgcttaatgtcattaaaagtgtcacccgcaatggacggtccatcatcttgacagcggtcctggctctgatcctggtttacctgttctcaattgtgggctatctgttcttcaaggatgactttatcttggaagtagataggttgcccaatgaaacagctgttccagaaactggcgagagtttggccaacgatttcctgtactctgatgtgtgcagggtagagacgggggagaactgcacctctcctgcacccaaagaagagctgctccctgccgaagaaacggaacaggataaggaacacacgtgtgagaccctgctcatgtgcatcgtcactgttctgagtcacgggctgcggagtgggggaggggtaggagacgtgctcaggaagccatccaaagaggagcctctgtttgctgcaagggtgatctacgacctcctcttcttcttcatggtcatcatcatcgtcctgaacctgattttcggggtcatcatcgacacctttgctgacctgaggagtgagaagcaaaagaaggaggagatcttaaaaaccacgtgcttcatctgcggcttggaaagggacaagtttgacaataagactgtcacctttgaagagcacatcaaggaagaacacaacatgtggcactatctgtgcttcatcgtgctggtgaaagtgaaggactccacagagtacaccgggcctgagagttacgtggcagagatgatcagggaaagaaaccttgattggttcctcagaatgagagccatgtccctggtcagcagcgattctgaaggggaacagaacgagctgaggaacctgcaggagaagctggagtctaccatgaagctggtcaccaatctttctggccagctgtcagaactaaaggaccagatgacagaacagaggaagcagaaacaaagaatcggccttctaggacatcctcctcacatgaatgtcaacccacagcagccggcctaggcaaatgaggcagagggactctgctcagccctctgtatatcactgtcagggtgggtacggctcattggttctgatttgcccactaagggtacatgtgcgcttagtacatttgtaaatactcagttttgtattgtatgtatatgattgctattctcagaggtttggactttcgtattgtaattagctctgttggcatggtgacttgtcactcctgccaaaaatattaaaaatgccttttttggaaggactacagaaagtacctgatttgcacttgaaccagattatagatttaaaagtatatgacatgtattttgtatttaaaactagaatagccagtatttatgttttttataaaactgtgcaatacaaattatgcaatcaccataactttgtaactcctgagtgtcctaagggagtacacatctttgaagctgatttgttgatactcgtgtaataaatggttaaatatcaaatgctgctgctgctgccaaaattatattaatagcgagtttctggcccctgggcaattttgtaccttgtaattatcctatggtgatgctgtttctcgttgctaatggcattagtgcccctgtatcctagtgataactccaggtctgtgaaccattcaaacagcattcattttgagaaaagcaactttagtttcaaggataattttaagcttcaaaattaatcatttaaagtgtttctttaagagagccatgttagaggctcacactttagcttgaaaggagttgatgaattaattttttaaagggaactttttacatgacgtttggaataacagcatattgctgaccagtcagtgtcatctcccgggtgaattttgatgtcacgttatagtcaaatgagttagctgatggtttctagattttcttcctctgaaccatgatgcagtaggtaagaagttattatgcgtatatacatatatacattcatatacgacaaagtaggagctgtccccttaggatgcatagctgcccctagggtacgtagctgaacactgacaatggcgttcttctgaaagagccacgtttgggttttatttctttgtcacatgatttcttttctggatgggtgcaaagtatcacaggaagtgttttctctctgtcgccttgttttgtacctgggtctcgctttactagaccgtctctgcacaaaagtttaaaaactgaaccgtatgcagagttccgaagcaagtcaagtttgtaaatgcatacctaaaaatatttaataaacgatgca

SEQ ID NO: 1381 - DNA, 8250 bp, Mus musculus
atgtctgacaaaatgtcgagtttcctacatattggagacatttgttctctgtatgcggagggatctacgaatggatttatcagcaccttaggcttggttgatgaccgttgtgttgtacagccagaagccggggaccttaacaatccacccaagaaattcagagactgcctctttaagctatgtcctatgaatcgatactccgcacagaaacagttctggaaagctgctaagcccggggccaacagcactacagatgcagtgctgctcaacaaattgcatcatgctgcagacttggaaaagaagcagaatgagacagaaaacaggaaattgttggggaccgtcatccaatatggcaacgtgatccagctcctgcatttgaaaagcaataaatacctgactgtgaataagaggctcccagccttgctagagaagaatgccatgagggtgacgttggacgaggctggaaatgaagggtcctggttttacattcaaccattttacaagcttcgctccatcggagacagtgtggtcataggcgacaaggtagttttgaatcctgtcaatgctggccagcctctacatgccagcagtcatcagctggtggataacccaggctgcaatgaggtcaactccgtcaactgtaatacaagctggaagatagtgcttttcatgaaatggagtgataacaaagacgacattctcaaaggaggtgatgtggtgaggctcttccatgccgagcaagagaagtttctcacctgtgatgagcaccggaagaagcagcatgtgttcctgaggaccaccggcaggcagtcagccacgtcggccaccagttctaaagccctgtgggaagtggaggtagtccagcacgacccatgtcggggtggagctgggtactggaatagcctcttccggttcaagcacctggctacagggcattacttggctgcagaggtagaccctgactttgaggaagaatgcctggagtttcagccctcagtggaccctgatcaggatgcatctcggagtaggttgagaaacgcgcaagaaaaaatggtatactctctggtctccgtgcctgaaggcaacgacatctcctccatctttgagctagaccccacgactctgcgtggaggtgacagccttgtcccaaggaactcctatgtccgtctcagacacctgtgcaccaacacctgggtacacagcacaaacatccccatcgacaaggaagaggagaagcctgtgatgctgaaaattggtacctctcccctgaaggaggacaaggaagcatttgccatagttcctgtttcccctgctgaggttcgggacctggactttgccaatgatgccagcaaggtgctgggctccatcgctgggaagttggaaaagggcaccatcacccagaatgagagaaggtctgtcacgaagcttttggaagacttggtttactttgtcacgggtggaactaactctggccaagacgtgcttgaagttgtcttctctaagcccaatcgagagcggcagaagctgatgagggaacagaatattctcaagcagatcttcaagctgttgcaggcccccttcacggactgcggggatggcccgatgcttcggctggaggagctgggggatcagcgccatgctcctttcagacatatttgccgactctgctacagggtcctgcgacactcacagcaagactacaggaagaaccaggagtacatagccaagcagtttggcttcatgcagaagcagattggctatgacgtgctggccgaagacaccatcactgccctgctccacaacaaccggaaactcctggagaagcacatcaccgcggcagagattgacacgtttgtcagcctggtgcgaaagaacagggagcccaggttcttggattacctctctgacctctgcgtatccatgaacaagtcaatccctgtgacacaggagctcatctgtaaagctgtgctcaatcccaccaatgctgacatcctgattgagaccaagctggttctttctcgttttgagtttgaaggcgtttccactggagagaatgctctggaagccggggaggatgaggaagaggtgtggctgttctggagggacagcaacaaagagatccgtagtaagagtgtccgggaattggcgcaagatgctaaagagggacagaaggaagacagggacatcctcagctactacagatatcagctgaacctctttgcaaggatgtgtctggaccgccagtacctggccatcaatgaaatctccgggcagctggatgttgatctcattctccgctgcatgtctgacgagaacctcccctacgacctcagggcatccttttgccgcctcatgcttcacatgcatgtggaccgagatccccaagagcaggtgacacctgtgaaatatgcccgactgtggtcagaaattccctctgagatcgccattgatgactatgacagcagtggaacatccaaagatgaaattaaggagaggtttgcacagacgatggagtttgtggaggagtacctaagagatgtggtttgtcaaagattccccttctctgataaggagaaaaataagctcacgtttgaggttgtgaacttagccaggaatctcatatactttggtttctacaacttttctgaccttctccgattaaccaagatcctcttggcaatcttagactgtgtccatgtgaccactatcttccccattagcaagatgacaaaaggagaagagaataaaggcagtaacgtgatgaggtctatccatggcgttggggagctgatgacccaggtggtgctgcggggaggaggcttcttgcccatgactcccatggctgcggcccctgaaggaaatgtgaagcaggcagagccagagaaagaggacatcatggtcatggacaccaagttgaagatcattgaaatactccagtttattttgaatgtgagattggattataggatctcctgcctcctgtgtatatttaagcgagagtttgatgaaagcaattcccagtcatcagaaacatcctccggaaacagcagccaggaagggccaagtaatgtgccaggtgctcttgactttgaacacattgaagaacaagcggaaggcatctttggaggaagtgaggagaacacacctttggacctggatgaccatggtggcagaaccttcctcagggtcctgctccacttgacaatgcatgactacccacccctggtgtctggggccctgcagctcctctttcggcacttcagccagaggcaggaggtccttcaggccttcaaacaggttcaactgctggttactagccaagatgtggacaactacaaacagatcaagcaagacttggaccaactaaggtccattgtggagaagtctgagctctgggtgtacaaaggccaaggtcccgatgagcctatggacggagcctccggtgaaaatgagcataagaaaaccgaggaggggacgagcaagccactgaagcacgagagcaccagcagctacaactaccgagtggtgaaagagattttgattcgacttagcaagctctgcgtgcaggagagcgcgtcggtgaggaagagccggaagcagcagcaacgactgctgaggaacatgggcgcacacgctgtggtgctggagctgctgcagatcccctacgagaaggccgaagacacaaagatgcaagagatcatgcggctggctcatgaatttttgcagaatttctgtgcaggcaaccagcagaatcaagctttgctgcataaacacataaacctgtttctcaagccagggatcctggaggcagtgacgatgcagcacatcttcatgaacaacttccagctgtgcagtgagatcaacgagagagtggtccagcactttgttcactgcatagagacccacggtcgaaacgtccagtatatcaagtttctccagacgattgtcaaggcagaagggaaattcattaaaaagtgccaagacatggtcatggctgagcttgtcaactctggagaggacgtcctcgtgttctacaatgacagagcctctttccagactctgatccagatgatgcggtccgagcgtgaccggatggatgagaacagccctctcatgtaccacatccatctggtggagctcttggccgtgtgcacagagggcaagaatgtgtacacggagatcaagtgcaactccttgctcccgctcgatgacatcgttcgtgtggtcactcatgaagactgcatccccgaggttaagatcgcttacattaacttcctgaatcactgctatgtggatacggaggtggagatgaaggagatttacacaagcaaccacatgtggaagttgtttgagaatttcctcgtggacatctgcagggcctgtaacaacacaagcgacaggaagcacgcagactccattctggagaagtacgtcactgaaatcgtgatgagcatcgtcaccaccttcttcagctctcccttctcagaccagagcaccactctgcagacccgccagcctgtctttgtgcaactcctgcaaggcgtgttccgagtttaccactgcaactggctgatgccgagccaaaaagcctcggtggagagctgcatccgggtgctctctgacgtagccaagagccgggccatagccattcctgttgacctggacagccaagtcaacaacctcttcctgaagtcccacaacattgtgcagaaaacagccctgaactggcggttatcagcccgaaacgccgctcgcagagactctgtactggcagcatccagagactaccgaaatatcattgagaggttacaggacatcgtgtctgccctagaggaccggctcaggcccctggtgcaggctgagctgtctgtgctcgtggatgttctacacagaccagaactgctcttccccgagaacacggatgccaggaggaaatgtgagagtggaggtttcatctgcaagctaataaaacataccaagcaactgctggaggagaatgaagagaaactatgcattaaagtcttacagaccctcagggaaatgatgaccaaagacagaggctatggagagaagcaaatttccattgatgaatcggaaaatgccgagctgccacaggcaccggaagctgagaactccacagagcaggagcttgaaccaagtccacccctgaggcaactggaagaccataaaaggggtgaggcactccgacaaattttggtcaaccgttactatggaaacatcagaccttcaggaagaagagagagccttaccagctttggcaatggcccactatcaccaggaggacccagcaagcctggtggaggagggggaggtcctggatctagttccacaagcaggggtgagatgagcctggctgaggttcagtgtcacctcgacaaggagggggcctccaacctggtcatcgatctcataatgaatgcatccagtgaccgagtattccatgaaagcattctgctggccatcgcacttctggaaggaggcaacaccaccatccagcactcgtttttctgccggctgacagaagataagaaatcagagaagttcttcaaggttttttacgatcgaatgaaggtggcccagcaggaaatcaaggcgacagtgacagtgaacaccagcgacttgggaaacaaaaagaaagatgatgaagtggacagggatgccccgtctcggaagaaagccaaagagcccacaacacagataacagaagaggtccgggatcagctcctggaagcatctgctgccaccaggaaagcctttaccaccttccggagggaggccgaccctgatgaccattaccagtctggggagggcacccaggctacaaccgacaaagccaaggatgacctagagatgagcgctgtcatcaccatcatgcagcctatcctgcgcttcctgcagctgctgtgtgaaaaccacaaccgagatctgcagaatttccttcgttgccaaaataataagaccaactacaatttggtgtgtgagacactgcagtttctggactgtatttgtgggagcacaaccggaggccttggtcttcttggactgtacataaatgaaaagaatgtagcacttatcaaccaaaccctggagagtctgacggagtactgtcaagggccttgccatgagaaccagaactgcatcgccacccacgagtccaatggcatcgatatcatcacagccctcatcctcaatgatatcaaccctctgggaaagaagcggatggacctggtgttagaactgaagaacaatgcttcgaagctgctactggccatcatggaaagcagacacgatagtgaaaatgcagagaggatcctgtacaacatgaggcccaaggagctggtggaagtgatcaagaaggcctacatgcaaggtgaagtggaatttgaggatggggagaacggtgaggatggagctgcctcacccaggaacgtgggccacaacatctacatcctcgctcaccagttggctcggcataacaaagaacttcaaaccatgctgaaacctggaggccaggtggatggggatgaagctctggagttctacgcgaagcacacagcacaaattgagattgtcagactggaccggacaatggaacagatcgtcttccctgtgcccagcatctgtgaattcctgactaaggaatcgaaacttcgaatatattacaccacagagcgggatgagcaaggtagcaagatcaatgacttcttcctgcgctccgaggacctctttaacgagatgaactggcagaagaaacttcgagcccagcctgtcttgtactggtgtgcccgaaacatgtctttctggagcagcatctccttcaacctggccgtcctgatgaacctgctggtggcgtttttctatccatttaaaggagtgaggggaggaacactagagccacactggtcaggcctcctgtggacagccatgctcatctctctggccattgtcattgctctgcccaagccccacggcatccgggccttaattgcttctacaatcctacgactgatattttcagttgggttgcagcccacactgtttctgctgggagctttcaatgtctgcaataaaatcatcttcctgatgagctttgtgggcaactgtgggaccttcaccagaggctaccgggccatggttctggatgtggagttcctctatcatttgctgtatctactcatctgtgccatgggcctcttcgtacatgagttcttctatagcttgctgctttttgatttagtgtacagagaggagactttgcttaatgtcattaaaagtgtcacccgcaatggacggtccatcatcttgacagcggtcctggctctgatcctggtttacctgttctcaattgtgggctatctgttcttcaaggatgactttatcttggaagtagataggttgcccaatgaaacagctgttccagaaactggcgagagtttggccaacgatttcctgtactctgatgtgtgcagggtagagacgggggagaactgcacctctcctgcacccaaagaagagctgctccctgccgaagaaacggaacaggataaggaacacacgtgtgagaccctgctcatgtgcatcgtcactgttctgagtcacgggctgcggagtgggggaggggtaggagacgtgctcaggaagccatccaaagaggagcctctgtttgctgcaagggtgatctacgacctcctcttcttcttcatggtcatcatcatcgtcctgaacctgattttcggggtcatcatcgacacctttgctgacctgaggagtgagaagcaaaagaaggaggagatcttaaaaaccacgtgcttcatctgcggcttggaaagggacaagtttgacaataagactgtcacctttgaagagcacatcaaggaagaacacaacatgtggcactatctgtgcttcatcgtgctggtgaaagtgaaggactccacagagtacaccgggcctgagagttacgtggcagagatgatcagggaaagaaaccttgattggttcctcagaatgagagccatgtccctggtcagcagcgattctgaaggggaacagaacgagctgaggaacctgcaggagaagctggagtctaccatgaagctggtcaccaatctttctggccagctgtcagaactaaaggaccagatgacagaacagaggaagcagaaacaaagaatcggccttctaggacatcctcctcacatgaatgtcaacccacagcagccggcctag

SEQ ID NO: 1382 - DNA, 96596 bp, Homo sapiens
gtcagaatgtacacattcttcctttaaaaaaaaaagtgaagacaacaaacataatacaaagattttctatttttttaggttggtgcaaaagtaattgtgtttttgccattgaaagtaatggtgaaatctgcaattatttttgtaccaatctaataatagcaacttctcaccctacttctctaaccaagtgaagatttccaaaaccagatggacttaaactttttttttttttttttttttttttgagatggactctcactctgtcgcccaggctagagtacagtggcgctatctcggctcactacaacctctgcttcccaggctcaagtgattctcctgcctcagcctcccgaatggctgggattacaggcgcctgacaccatgcccgggtagtttttgtattttcagtggagatggggtttcatcatgttggccaggctagtctcaaactcctgacctcaagtagtcgacctaccttggcttcccaaagtgctgggattacaggcaggagccactgtaccaggcccattttgctttttctgaaggccaaatgagtgttcaataatacagaagttaaaaatgattaacaaatcccacccccccttgtttttttggaacaaaatcttgttcttctgaccagactagtgcagtggcataatcatggctcactgcagcctcaacctcccgagtagatggttctacaggtttgtgccaccacactgggctaatgtttttattttttattttgtagagagagagtctcactatgttgcctaggttggtcttgaattcctgggctcaagctcatcttggtctcccaaagtgccgggacagtatccttttttggaaagaccaaatctatttacatattaccacatggaaattttttcattacgccttataacaatgtttcctcattcaggctcaaaagagtatattcagaaatttagaaagaaaagccttgatttgcctatgagtgagattcttttggaaacaacaatctttttcttttaaatatctttatttatttatttatttatagagatgaaatctcgctctgtcgcccaggctggaatgcaatggtgtgatcttgtcttactacaacctccgcctcctgggtcaaagcaattctcctgtctcagcctcccgagtagctgtgattacaggtgcctgccacgacaacctactaattttttatatttttagcagagatggggttttgccatgttgaccaggctggtcttgcgctcttgacttcaggtgatctgcccacctcggcctcccgaagtgcagggattacaggcatgagccaccacccttatttatttttgattataagagtgctatttgctgtttcttttttttttttctaataaacactgatctttatagaatctttatagaatttgctttaagatagccaatccctctcctccccatccctctcttccccttccctcccctttccttttatttggatagaccctcactctgttccccaggctggagtgcagtggcatgatctcggctctctgcaacctctgcctcctaagttcaagtgattctcctgcttcagcctcctgggtgtgcaccaccacacccagctaaattttttaaatgtatttttagtagagacggggtttcgccatgttggccaggctggtctcaaattcctgacctcaagtgatctgcccacctcggcctcccaaagtgctgggattacaggcatgagccacggtctttttctgtttcttaaggtatttcaggtattgagtaagacttagactacttttaaaatcgatgcactttctgttgcctcctcctcctcctccccctcttccttctaagaggtaacacagttaaaaaaaattgaaataaaagggcttgtttggaggacagttgagcagagaaactactcagaagaaggtatttccctcattgactcgctatgttatattcaacataaatgtttcaatgacaaagaatcatcttgataatatggcctataatggagaaatattccagtgtgaatggacaggtgcctggatggtggtgaagaaaccaaggaagatcagaggaccacagcaccagccgtttcctaggtcacaactgctaggtctgcaaactcttacttgaaagaagaaacaaggagggaaatggcatgagagatcagctgatgacaataacctctgataaaaaagcagccagtcttcttatgtgtcatcctctaagcaccatgtatgaaattcctctgtaagaaaggtagtgatcaagaaaaaggcagatagtaaaagttctatgcattccgttcagtctttttagtgcctagtgtagcacctgctagggtaggtaggtacctattaaacatcagtttaataatgacagacatgaaaccaaccaaatgttcttaatagctccctctaccctattcctcaccagtccaatcccacttccctgggctgaccctacccaaatgatctgtttcataaaggattgactcaaattctctgtctggattgaactcatgatacaggttacctatatcctaaaactaaagttagagggggaaatactacttaaaatcttgaaataaaattaagtgggagcaaaacaaagcagttaatttgcatgagtctacactgatagagcatgagaagtgaaaaaagctataagttctacttcgctggtaactgaattacatagaattcactgctcagtttagtaactaagtctaatgatcattaaaaagctttcccaggagaagggaaagatgaagcctgcaatactcaagttttccacttcctttttggagatggagtctcgctcttgtcgcccaggctggagtgcagtggtataatctcggctcactgcaaccttcgccatccgggttccaggattctcctgcctcagcctcctaagtagctgggaccacaggcatgtgccacctaacctggctaatttttgtatttttagtagagatgtggttttgccatgttgccccggctggtctggaactcctgacttcaaatgatcctcctgccttggcctcccaaaatgctggcattacaggcatgagccactgtgcctggccttccatttcccttttcttatgcataattctttttgcttttctggttgatttgtaaagaccctaagaaggacatattgcaacaaatacaattactcctaacttggagactgacacaaaagttgtttagttataataagtaggttgttctgcattttacccaaaaagctaagtgtaaatttttcaatcatttgttgaaacatcactatcaccttcaaaggtaaaaaataattacttctccagcataactgtaaaactatcacaaaaatgggcacagacatctccacgaatgtggcaagattttagataattttttgaataagataggtaagtgtaatcatatataatttttagattaaattggcatgcattttatttttttttgagacagaatcttgctctgtcacccaggctggagtgcagtggtatgatctcggctcactgcaacctctgcctgccgggttcaagggattattgtgcctcagcctcccgagtagctgggactacaggtgcatgccaccacacatttgtggagagtgagtttcagataccatgagatttcacttcaaaatactttagtatacatctcttgaggacattttcatacataaccacaatgccatcatcacacctaagaaaattatttacaatttttataatatgcaaattgtttacagttgctcagaaatgtcttctatagattcattttaaaatttcttttaatccaaaattcaaaggtcacatgttgcatttagttgtaaagtgtgtttcagtctttttaaatttttaatttgcaattgacacataattgtccatattcatggggtaaaatgtgatgtttcaatgcatgtatacatagtataatgatccagtcagggtaattaccaaatgcatcactttaagcatttgcatctagataatcctcctgccatattttttaaatgacactgattcatttgaagaatccaggccaatggtcttgtggaatgtcctgcattctgagtttgtttgattgtttcctcacgaatatttttggcaagaacatttcatatgtgatgttgtgtacttcttatagaatcatatacatatgtaaatagtgtctagttgtcccagtattgctggtaataaatttgatcacgtggttatgtgggtgaatcgtgggtgattgccattatctctttactgtaaaggtccatttttcacttcataatttgtgtgtgatgtatggagtgatttttaggaccacatgactatcttattcctcatcaacattttccccagagtgtttggcatctattgataatctgcctaaataattttttacttatttatattttgagacggggtctcgctctgttgcccaggctggagtgcagtggcatgatcacagctcactgcagccactatctccctgggctcaggtgatcctcccacgtctgcctcccaagtagctgggactacaagtgcatgccaccacgaccagctaatttttatattttttgtagagatggaattttgccatgttgcccaggctggtcttgaattcctgggctcaagtgatctgcccaccttggcctctcaaagtgctaggattataagcttgaggcactgtgcctggcctatctaaataaattattatactggaagctgcaaatttgctaatgttattatttcttctacatgtattagctgaattattctgtaaggaagagctttatgttttttctttgatacacagatttcatttcagtttaaacactaggataagacaaaaaagccttttccaagatttcttcaagtccccagatctagcttgtctaccagagcaatttaggatgacagtcttgcagatgggaggcaggagatggggtagttaataatagacccctggctctgcatgttttacaggaaaataatgaataagaaaataatagttctctttacttgcttacatgattctagacaacactggcagcaatcatcagagatggtatagcagctacttccatattgcatagagtactaagaattcttaatttttgcattattttgtagttatcatgctgccttccagattttaaattattgacattttgtccatgttccctccactcacaaggtgactgaccagcagtttcttccgcacttcagagataggacaacaaaaataggccctcttgctgtgtcttctctcattctcacaggatatctagagcctggattcagaaaacatcttactttctatagctccataccaagtcgtcctctctcctgcccttgttcgaatagcaactccactttttccatgtcaagtagggttgattaagtgtctgtaggtcatttcttctggtcatctttgtaagttccaattagccagtaagtgctgaatgcttactctgtatccagagcagaacaagatgctgcaaagggtcctacatttataggacttagtccctatcttcaaagaggttatctgaatggtgagacaaaaatcaccgaaaaatacagctaaaagataatctagtcttgtgggagtatctatgaatgatttttagaggactggtacaagaaacttaagaactggtgcagaaatttgcagtatctgtgttgtgctggggcaagtgcccatggattttgtgagtttccacgagggctgtgactctatccctccaccataaaacattcacaatgaccaagagagactagttggactagctatgcagtagctatttgtctttgctgatgttttccatggtcaatggtagtccatcacattagataatatagtgtcagtgccaaaatatagattgaattctatgattgggtgttggacattctttcttgccatttaagtgtcatttagagttattaattaaagcactcaaggctcattgtgacattcataggtgattctgttctttttttttaaattttttacaggtacatagtaggtgtatacattttggggtacatattttgatataggcatgcaatgtgaaataagcgcatcatggagaatgggctatccatccccctcaaacatttattctttgagtcacaatccaattacactccataggcaattgaaatcttatgcctgagagaaaattgggaatagtgctgccccaataatctgaagtttggtttggaactgagtactgtatcaggacgcatcaacattatctccattcttgtcaataatattctcttactttagtatagcgagggtgagtttgcaaagccctttcatgtcctatgacccattgacccagtgagattgacaaggcaaggattgttagtatcactttatcaaacaaaacaaaacaggatataaatggtacagctgggtgtcaaaaccattttctccgatccctcctttctccagcttatcttgctctcttaaccagggcagcatttgaggtgggcttctaggcagatgaattcagttagagttttcagctgtgtactgctgatgaaacctgcttctatttgtaggtcttccctgggggtaggctcaagtgctagttttggactttcttcagacttctgctcagtctatgatactgtactgaccttgcaaagccctcgtagttccctgcatgaacatttcaagggcaaagtcataaatggccattttaatgggctggtcatcatctcgaattgtgatcctgggaatcagattcttggttttctagatcagtgctgcataatatatgatatgagctatatatgtaatttttaatttcctagtagctatattaaaaaaggaaaaagcaggtaaaataaattctaataatctattttatttaacacaaatatccaaaatattaccacttcaacatgtaatcactatacaaattaagatattttgcttttttttgtactaagtctttgaaattcaatgtgttaacatctatttcacatctcagaactagccacatcttacgtgcctaaatggctagtagtcactatactggaaaacacagggatagaaaattcttctagaaaaaaatagtgaagagaaagcagctcctttccctctactgataacagagaatgagttaggcagtgacccttatattctgacattaatcatcataatttatcagtcatacatcatcatagagaacctcttcacatcatagcaaaattactttctagtgacctagcagcttctagaccttaaaaatgttgaataggattatccatacatacaggcggagaaaataggctatgatagagatgggctacaaggtgttgcatgctccaaaaatatggtcatgtatcctgccatatgcctgacacaccttccattaaaacatcttcttaacaaacttttttttttttttttaacacatctactaaaatgtgcagaaagaagaataagtccttctgggtcaggggaggtagagagcacaagcatgaataagacatagatgctgccttcagtgaaatttgtggtctccgagggaagacagtggataatgcaggtaggagataaatgtccattatatgatgaaaatgaaaattgtccaactggatcttcagaaaaccgctgttaatattccattgtttctgagttagaagcacatgaaataattacccttcactatttaccagttacacaggcatacactgatttgttgaatttgcttgaaaagtagagccgaagatcctttgaaaatggaagaggttttcatgggggaagagatgagtgggggcgaatgagaaacatctcctttatatggcagatgcggcagtttcttgatgatggggagaagcagcttaacgtattaggcactagaccccagcgtccagtgaccaggggataatgctgacagggaacggagggcaggagtgaatatcgtgaacacaaactttgtctatttcaagagctttgccccttcctggactgacattaaatgcttatctgagcaggcaaatacagtgcacatgtttacattggggaggtagcggagactagtagtttaggaccagggttcaagactcagctatttgtgtgactttggaggaagtaatttaatcgctttgtgccccccctcagttttctcataagtaaaaaatggcttaataggatttaattaggtgctatacagaaagagtttagaccaatgcctgacacatggcattcacccaataagtgtcaataattatgattcgttttggcattattatgtcagtaataactattagctatgattctcctctaatttgttcctaaagtttcatgagactcgattttatattaaggaatcctgctaaaaagtagacatattctaataagaatttccttcagatggcaaaactggggcaaagagatgaaaatgacttgcccaagggctcagaggctgctcctaaatggggagagaggctatttaaggcaatggcggtggatttccccaaagacaagggtttcatacacgtagagtctggaacgggagtccaggctgtaccacttaactcgaggggtcatttgggaagttacctgatttctctgagccctggattgtgcacctgccaaatagatataataaatatacctacagttggtaaaactcaatagcatgacgcatgaaaactgcatgtggtctgggctcaataaaatcagcctccccattgattattatcattattattactattgttataacagatctttaggcggcgtcaggaagtgcctgtctgggatgctataatgcgtttggctcaccactatgccccagcgcctggcacctagtaaacactcaggaaacgtttgaggaatgaatatacgtcatttgaggcaagacagggcagtcggctgactgcctccgggcttagctcttcccctccttgcaaaagccggagccctaagcagcgtgtagcccgggagcccaggcattacttggcagcgggtgaaacccaccttgccccattcggagctcttggagagcgccccgcctggatgcgcatctctgtgtgagcggctctttcctaagcccttatttttctggtttgcggtttatttacttaagcatttacagctcccaggagcagaggggctgctagaggtacggtcaggactgaggtcgcggtttgtatttattttctgcctcccaatctcagagccggcaagtcacaacacggctcctttatttgtgcaccggagaggtctgcctttctttacctcctcacgggcgataaaagacaagcaactcgggctcagaaaagtgctctcacgcgacttgcctgtgtctccgcttgcgtggaccgtcgctcccaggcttggtttctcgtgcaaacccgagcagggcggagcagattaaataaagacacctcgcgcctttaatccttgaccgcaaacactggcgtttttgtgccccggatttctgaaattcttggctcggggaaccaaggcagggggagggtgggcttgtaaaaacttcccaaagcagaaatccgagctcctagcccctccccggccccagtgacacctggattccagggaaggggggcagccggaggagaggcgtccccaagggttgcgggcgcttcccaggggtgactttgaacggctggctccaagccctaccgaccccagccaaggaacaggctcagcagcctgaaagcctcgcaggacgcccctcccctgtccccgcacgcgtctatttagggcccagcccgggcgcccaggggattctgggacttgtagtccctccccgcagcctcaggcgccgccacgacccgctacttggactacattgcccagggagcttcccggcctatataagccacccggagccgctttaaagtgcagtaaccatgtggatgtgctgctgaagcgtttcctcaagctcgctggggtgggaggagaggaggaggagaaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggtagcggctggggccgggcagagggcgcggggagttggcactggctccccgggcgcagaagtttttgccccgctctcggggagatcttgagggatgtgcatgcacttggcatgcatttgggggttcctttactgcgggcaattgttttggggggagctcatttgaagcttaaaaaacaaatatcctctactctagtgcgtggctttgggggctccccattctggtctgatgtggcattcccccaagttggaaactgttgctgcagctgcaggaaatagttctttttttttttttttttttgaagagaggttgtgggggtgtcatatgtgagtctgctcaaggaaataatctttctaaaaatgtatccctctcttgcgctccgtggttgggagaataatgcatgtgtaggggccccccgtggggagggtttttaaaaacggaagaaaaccggagaagcggtgagggatgaagtgtggacgaagctcatgtccaatgaggatgcgggcttcggatacttggccttctcgccgggaaacaagtgctttgggatctgccaaacacttcccttagttccagcctcccgcacgttcgaagtttgtgcgtgcctagtctcaattgtcagttacatcctggaaataagtaagcgtagttacctggaatcttcgcccaagcgatcccaccaacttgcctaccaagtttgggggcgggggggctgtccccagtgaaggaggctaaagaaggtggaaacttgtaatttggagcatttctgttagagctcatcttccgcggtctggtactcagtcttctttctttctaaatatttaggagctgactacagaggagcaggatttgcacccctcgctgggcttgctttggcaacagagtgcctgacccaggtcaggtgagtgtggaagcctgagtgctgtagtcaataatgagtttttgtcctaagcctattttaagttctatctaaaccgccaaggaggtggggagtaagaaagaaaaagaaactccgtggctcagtcttcaaaatttgcctctgcctttggtgagggcttttgggagcagaggtccagtggacagtccgtttcttggaagtagctgagaattgaaggagcctgaaagtttatgagagaggaggggaaaaggccattaaatggagcaataaaacggcggcccattgccggtctgaaaagcatgctgatgatttaaattctgaaggatacagtgcatttcatatgccaaaatgtgtaagcagtattaactgcctctctccttcaagaaatagtcactcttttctaattttgaacgtgtgcttaatcagagtaggttggattgcaagaaatgaaagtggttgctgcaagttgaaagaattagaactttaaaaagggaagtgagttattgaagcttaaggtggtagcatccagcccttgactcaagccacctgagtgtcaaggaatctggcaggtccctgttgttttggggcccgtggtggaatatgagctgagagcagcatttatctgtaaacacaacagttcctattttttccccaaaatggtcagactgcatttgaagagtgggaggtttcaacgggtgcacgtacatcactattgctgcagatttggctatcaggagttttttctcctgaaatgttcaggaacatggtaaataacagggtaacagaggtaggtgggggtgggtggctgggtcttaataacttttttaacattctaaatatttagctgttccctgggctacaatctttgggcttttctaatgagaaaataaaagtcagacacttcattatagtggtatagtgcttttgtttcctgttgataagatcctcaggagtactggcggagtgagaagcatttggatgtgagaactctagtttcttcttggagttctgttgactcacatggctgtgtgggtgctcatagagccaaggattaggcccagttccccttttcagaattagctgtacagcaaggaaaaactggtccacagactcttttctaactggttgctaaaaataataagatggacacattaagtacttgtaagccaggtccagagccatgtatctcagaaaccctgtgcgtcagatgcaggtgaagaaactgaggtgcagagagtgaaatcacttgcgcagtagctagtacaaagtaggagcagggtgtaacctcaggcggtgaggctgtactgcatcccacaaatggacctcagttgatttggggatgctggtggtgagagggaagctaggaaaaatggtaaacttactgctactgatgaaataacttgcatacctcccaccaatgatgaaataatacataacattgatgtaagaaggaaaggatgtagccacaaacatagggataaaagagtgcagatatttgaggaggtattagatactgtaatgagttcattttggaaagcctgaatggggagagtaaaaagaaacaaaaccacaaggaacattatgtaagttaagcattaggctcacctcctagctgaaatacatcttgattatttacatcaaagaatctgagtaggttaaaaggatcaggcgtttccccatctgaataattcgaaagtttaaactgcagttagactgcaatgtgaaatgttgataccttttcatataccttccagtttgctttgcagccagttgtgcagatgtttttgttctccattttttctttcaagttcatgtgtgtgtgtgtgtgtatgcatatgtacactgaaagtacaatctgctctttgaataattcaaatcagaacagaaaatcctttcaagatatcattcttgtcaggcagggaaagttcttcatgttctaagtgaattactctggctcttgccttgagacccatgaaagtcatttggggttgacaatggtatctatttaaaccaagtgattgtcttttggagggaattggcatcttttctttaggaatgagaagtggaatggttgcttagaaaaaaagagatagatgaactccacagaaagatcaagagtcttttcttcaaaatatttttaagtgaggaagatcagggtgttggtattgcggggagggaggagagtgggcagagagaaagataaaaaagaaacctttaatccaatggtgtgcaaccaactgacttccagaggggggaatatcacatggcttttcaactcatttataaagatatcatggaaactgtctgatttcttcatgagcagctcttagaaaacaaacaaaaataaaacaaacaccaaatatgaacaacagaaaaaaacagccaaaataaaagtaggcctggagttaggtttctaggtcaagctgtctttggctacatctaattaaggagtctccacagggccagtgtctatcttgtttactattggtttgatttttaaaaataaaacacattgcatttgcaggctgtctgttaaccagaagtccatgcagttttttttttccatttttgctgttttaagtttgtgcatagctcaattgatgaatgcaattaaggcttgaagtcagtgatgtgaatgacataacttctatgattccttacaattctcttggtttctgtggttctgagatgattgctaatgagaataagccagatacaccactgaaaccgtcacccattcaactttgagatttctaaattggatgtagtttaaggcacatggtgtggtaaatctatttaacagactctaagacctgttcaagttgttgtgtgcgattcaaatgttttattctttattcaacaaatttcttgagcacctgctatgtactaagatgtattccaggtgctcaggatatagcaatgaacaaaccatcccgttcccaagaggcttacatctcagttggtgggaggcagccaatataaataaacaagtaagtattatagtattagaggtagtaaaagctatggagaaaaagaaaactggttaaagggggaacagaaaataacaagtggagaaattagatcccttgtgcattgccggtgggaatgtaaaatggtgaagctgctgtggaaaacagcatggcagttactaaaaaaaattaaacataaaattactatatgtcccagcaattccacttcaaggtatatactttaaaaaattgaaagtagggacgtgagcagatatttgtacacctgtgtcagtagaagcattatcacagtagccaaaaggtagaaacaacacaagtctactgatgaatgaacagataaacaaaatgtgaaatatacatacaatggaatattattcagccttaaaaagggaattctgacacatgctacaatgtggatgaaccttgaaaacatgctaagtgaaacaagccagaaataaaaggacacatattttatgatttttcttatagaggcatctagagtagtcagatccctgcagacagaaagtagaatggggattgctgggggagatagaagacaggaagggggagttagtgtttattgaggatagagtttcagtttggaaagatgaaaaagttctggaaatggatggtggtgatgtcacacaacagtgtgaatgtacttagtgccactgagttataacatttcaaagtggtatattttatgttatgtatattttacagtaattttaaaaagcaacaaaacatgatgaggggtattaagggagtactcaggtggggattagatctttactacatgacatctcagcacagatctgaaggaggcaaacgagttgaccctgtagctgtcagggaaaaagtgtgttccaaatgtcagagcagcaagtacagaggccctgagataggagtgtttgtgacatgttggaggaaggagaagaaggccaggggagagtgctaggagttcaggagggagagggagtcaaggtccagacctgtagggaccagattttgcaggtcaacagtggtttatctgaggacttgtaaactctcacggaattctcagtgtggttttcaacatcacaaaactacattgtcctttctgaagagactctggtaaggttggcaggatcacataccagatgggaactcgatagggggtaaaacccagatttctggactgtctggttaatgacaggacttacctggagttgtaattcacttcagtagaaaaggaaagtttgacaaataggtgaacgtacagttgacttggagagcaaatggtaagaacataatgataatcctggagtttcaacacaaacctatgtcttaccgccaccctgcgttgtatccagtgtcgttttaagagatatttacaaggaggactaatattctgctctccagcatccttgaggaattagaagcttcacatcagtgattctccttaataagtgaagtggacccctgcacatgtgcaaacttaaagcaaacctcaaattttgttacttattacataagatatacatattcatgtagcacacaccttggactcggctactcaggggacggaggcaggagaattacttgagcccgggggtttgaggctgtaatatactatgattgcatctgtgatagctactgtactccagcaagaccccatctctgttaaaaaaatttttttaaggagaaaaagatagcatattcattgtagtgcaacattaggaaataaagaggagcaatgaaacaaaacaaaacaattcaactattagagattagggtttcaggcttttcctctaagtatgcatatgtaaaatttacgtatatatttaaatttcataaaaagggactaacacagtatctctcatttggtaaattaccttttgtacatcttgaacatctttttaataaacagacatctgtgtctcatttttctaaatgtgcctacccctttgatggcctttcatttttattgagtctaggtttatacttccctgatatatatacatatataaatagatatttgtaaaaaatacataatataataattttacacatacacgtatttaacagtttgaattaggatccaaataaggtaaatacattacaaatggttgatgttcactaatctctgtatttcctctacagatcttttttccatgcattttttttgttgttatcgaagaaactgggtgatacacgtctccacagtttagactttgctgactgcatcagtgcaatgtggtttaacatgtttctgtatccccttggggtaccataatttggtagttagatgtagaggcttcatcaaagttaggttcttttcttttttaaattgagaaggggtctcactatgttgcctcggctggccttggactcctggtctcaagcaatcttcctgtgccagccttcccagtagctgggactccagtaagtctgctctgtaaactttgcttaggggggtgtgagatgttggatgtctactcttgttatatgagcaccccttgatgctcactacctgaatccattagttctctcgtcagtgagaaatgggctggtaaagttcctgagatttcgacacagcccttgttgtctttgctagcttttttgatttctgtataacaagatgttccaggctcatcttctctatttcttatcccagaccaagaatcggccttttctccaaggagcctttgctcttttaagagggaaattttgtttgttttgtttttttgagacagagtcttactctgctgcccaggctggagtgcagtggcatgatttcagctcactgcaacttctgcctcttgggctcaagctaccctctcacctaatcctcctgagtagctgggactatgggcattcaccaccacacctggctaatcttttttgtttttttgtagggacgggatctcgccatgttgtccaggatgctctcaaacacctaggctcaagcagtgttctcaccttgacctcccaaagtgttgggattacaggcgtgagacatcatgcctggccaaaatggtatttagagatctccacctagggccaagtaggtactcttgtcatcctcatcttacagacgagaagacaaattaaaatgaagaaaacttaaaacttgaatttcctaggtgaaagtatttccaaaatgcaattgacctatccttgcctttttgcaaagaattctgaatataatctaaactttttttaaaaattggttttgggtttagccttagtgtcctgaggctaagacatcattgttctccccagatgagcaggaatgttactcttgttctgtatccgtgtttttcaaactctgtggaaacccactaagaggttgttaaatcaatttagtgggccttgatgaactttttatttttagtttttgaaacagggtcttgctctgttgccaaggctggagtacagtgacatgatgttggctcactgcagcctcaacctcccaggcacaagcgatcctctcacctcggtctcctgagtagttgggaccaccagcgtgccccaccactcctggctaatttaaaaaaaaaattttttttgtagagattgggtctccctgtattgtccaggttggccttgaacttctaggctcaaacgatcctctcgccttggcctcccaaagtgctgggactggaggtgtgagtcaccgggcccagccaaactttttttttttttaatgacatgcactagaatagaaaacatggaagtgtatttcgtggatacttaaaaagaactgtgtatgttgcaacaaaattctttgtctcacatacacaatgaacattgggttgtaagttcaatagttttcttactctgagctgcagtcaaaagtttgagaaacactgtactacatctttgccactccaagtgtggtccccagaccagcgttactgacattaactgggaacttgctagcaattgcagactctcagaccctactccacattcaatgaatgagaacctacatttttgcaagatcctcaagtgattcacacacacgtgaaaatacgagaagatatgcattggaggatgcctgtccctgtgctttttcagtccttgtcatttagtggttcctttgctttttcatggctagctctcacctgttcaggctgaagctgacctttgtacttttcccctgcagccttattttcagtgaagtggaaaggtaggctaatcaccaacctgaggtgagagtaagtagttttcacatgattccctctccaacaaacatgggaactttgatgcttacatttgggggagcttttattcgctgttcacatgaaggcagaaagagaccagaaggcacatgtacccctacttagagttgtgaagtcactgctgttcacctgctgtcatgggacaatgaggaacttatgttttatcatactttctgacctgtcccatcagcagaacttctggatggcttgatataatgcggcttatcagaagaagatgaacataagaaaaatatcactagtctccaagtttcttgctgttcttttgcatttcagaaggagctttgtctgggaaatgattttcttttgcaagaacagcttaaaagcatcccaagcacatatttctgaacagaaaaagctgatacgacacccagacgacggacattcatttgtttgccttgtcgtgtgtgtgtatgttgtacctcatgtgtccctccccacccccgtctgtccacctcgccagatccttctattccttagggcccagcccaaacgcttcctcctccgggaagttttttatgatacttgaaaatctgtcatttgaaactccagggccctaaaacctattttccttttgggccttttgtgtttttttaactcataagaatacctggcacacaggaagtgcttacacaataagtaatttgtatatatgttttttctccctttgaaggctgcttggaaaaactaattttttgtacccctctctcctttttttttttttgagaaggaatctcgctctgtcaccaggctggagtgcagtggcctgatctcagctcactgcaacctccgcctgccaggttcaagcgattctcctgcctcagcctcctgagtagctgggtctacaggcatgtgccaccatgcctagctaatttttatatttttagtagagatgggatttcaccatgttggccaggattgtctcgatctcttgacctcatgacctgcccaccttggcctcccgaagtgctgggattacaggcgtgatccactgcgcctggcccctgtacccctctcctgattaaatatttcttgaactggcatctttctttgaaaagccttacagccaggcatcgtggctcacggctgtaatcctagcactttgggatgcacaaggtgggtggatcacctgaggtcaggagtttgagaccagcctggccaacatggtgaaaccccatctctactaaaattacaaaaaaaattagctgggcatgatggtgggcacctgtagtcccagctacttgggaggctgaggcaggagaattgcttgaattcaggaggtggaggttgcagtgagctgagatcgcaccactgcactccagcctggggggcagagtgagactccatctcaataaaaagaaaaaaagaaaagccctttattgcagagggtgacgtgaggaccatgtagagatattaagcatttccttttgatagttttgaggtgttgttcagtacaaatctctgcaggacatttgtcttgggaaactgttgagtattcataaaagggagtggaaaaatcaggtagtgaaaccaagctgctttcaggtcatattggtattgccctggtgagccacaggatggggactccgcagtaccgagtgttgactgcttcttgggtaaggggcaaaacatggaacatctgtgcatctgtttcctcttctgtagaataggtgtaaaaataaaaatacctgcttcgggtcattgctgccgagttgtctaaaaacaaatgtttgcagaaggcgttacagataaaaaaacaaagcaaaacctatctatgtcctagagcagtggtctcaatggggacagggagagtgatttgtgtcctccaggggacatttggtatcgtctggagatatttttggttgttctatctggcaggcaggggtggggtgctactggcattttgtgaacagatcctatggtgcacaggatagccccccactcccctgccccaccacacacacacgcaacggagacctctctgccctagaatgtcagtagtgaaccggttaagaaaccctgtccttgagtgaatttttctggcttggtgagacttttgtctctctctgaggatattgacctaacttcatttgctggttttttgaggtttgggctatgtgggcagaggggtgtctcttcaggctgggactgacttcaactttttaacaaaataagcaccctccccctctcgccccctcccaaaaccaaaaaacactggccttggtatctggagccctgtggtctatctttggccactcatcagctgtgtgacctccaagaaatcactaggcctcaggtttgttttttctacccgtaaattaaagagttttagctaaatgccctccactcaccaaatctgcagctctttgccttggaaatattgagcttttggttggcttctcttactttggccttgaagaatagaagccatgagaccaaatgtcagtgcgggcatctttttttgagaaataactttgtagatattgtacctggttggggaaaaggttatttagcagacatgtctgaaaaagcgagtaggtttatttttgtgtgtgtatgtgtgttgcggcggggggaatggagaatgagcaacgttgtattatactagagaatcactcctctgaacttcagatttacagctgctgtttctgggaggccatgaagggccttgcttaaagatgaaacttctgagttggtgacttcctttgggactgcctgaaaacgaaagcataatacaattttctatgctcccagagaagtgctttttgcaagagaataaattatctgatgatggggacatgctgcatttctgaggacgatctgattagcagctaatgggacaagaaggcaaggagggggagctgtgtgaaaacgtgtggggaggagggtggcattatgtccaagtcaaaaatgtgctgttcctcctcatttcacaataaagatgatatcgccaagcatctttgctcaaaggaagtccaaaattaaccctgagtgcccaggaacaggagcagagactgttgtaaagggagcctttttctccctcttgaaaaagtcaaccgtaaatgcgttaggttttctctacctcgtatttacagccatattaccatatatgtacctgggtgagggcatcgcagggagacttgtgctcactctgtagggagtttccttggcctcttgccaggagattgatcaaatgccagcagctcttcctttttctgggcatactcctttttttttttttcctgtgaaagacctcatggtttgccaggctcggcccatcgttaacctgccctgctgggtgctgcttgacctaaaaagtgaaacggtgcctttttgtcttcgtccttatcctccgttctgaggggccaactgccttatggcctcttggcttgccaggtgctttgagcaaaagccctgtgtgtaagcccctctctttgctgcctaactttaaaggaagcttttttccccttgtttttgagaaggagtctcatctgtcgcccaggctggagtgcagtggcatgatctcagcccactgcaacctccacctcataggttcatgcgattctcctgccttggcctcccaagtagctgggactacaagcacaagccaccacgcctggctaatttttgtattcttagtaaagacggggtttcgccatgttggccaggatggtctcaaactcctgacctcaagtgatccacccaccttggcctcccaaagtgttgggatgacaggcatgagtcactgtgcctggcctaaaggaagctttttgatttttattatttttaaagcaagcagcaagaaaaccagcaccaaaggacgttggcaagggccttttgttttttaggaggtggaggtagtgtggatatgccaagaaagaatggggaaggctgatggacttgttgttggctccattttttagcagaagaatgactgtccaaatgcaggtgctttggggctaggtggcaaagcttgacgactggaggatagacgcaaagggtgctgtgtgagtgagatgctggcattcactcctcacctggctgtgctttggtggttctggttttattaggaatagtggggaaaacattgttggagttggcattgacatgttgaggtcagtacatctcatgtgtcccttttgtatattcacttgtcatttggactttgctgtttggcagagctgatcctctgctgattataagcctaagaagtttagaaagagtagtttatgagaatagaaaatagaacagattagaaagtagaattataacagccaataggaatgcttcctccgtccccctttctctgtgctaagtaagcatattttctttttcacaattaattgtcaacataactatgagataagccctcattatccccattctgcagatgaggaaattgagggccagataagggaggtaacttgattgacttcccattacatttagaatagaaggccaactttttaccctggcttgtgaagtcctactggctctatcttctctaccctgtctttagcctgtactttcttcctttccccattaatgctgcagacattgggctggctttctgtttctggaatttgctaagctcttttctgctttatggcctttgtactagccgtttactctacctaaaatgctcttccgcctgatttttttttgcatgactgcctctatcttgactttcaggtcttcgcttaaacatctcatcttgttttttctgaccagccaaaattgcattgtcacttaatcatatcaccagttttaattttttgcatatactcatcactatctgatttgtcttgcttgttttatctgtttgtttcctgtctgtctgccctcactagaatataggtatcacgggagcagggaccttgtatgtcttgctttgatctgtatccccagtacctagtataggggtggcatatagtaggtatcaataaatatgttcgataagaaggaagatttaagtttcacatggaacagttcactttctagagccctggctgttcagttttatattttgcattttcatcctgttatataaagtttccaaacttatacagtgagagtcctaagcacacagtcattgccaggacaactcttaaagaaaagtttatggcagcagttttcaaacttctggctctcaggagctcttttcatgcctaaaaacaattcaggaccctaaagaactgttgatgtgagttacatctgtctgtatttacaatgttagaaattaacactgagaaaatgaacactgaaaaaatatttttaaaaaccaattacacattaacgtattgacatatttttaatgaacaataagaatattttcccaaacaaaaattttgagaagagtagcaattttttttttttttttttgcgaatcactttgaggtctggtttcacagaacatagccggattcacagatcatatatctgtttctgtcttcagtctgttgttacatcatgtgccttgcagcctctggaaaacttcactgtacatgtgtgagagactgagtgaaaatgaaaataatgccccaatgttattgtgaaatagttttgaccttgaagtttccctgacccttgggccaccagctcctagagtacgtaggtaatttgaaatgtggggttgtggcatggaacattagagagagggagaaattgaaggcttaagtgacagggtgcaattgaccatctctaagtctgggtattgtatcagatctttctgttcagaaaaaaatgcatggggatacttttcagttgtttttgtgaaacaaaattgcttcctaaagttcctcctgaaatgcaaagaaacgctgagaatgtggaagctagtggtacttgtcctacgttcatctttttcttatgagcaagattataccaagcagtccagaagttctgcagtgggatgggtcattaaaaaattataaagcataggttcctctctgtgtctgagaatagcagcttcaagtgtaacttcctttataactgttagtctccaacacttactttgttctttttgtagcttttggcctcagatgaagttgtgtcctacaatagaaattagattgatgcttattgctcttaggttctgtcataactggtgtttaaggaaccaggatagaagcttttaataatagatgagctatattctgtgctagccagcttcactgtttaaggaggttaaatgattacaaattcaggcttctggggagtgttttgcgtgtgtcttgggtcagtgatatataagattttcactgttaaggtaattgtgtggtaaaatacagaggagcttggtcatcaggaaattaatggtgcactgtggggacgaggcgaggggttgcaggcaggcaggggatccaaagtacctgactctcatgctcagaagggtttcatttaaggtcagactgtcagtgggactaccctgccacccgattactgaaagtcagactgttcagccccagtggccaggtggcttcatcttaattaaacgtaggaggcttgcctttgtgtcttggtaaaaactggcaggtctgtggttttggggtcccttaactagtataaagtcaatttctcatttcctcccaagcctgtccacccttgaagattaagtgatcccttaggtaacttattggttaatgaagtgttctactttagtctcagtttcaggagttgttaacttttaaattcggaattctgtgtaggcgaaaatcaaggtttttttttttttttttttttaaatgaatgtaatgcaattagttaagtgtgtgcaggagaactaatagatggaaaaatttcaataagtgagttttctgccacagtcaaatgagtgagttttctatcacactaaaagcttttagaaaaaaaaaaattccaaacctatcttgagctgctgcttaaaattaaatgaacatatttcttttttagtgaggttgtgctttggcctgttttaacaccagagtggaagaggttctaaatactgaattactatccctttgaagaggtttccaccacccccactgccagcaggggacctagattgatgttagaaggcgggggagttgagttgaggtctggccagctttggtattgtgagtttgggtactgaaaaacaacagtactttggagatgctgtccaagtatcagccacctcgtgggcttacagaggatttaaacatttctgggatctttgtttctccagatgtatttcctagagtattgaccaggtaagcaacattcatcaagtagaggaatcacaggacagaggtgagtgaagactttgaaggaacaaaaacgaatgttttcatttcagactcattcagacatacagaaagtgagcataaagggccaagtattgtgttgaccactttatgtggattatttggtttactcctcacaatgaccctgagaaatatgaaaggttgcccccttttttacagataagagagctgaggttcagagaagttatggaagttgcttaaggacacacagctggtaatttatgaggctggaattcagactcacatattctgagtctgtttccaagtgtacactcttgtcagtactccaagccattttggacatgtggaggggatggtcaatggggataaaagttagagtatctttccagggataaaagttagatattttgtttcttgcttccaaatttctcatagaaatctattgaaaagggccaagtaggtttctgttcttgatctaacactgtaaatttggctttaatttgttttggagagcagtcatctaaaaaacaaacgaggtgtggtggctcatgcctgtaattccagcactttgagaggctgaagcaggaggattacttgaggccagagttcaagaccaacctgggcaccatagtgagaccttgtctctacaaaaataagaatgaaaaaacttagccagacatggtggtacgcaccggtagttctagctactcaggaggctgaggtgggaggatcacttgagcctgggaggtcaaggctgcagtgagctatgattgcaccactaccttccagcctgggtgacagagtgagaccataactctaaaaaacaaaaccagtataaactcttctaggcagcagatacaatagcactaaagtgacattgaacccatatttgactgcttgctctatcccaggtactaccaggtactaggatgcaacaggaaagaagacaactgaggttcttgccctcatgagcttgcagtctagtggagaagacaaacaaacaagtgaataagcaatgttaggacagtggtagtggacccaggttgctgtatagaagagtatgttggaaacgtataacccagatctgggaggtcggagagggcttcccagaggtggagacatcaaactggggctgtgaaggtgagtgggagttagccacaagtggtggtgggagagggagggagatgtctcaggctgagagacagcatgtgcaaaggcccagggaacagagcatggtgggggccctggaaaaaaaatcattatggctggagtatggagagcagggctcaaggtaggcagggctagatcatgaagagctccaaagagatgttggaaggttttaagcagggaaatgatatggtctgatttatgtttctaaaatatcatgctggatgttgtatgccgaatagattgacgaggaaagacagattcagagaaacgagtaggaaggccttagggagtccagttgagaaatgatactggctgagactcaggttagcaggggcaagggagctagaagaatcaagagatatagtaaagcttaaagtcagcaaaaattgatgctggattagactttttcattcatttattcaacaggtatttactgaatacctactatgtgctaggcattggtgtttggaatacagttgtgtataaaacacatcacacacagatctctagaatacagcatgtgccttgtacggtgtcagacaggaattgcacaagtaaatgtgaacttgtaactgagatgaaggctgggaaggagagatccatggtgtagagtttataagagtggaatttaacttcatctgaggggatggggaagattttctggtggaaatggtagttgaattcagagctggagggtgacttggctataattagagcaaggggtggggtagggacgagagtgttgtgggcttgagaaaacagcacaggcaagggccctgtggcagggaacatgagagagggaggactggaggagccaccaggctttgctggtggtcactgagaaatggctatgaaggaggaacaggttgggcaggcaggtaaattctttttggtacattgagatgccgtgagccgctaggagcaaaactctagtagctgtgggacatgagagacagatttgggaatcctcttcacgtaacagtgactggagccagcagagtggacgagaagaccaggaaaggtatagagaaggcagagagcaatacagacgctgaagagcagctctggcttctcttccccaaggagatctttctgcatttatttttttctttatttgcacttttcttgggaatataatcaaatcttccctgccccccctttttttttacgcacagctcagggagcaatttcaatagagggcaaagggaagctcagccagagggtggtgtcaggctcaacaaagctgccacagcctccctctgcaagagtgtctcccagaggcagtgatctacctttctttgccttggccaaagccaccctggaagaatcctgttttaacaggtgcttgcacccatcagaatggtggtgggtggcggtctgatagtactattatatattggtggcatgcctacttcacgccagatgctttgctgagtgtttataaataccgtcttgctgaaccttatgtcagcttgctgaggtaggtgctcttattctccccattttacagctgggaaaagtgaggcttagggaagttctggaacttgcctgaagttcttcagtgagtaagtggcagagctggggtttgaacctgggcactttgactctggagcctcagctcctgcctgccatgggctgagaggtgcttttgaggtcattctgcgtcaggaattgcggggaggatggtgatgctttgtgaaaagaagcaaagccttaaggagaaataatctagatagcattcacatatgcagaggtcttagatgcttcagagggcagatgaatagcaaaagttctgggaggcggctatcctttgtggggctaagggaggggacaggagtaattgttttattttttcacaggcagggtcttgctctgttgcccaggctggaatgcagtggtatgatcacagctcactgcagcctggagctcccaggctcaagtgatcctcccaagtagctggggttacagatgtgtaccaccatgccctgataatgtgtttttatttttattttttgtagaaatggggtctggctggtctcaaactccttgcttcaagccatcctcccaccttggctgtttgagatgtgatgacaggcatgagccaccgtgcctggtttaggagtaattgtctgaacaaggctgtttgaacaaagaataggctctattgcccagtgagaccatccataggcagcgcgatggggagatttcattattgggcgggaggtggaattacatgctttacagggttccttccaacttttattccatgattctgtgttttttgaaaggttagaatgctctgtggctggcagttgagtgtaattcgctattgttcaccttttttcatcaggggaattaggaaggataaattatcttccctgaagtaaaatctgtcatcatgggtcatataggagttcatttgttatgatacacatctgattttttaaacaggggatcctttactgagtttaaattttgatgccctggaatctttcagaattccacttatctctcgtggaagaaaaataaaaataactagcatagattaattcaagtatgtcagccactgtaccaggtgcttttcaagcattatttcacccattgctcaccacagcctcttgaagttaaattatccccatttaacagaggaggaaatgaaagcagagaggttgtggtgggctcctaataacaagctagatgataataataataataagagcttaggggcagagagccagggtggagtgcgggagctgagcgcctaagcctgccctcgtgtatgtcaggcatggcttgtcagcagagccctcggtgtctgtaagtgtttgaagttccgcagctccgtggcaggttggcgccagctctgttttctctgaggtggtccttgtcatggtgtgagtgacataggagccctgagtgcagctgctagaagttcacaggcacaaatggtccacgatcagataaagaggcgggctctcccacccagctctgaacaacaggaagtcttccagaagattgctcctaggcccatcacttctggggcggactttccacctccacccctccacaccacagaggcctgttctgttgactttcccggcctttgtttttccttccaggacatcactgataattgcactaaaacctatcctcctccccccatctccttcctccacttcactaaggcgaggccggaggagatctccagaggtttctagccagaccagcaagctttctgcccagtcctttgtgaggggaattatcacatgagacccctggggaaggatctgtcctcccctactttttggttgtttttaattgggacccctggcagattgcccagaggatcattagctgtggtgggtggactggcctgtgatttcagggggagatgtaaaatgtagctaaaggttacttattcacttatctcggccacttaataagtatcttggttagaagatgcttaattttttttctgacttatggaagtattacagagccatggtagaaaaattagaaaacagaattgtgcataagaagaaactcagttctccataatcatccggagtataagaacatttaacattttaacctgtgttcccaggatcactgttgataaacacctccactgaagaatcagatagacctaggttgggtgcggtggcttttggctgtcatcccattactttgggaggctgaggcaggcagatcacttgaggccaggagttcaagacccgcctgtccaacatggcaaaaccccatctctacaaaaaatacaaacgtttagccaggcatggcggtgggtgcctgtaatcccagctactcaggaggctgaggcgggagaatcgcttgaacctgggaggtggaggttgcagtgagctgagattgtgccactgcactccagcttgggcaacagagcaagactctgtctaaaaaaaaaaaaaaagtctgatagacctgggttgtaataaccctggtcctcctgcttactaattttatgtgatgtggggatcttacctctctgtattacacctcagtgtcttcaacaacaaaatggcaataatggtagttcctacctcctgctgtggtcatgaggattcactaagagaacatttgtaaagcactcagcacaatggtgggcatgagaaatccttgataaatgccagctattattatcagaaaagaaaataatgcagaaccgtgctgtaggaatgcaatgtccagacatctattgcaatgatcagctgcaagcaacatggggtacatcatgctttgtcactcgaggacactgaattgtctgcttcttcccattaagggcctggaatctttcagtaaggtatccaggtggcggtgatggttcacaaaacagcaggcattttctggcctagtctccactagggctgaatgcttatctgaagggtgatcctgaaaggagagccttagtcacactggacaaggccctagtcctcttgcggagcacatacctgctcttctgcatttggaaattccctggtgtcctttcgggatgccagggtgtacagacataaatttggtctggttcaaaattcaaacaaattgtcttctaataattggtcttagaagtatgctgacttcctgaccctttaagataaagctttataatataagcgcagaagggaaatattaatcccccttgatgttttccatttgtgccgcctttctggatgctgtttaaaacattggtttgcctttaaatataaaatatgtagttacgaagaattaaacaatgactgacatgattctagagtggtacttggcaaaccgtccttctgtacattatttgtgtatcttccctcaaggtctagagatgctggctcttttgtttgagagtttattctgtgttctcagttgctgtctccctctataaataagttcatgtttaatgaaatgctctttatctctcctgcaatgtctgggttgttggaggggagggaaggggatgacaaatcagcttttccctgcagcttctcataagcagtgaactgaggttctttaacataagtttgctttcagtaactgacattcctgctaaggtggtaggttgcttcctgaggtgtcatgctgatcattgctgcataattcttcctgaaagaaaacttggcacccaggaagcaattgaaggagacacaataccgttccacactgttacaactcttgtaactgtgtggggtaaatggcttctggaaggggaagtcgagtaaattgatggggaaaggggtgtaaaggggtctgggtttggaggaggggttttgggaaaacctgggttgccctgggcatctccacagcagatgcctgaggaaacactgggctattagctgcagtccacaccagcacacagtcttcccacataactgagtttgttttttaattgtcaatttagctttttacaattggttcccactcctcaatatttatggccctgatgaaagctgtttctaggagtcacatcaatatttttgttgatatttatgtgtgtgtatgtgtgtttaatgatttctgagctatgtagagatttcctgagacttaagagctttttctaagactgcctctaactagctgcgtgttcctgggcagggaaccttattattcttacccaaatactgaaggatctgggccaggtactgtctaaagggttttcatcctctggaagtgtttcttggtgaaggatgagaaggcaagacatttaagtagcatttgggtgacgtgcgtacagttgtggaattctgaaaaggcctaaaaggctgctggaaatttgtggtatttattggcaggtttctttttattaatgtcattttgttgctttggtaccttagcccaggcactgtggccttgccagaagcaggtttttataccaggtgtttccttctgacttaacattccctgaagcaaattgaatatgttaatgtttcataagtcagactttccaggtaactccctagtcactgccacgttcttggctgagttccctgcaggctttctattcactgcagtttttattatcaagggtcctcaacttgtagaatctgattcaggcatggttttgttagaaacaaatgttactgtggttggaatatcctgaaattagataatatacggggaaaaagtgttgttgcatatgtccttacttggctcattgaatcgcctgcctgtcaaactgttatttaaatttgacttttaagtaaggcgctttggaaaattgagctaagccaactcttagtgacttttttccccttctgaacatttcttttcttctaacaatgctgcatattttactttgtctaggattttcaagaaagacatgtctgacaaaatgtctagcttcctacatattggagacatttgttctctgtacgcggagggatcgacaaatggatttattagcaccttggggtaagagcatgcaatttcttgtgtggcacggtttgtttaagacatcataacatcagcttaaaactgtgatttttctaacataagaacgtcaccgttttacttggctttctaagtgcggttgaaatcacaaacaccaaatctcatgttagccaagtttaacctcttatacaaaaacacaattttctgtatatttctgaaagagcaaaacctcattatttaggacactattctgagtttattaaaatttgcttttcctttctatataaaagggagagtgcctttattccactatggaatacagtttaaatggaataaagtgtaaagatgaatatttacagagcccaaagaagtgctttttagttttgtaaaggctcttcttttcagatagtgactcctttataatataagcaaagaccaaacctcctgggctgcctatctcttttctttgaagcagacatttcctattttacattgctgtatgcatttgaaaattataaattgcataaagttctataaatcagatttttgctcttttgtgcttttttcccaatctttatacaacttttaagggtataaatatatttcataatgtactcatttgattatcttctcccgtctcctcctacgcctattgtctagaagaggaaatgagaggtgaaatagtcccaaaggcagacagaggcagaatggagaatcaagatggttaactccaaaatagttacgaatggtctatattgtctttgtgtagaaaggagtagtgaggccccggggcggcattgttgaatttggcaagagctggactcaaataaattgggggaaggaagaccagcagcttctccaagaacctcatttttacagcagccagaccttcctttcaattatagctattatttaaagcatgcttgtttcctggtatttgtgcagaatgagtattcctaggctctcatgcaggttactccacactcagggagcaaattattatagatacagaattatagctcaattagacttgtgctcccactgtagagagattttgtttcaaatgtcatccagtgaaaaagaagtcatccatggctgcctgatcaccagatccagtgactttctacatttgacctctctccattatggacctacccttaacaatttatcttctgtggcttttggcaaagaggcctccttctgccctgcctctgactctccctcctttcttcatggttggctccttcctgttttcatcgtctatggttgactcttttaccctcttcttcttttcagtaatgacagcaacagtaataaatgaaaagcactaaatgagcccagtgggtatttgctgtgtgctaggcactatgctaaatactgtgcctacatcttccttaatcctcacacaactgtctatggtgaacattgtcatcattgctgtttgtggaggcaaaacttttgagcttcagagaggcaaagtcacttgcccaagatttcacagctcagaaaattccagactccaaggctagggctgccagcagttgctctctgcaggccagcttctctctttccagcttccttgtctgcccacagctctccctcctccttgactgtgcacagcccctatctggatgcctggttaaacctcaacccactctattcccatgtttcccctgggggtcttgatttcccagtcacccaggtgcctcctgagcccccgggatcttagtaccttctttctcttccagggcatctcttctttaaaatcatatgaagtgctttttaagtgttttcctcaaacattgtaaacaaattaatgatgagtccctcctgcccttttaaagtgaggagggcttctttttgaactttgggttgctaatactttcttgagatgaatactttattttctcagttgcttgcacatatttgaggatagcagtgtaaaaatggggttggaaagaaagtttgacaacccttcctgtttttaatatttatgggggacctgttgtggactacagtgagtgagtgccagtcgttatgggactcactgtgtagcactccagccccatcccatttatatagatggtggttacctccaaatggcttcatctactgattgaacttgagaactccaataggatcttggagggcaagtgtgtgtgtgtgcacactactcagtggcatgcttctgaattgcctttttagcttgttaaaaataaaggttcagcttggtgcggtagctaacgcctgtaatcccagctacttgggaggctgagatgggaggatcctttgagaccaggagctcaagaccagcttttaagaccagcctgggcaatatagcaagaaccctgtctctttataaaaacaagacgggcaggattcttgggcctcatcctacagcacagctttagtaagctgggttgacagagtcctggcgtcagtatatttggaaacaataagtctgatgaacatccccctcgttaagaatccctgagaccaactttcattttacagatgaaaaaactgagaccggtaggggtaaaatgccacagtcatgatcatgccgctagtaggtggcagagtgccatctacaattcatttgtcatctgagcttgactggggctcctcttaccacttcctccccatttgagaacttgatgatttatttatttttttttttcttgagatggagtctcactctgtcgccaggctggagtgcagtggcacgatcttggctcactgcaccctccacctcctgggttcaagcaattcatctgcctcagcctcccatgtagctgggactacaggcgcctgccaccacgcccagctaatttttgaatttctagtagtgacaggattttgccatgttggccagaatggtctcaatctcttgacctcgtgatccgcctgtctcggcctcccaaagtgctgggattacaggtgtgagccaccatgcctggccatggcttgatgatttattaacctagccctaccttggattctgagcccaccctgtcaagcattatgttagctctgggggcattactatacttacaggagcttaaggtggtggttttatatatgtatattctgctcttgatttttacatgagaactcaggccattggctacactgttcttcttgtttatacagtgaagtcttgtgtcatgaagctgaaggaggcaaactgctggtggggtaccatggacactttgattttacccaccaaatagatactgagctgccagccttgggcatcttctggccttcatggagctggtagcctggtgcccctttggagtctcagtcagtgaggttgggaggacagagaaggagaggcagagagtgtctggcgcaggagaagcttggtcggcggggctttgtggagaaggtggggctcttaccctgagtcctgaaagacaggcaggacttgaggaggcaaaagggaatcttggagaatagaacagtaagggtcaaggctgaatatttaatggtaccttgcatttgggatgagaggaggcagcacagatgaatggaggaaccctggaaaaccatggtgtgttagctgggaacaactgcaagttctgtggtcacttggaagattagccagttctatcagtaccagttttaggagcttggacaagttgtgtaacttctcagagtctcagttccctcatctgttcaaaaatatatttttaagtggttcttctaaaagaattgtgcaagttagacttagcagtcaggactttaaatactgagtctttatgtaatgtgagcttatttatttgtaattttttgtactttccccactagttgcttttgatgctccacagtcctttcatatcttcatgagtttgtgctcatggttctttccacctggaaacgctcccctctagcctccaacatctatttcgaatcttccagtagttccattagaacttcctctgtctgcagcttctcagatgacctcaggcacagttcgcttctggctgtatttttttttcttccttctcttacagcccttagattatattctccttatcagtttgttcttaaggctcctgcactagccttgagctcccaaagagcaagggcctggctcatattcacctggcacaaagtcagctcctcagctacccttagttgaatgcaacagccccttgctgtgtctcgcgacttcagccaccttgcatgctatactcagatctaccatggacatggttatgggaaaggagccacagaaaacagtagccttaatgtgtccttcacagaacagaaccctgggcttttggattaggtttagatccatgcataggaagcctctagtgtaaagagttcctggcaggagaatatggcaatctaaatgttgcgcaggaaaagccctgggatatctgatttttgcatagtgctaagagtttcattttcatacacttgacagagcatttatctgtcttctttacagcctggttgatgatcgttgtgttgtacagccagaaaccggggaccttaacaatccacctaagaaattcagaggtaaggtggtggctttcctggagtagtcaccttgactcacttgaaaattcttgaagtgtgttgttggtgtgtgtgtgtgtttataagcaaaataggcttatttattatgtatttttttcagagtatgatttgagttctaagctttacaacttgaaaaatgcatacataaatttagtatcaagattgggttggcttttactgggtccttaatttgtctattgaatatgtgttgacaagtgctaattcggtttaaagtcttacatttgtacaggtatttcttcaaacaaatagtatttatggatccagtcacagggaacattcattatttcagcagatctcactgtccgtttggggatgctgatattcttagataccttctttaagaggtatctaatgatacctcactgaatgtctcactggaatgaaacgttcttaattattgcacttgttttttgagttaaaagacataggcaggctgggcacagtggcgcatgcttgtaatctcagcactttgggaggccagggtgtggagattgctagagcctgggaattctagacgagtctgggaattctagaccagcctgggcaacatggtgaaacactgtctctactgaaaatacagaaattagctgggtgtggtagcatgcacctgtagtcccagctactcaggaggctgaggttgggaggatcacctgagcctgggagttccaggctactgtgaaccgagattgcaccactgtactccagcctgggcgacaaagtgagaccctgtctcaaaaacaaaaacaaaaacaaaaacaaaaacaagacataggcagggcagcttttctacccaaattagttttttctttaggcctcctgaatttggtatctttctccaaaggtagcttagtttattgtaggaggtctttgaaatacacttggtatcttagatgataaacatttgtttttcttttttgttgttgtggttagtggtcctcagctctaggcacatgttagaatcatctgaggaagtttttaaattaaatagatgcttggggctccattgtagagcttagggatcaactatagagccctaacatctatttattaattaaattatttatcaattaaggtaacctctggaattggggatgattctttacagccagggcagaaaaccactgggttaggtatttgactgatgacttcagtcccaaagggctcaaatcttgccatttgcagattatataactcaagttctaagttcttattgtttagtggtttagaaactgtttgacttttttggataaaagctaaataaattagaataaaatagaactcagacgttcagatggagaaaagccatttggaagacatttggtgttgagttgcatccagttggcgtgagacaatcaggagaatgttttcacctgaggatgggtggtggtaggggaggctgttaaagagagagaataacagttgttgatacaagttgtaagaggaacccaaggcggctactgcctccaccgcctttttcttctcaatccttctttcatgtttccttccaagacaagacaaaatcttgagtgctgcaaaaatgaaatgtttcgtccaacgatcataattcagtcactcatagaattacttccccactgtgaatattaaaagggacaagatcaattgactgtgccaggccctgtgctaagcactctgcctgcattagctcagggagccatccctcctccctaggaagagattgataccctcggaacttaagaaccttgtctgaggtcacatggctggtgacggatggagtgggagccatggttctcaactttggctgcacagggagatcacctggagaactctcagaaacactgatagctgaatccagctcagggattttgagttaactgggcattgggatttttgaaagcttctcaggtgtttctcttgtgctgccaaggttaagaaccatggctaatgaaatctaggctaataaaacttgaactttgttattcagggaagagctgatctaggtttcgcttttgcagctgggaccaaggggagggatatgcgtccggaaggcattgcttgggtccagcgtgagctcttatcttgttctatatacgggccttgggagctgggagatgaacctgggagagattctaatgtactgtacgaagttaactagtggctatttgttttttacaaatacatgcacataatttaaaattttgttttttaaatcgacatatatttatggtgtacaacatgatgttttagaatatgcatatatagtggaatggctaaattgagttaattcatatatacattacctcacatgcttattattttttttttggtgagaacatttaaaaactactcttagtgagtttcaaatatacggtatattgttatttgctgtagtcactgtgttgtacagtagatctctggaacttattcctcctaactgaaatctgtatccctcggccaacatctcaatcctccaccccagcccctggtgaccactgttccactctctgtttctaggagttcaatctttttagattccacatataagcaagatcatgtggtattcgtctttctgtgcctggcttatttcacttagcataatgtcctccgggttcattcatgttgtcacaaatgaaccagggactgtttgaatacagggttagaatgttaaaaataaataggactatagcaggggaagtcggaggagacatgtttttctggcacgactgtaaaggtgcctggtgcttggatgtatgtatggtggctgatttgaagtgactgttttgagataacggtaatagtctgacagaagctatttggaaggaagcaaactccttttacagcctggcctggttctacaggtggtcacgtgacagtgacttgatttgttgagtgcttttctccctaaattaaaaataaaggtttctgggttgtgagatgcttcgtccttgtgggaaaatctggttcaaaacaagctctgctgcaggctttgggaatgtaggtcaggacttccttaattccatgtgctaaaccagaggtcccctgcacccaggtgaggggcctaggcagctctgcctttgcaggctgcctcagtgctggaaagatctgcttctccaccgtggaacttgggcagtgagttttaaaaaattttccaaagcattccttcaactgcggtgcagcatactttgacggtttttttttttttttttttttttttttttaaatgaagagaaagatctctcttttggaagcaattgctgcgtttccaaatataagtgtattttggagctgaagtcattttgatgtttagaaattgtgcatagggcagttgggcaatttggaggcatttctagtccatttcctcatggactcgttgcaccctagagtttaacaaacacatatggaaaagtgagatgctggcaagcagccgaatgggatgatggagtctttatctgagcaatcagcagagctgcatgtagtcatttgggtttgctcttgcttccattgtttccttgccaagttatttcctatattgagaaccatcataacctgttcttaagtaaatggaaatccaaggcctgtttatgcaatattccccatggcttctgactttgcatctttaattttgtgagctcctgagatctgcagccctaatggttaataaaagaggctcttggatcaggcttcctggttcatatccaagttccatgaattctttgctgtgtgaccctgaacagattacttcacctttgccaaccttggttttctcacctgtaaaatgggagaggataataggctctatctcataaggtcattgagaagattaattgtgtgttaagaatttagtactgggggagtctgacccttagttaagagtttaagccttattcttttctttgtattcccagtacttagtacagagcctggtacttgtaaatctcatgtttaattttatgagaataattatatattgttattttttttttgtcttcaaattgtttgtgggtggggacgtgcacatgaacccctgggcttggatttgagccccagtgctcgtgtatgcaagctgagtaaccttgatagattccataatatttctcagcttctttcctcacttgtgagttagggtcaaacaattccatccttatcaagataatatgcataaaaagcctaatagagtgcttagtacacagtagttgttcagtgagtggttgctgttaattttcacagtagatatagaagagttcaacatcgaacagaagatatagaagagttcaacatcgaacacacttgcttttttttctctgatggttgaaagtacatttccaaagtgaattgctttttttgtgtgtgtgtgtgatttccttgaatgtatctcttgcctctaacttcctctgtaggaagaaaaggttggctgcacatctgtttcacataagccacatctttttcatctgaatgaattttggacaatatcattgtcctcgtaagggatgaggagagctgagacttagaataatacagcaactttagttcttttattaatatggtaccattttaaagccccaacatccatggaaggtaaggcagaacctcctcttctccctgatttgtgttgtctttgcccataatcttgaaagaatagagaaggcaaacatcagattgaaacagggaatagaaactttgtggttagtgaattcctttatctgtattatcttttcctcttcccacttttaccagtccctcccccagctcccccggtgctaaatataaagatatctacaaagaaaaggtggaaactaacaaccagtcttcattttgctcccagaatctctgctctttttaaatataaatcacctccagggttgttggagtagaaacaagggaactgggcttttgggcaattagataggctttagtgttgatcatgccattattgcataagattcgggcaacagtcaggctcttgctttcaaaacctaatcttctctgttcacatcaagaggccagtcatggctccaaattcttgatgttggacagatgttaccatatcaataatatcaaaatgtgcagcttttaactttgcagggagccccttagtttcagaataaaagctgttcgaagggaaacttacagttcaaaatgaggagaagttggggcaggaaaaaatgaggtgaaaggaatcattattctatcactaagtggttcatatgaattggggaggggatcagacagactgaatatgtggatgttccagataagtatcttacatttctctttcccagtgaagttggtttcaagcatcatagtctaatctaagcaaatgtattgtgaaaaatgagtgttgacctccagcgctgaggccctactgtgtaccagctgctggccttggtgatggcaggacaagatgagttacactccttcttgctttcaggagtcttagagtttcatggagaaacagacccacattataagttacaatagccaatgttaatacagcatttattttgtgcaaagcacttcctttgaattatctcttttaatctgaggaacccacctatgaggtgtaggtcttgatgttcccattatgcagttgaggaaatggaagctctaagaagttgggtaacttgcccatagtcagttaaatgtcacttcttagaatgattatcattcatttcacaaacacttattgggtagttcccatgtgccagccatttgtactccatgaggaaagagacattctcaaagaagtctacatcaatatgtagtgaaaatctttaagaaacttctttagagtaatttgttgtcttcactgcaactatttatatataagtagaagcaaagcaggtgaaatttcttcctacctagtataaaacctggcctactggggaaaagtaaatgaggatgcttttcatgtcctaatctttcgctgtgcagcaccctgagaccagagcgcacctatttggtacctgatgccatttgagatgacaagttatgagctggtccagtgccatgtgacttatgagtgtcgtagccagagccctcttccaaaggctgggcccagtgcttttcttcctttgtagttttatggagacaaggtctcactctgttgcccaggctggattgcaattgtgtggtcatggctcactgcagcctcgaccttctgggttcaaaccatcctccttcctaagcctcccgagtagctgggactacggacataccccatcatgcctggcttctttttaaatttttgtagagatgggggtcttgtatggtgctcaggctggtcttgaactcatggccccaagccatccaccaccttggcctctcaaattgctgggattactggtgtgagccactgcaccctgccacacttaatgcacttttagccattgccccaaccagctgtgggatgcgcagtatgttacttacagtaggatgagtcctgtttgtagtgcaaacgagggtctggcctggggcagtataacccagtttctgggcatttccagagtaaaatgttggtggaagacccctggttcctcaacatatgcccggctagaaataatgacagtctgagtattgtgcagtcaccatgatactggcatggagaagagtatgttgcttggctataatgagccgctcttggacctaaagcatggccatgaacttgaggatcacacttgtggcctttttatttttattggtgccttctttccccagtcccagagtgctggcaccatgttagccccttttagtagcatgctggtggatttagtaggattattttattgagagagagaagggttttacatctcatgcaagctctttgtaattgactttgaaacctcccagcagcttaggaagggtcctcaaataagaatggcatttttcatgcttgagtgataagaaacacttgagtgtcaatagcctacttctctgatcttggtcttgcctgcaatttaggttaaatataggggaaagagcaacctctggatgccagagctagcatccagcccagaatctgccatgaactgctccaataccttggagaagtgatttcgtctctcttagcctcagtttccccatctgttaaattgggtttttccaagatttcatccagcttgaaactttgctattagtggcggaaacaggcaggttaacgttagaagccttgtgctgtccagaaataggttcttatttctttgggattacaggtctctttgtcaagatagatgagtgctggtaatagccaggccttaaccttacccttaggccagatggggacacaggcagggtcttgggtcacaaaggtcatctagggtggctataacaaactcaccggcttagctttctttcaaacgaccctcctttgccgcacattgttttaaatgttgctaagcaacagtattttttgatttttttcttttggcaaggcatcgaaggaatgaatccgtatcttacttagttttaaataccctcatgcaaaggggagggcctaacttaaattttgtttgttcttttgattctaatccatgacaggcctttcatagtaggggtataggacttactttctgcctgtcttgttaaataaggcagaaaaatcagtctatttaaggtgcttgtcaagtatatgccttgaggcatattgaaggtttcaagagtgtgtgcagctgccttgtaggagagtctcctccaacttgttctgtattcacaaaatcaattcaaatttaataaaaagattaatagttttttgtaatcttcatttcagatttactagtttatctcaatcttggaccaacagactccatttaaagggaacaaaactgtaatttaagtcaattccctgggcaacatagaatgttcacagtgtgttacacaatcgctggggatggtgcctgctgcctgattatgctggagtcccacacactgcagcgtatccctcactggattgctgcctacttgcttcaagctatgagatgcatgtctgaaggctctgggtaccctgaaaatgagcataagggaatttgtgtttactttgatgccctggatccattcttttttgcatacctgagtcaccctggaaagtagacctcagacccctcttttatagtcatttacccttatgatttagttgctaatggagaaccattttcactatgtgcataaaatgcttctagtgcaataaataagtttaccttgtcctccaattgaatcactgtattgcttttgtgacttcctccattgagggtgaaattgatttggaaatctcagcaagcgtaatggggtcatattgtcatattgtcatattgttatatggttctcctgaaagcagtatactgtggttgattacggactttttcttttggcaaagggttttataatcccgtcttgagcattgatgaagatgtgtggtgaatcacttgagcttatgataactcttttcctttcttgtttgacatgtgagaaaattagagggatttagaaagtctcctggggtcaaagagcaatcctgtgccaaaactagggttggggcacaaccccagtttctactcacactgtcttttaggcttctgtgtttgagccatgaattaaaaattttttttggttccatcaccctgtgtaattaatgataacctactttttataaatgcaaataatagtgaataccttgtgtagtgctaagagacattagtgaatataatctatttaattaatatactttacatacactcatttatttaatcctcataacaaccccataagtaagaccggtacctttctacagatgaggaaactgacatgtaagatgtttagtgtctggtccaagatcacgtagctagaagtggcagagctgggatttgaacccagtcaatctaacaccataaatcctcctcttaacagctactctaaactgcctttagaagtggactggccttgaaatattctttgacaaaaattacccgatttcttaacttcctcctctgcaaccccaaagtatgtcattgtgagctgcattgacacagaagaaaaagtctacagacaagaggggcatgctaaccgcctacttaacaatcttgagtatagtatttatcactatctgataaatacacagctactgttttctcctcgccagattttggagcactcaaagggaccaaatcttgccctgcactcctggcccagcacctggcataatgttggtccttctttaaatactggttgaaaaggaattggtgttcttttctgatatgattttgactgctcccagttctagcagtgtttttgctgacattttaaattgaatggccgctgatctttttacactgatgacttaacgctgccctgtaatcttgctccaaactacctgagcctgttactcttgaaaagctttcctgtaggctgggcatggtggctcatgcctgcaatcccagaactttgagaggccaaggcgggaggatggcttgagcctaggagtttgagacctgcctgggcaacaaagtgagatcctgtctctacaaaaaatgaaattagccaagcatggtggtggtcacatgtagtccctgctacacaggaggctgaggcaggagggttgcttgagcccagtaggttgaggccgcagtgagccatgtttgcaccactgcactccagcctgggcaacagagcaagactcaacaacaacaacaacaacaacccctaaaactgtcttgtagttgactcgtcttctccctggaaagtggatcttattggtctcattctctgagagtgtcttctccttgactcctaatgtttgatcttttttctctctttcatgcctatagttttgagattccttggctgcattcagtacatgagcatgaaaaacaaataattgttaagtaccttcctcctttgtgcttggctttctgatagggtcatgcatgcttttgttcttgaccgttggagcacactgtgacatgggtactgttatgtccccattttacagttgggcaccctgaacccacagagggttagcaatcaaggtgtatctgggatttgaacctatgtctggaggaccacacagtgtctgccacttaagtgaattcacagagttgggctgctcagaaaacacttgaggcttctgatgtcctaggttccacatttcaaaggcatgttgcttcgtgggaataaagctaacgcaggggtaacttggaggctaggtctccattcgatattgaatgatgacgttttagattagctccggcaacaacatttctccccaaagttgctgcacagactcctcacctgtttctgtaattccacctttgcctcctttgtgtctgagtgtggacacctcctccaatccaccgtttactgcggctaggggaatcagcacaggtctgaagatgtcattcagctgcttggaacctcatagtggttccccagttgtgctcaggataaaagacacactctcagggttcccagcagtctgcatgagtcaccactgcttacctctcagccttatctgcagtaactcctccaggttctctgctccatccagatggattgacttccttctggcagtcagaatacttgctctgtactctgggactttgcatgtcctgtttcttctgcctgaaatgatctccctatctctgttgttccttcctggaccccccagtctttctaatgcccactcaaccttcaaatctcaggcatctcctctggggcacctttactgaacctttgtgtgcaggcaagcagctgctccttttgcacagactctgaagccagaccctgtgggtttggctctcagccctgcttttgactggtcatgtcatctcagatgtattacttaacctggcaatgcctccactttctcatctggaaaatggggaaattattatatatacctcacagggttttcatgaggattaaatgagttaatctgtgtaaagcacttacgggactacctggtccatattaaatgccataacactgctaatttttggttttgacttttaacttgatggttttgacttagcccttcccccctattgcattaactgtgaggacagaaaccatgcctgtctccctaaggctttgcacaggttctggactatattaggaactaaaatgtttgtggaatgaatgaagagagacctctaaggcattgcttctgagatctgactgcgtataggaaccacctggaatcttgttaaagtgtagattctaattaggtagtctgaaatgagacctgagattctacatttcttttttatttattttatttttattttttgagatagggtcttgctctgtagctcaggctggagagcagtgatgcactcaaggcccaccgcagccttgacttcccaggcttaagtgatcttcccccctcagcctcctaatcctgagtagctgggattacaggcgtgtgtcaccacacccagctaatttttgtattttttgtagagacggggtttcgccacgttgcccaggctggtcttaaactcctgggctcaactgatcctcccactttgtcctccaaaagtatcgggattacaggcatgagccacggcaccctgccgagattctacatttctaacaagttgtcatgctcctgcaaggctctcgggagccactgactgttatcttcccttattttatggctgtcctatagaagacagatgttctgagcccagagcaatagagaatgagggctagtggatcaaagtgcccagaggtagaatatgaggcttaaaagaacttaattctgactattagtgctgagcagttactcaaagaagaggcctgcttcaaattactgagtttcccccgattcaaagagggctgaccatctgtcggggattttgcagagggaatttctgctctgggacagaggttagatggatgattccatttgactgtgtgtgttttcccaccgaaggacccagctgttctttctgtttttgcttcctgtggaagccctatggttgggagcgttgggtcaataaacagctggggagagcacagatgcactgtagacaagaaactctctggaaactgaatgggttcaatccaattggtaagagaacattagtggaaagatggcattattgaatgtttgaaaaaatgaacaaatagaaaaaaacaatagctttctaagtcaaggcttgccgaatccggtcataatgagtgggtaagatgtcctggggagacactacagcgtggtggttaggagcacaggctctggagtcagtcatgggttcaagtccctgccctgctcttactagttatatgaccacaggcaagtcatttaacctgtctatgccttagtttccccacctggctgccatggtgaataacactgtggagctgataggcttgtgtgaggatgatttggtgcatgtgtaacacagtaaatacctgcaatacagcctcagcactcagtgaagagtggctattgtgactgaatttgcaattagcagctttcgggacatctcttaggaagctcaaacatggcctttgccatcttgtaaaacatcgatatgtccgttttaaaaactcagccagtggagtatacaaaggaatccatagccaggcagactttagccttcctgaattttttagattttattgagtgggcctggtaaccagctatgacagagcttggggctattagaaaagaagccatcagggcttttctctcctcgcacgagccttgatcagagcctcagttactgacgggtcgtttgctcgagatggtaatcctgccttctgtatagaattacaagcctagccagagaggaagttgtgtttatcttaccccaaacagcaggcattccagtgactcttgacagacaggaggaagttattgccaatctgctctttcccaaaagctgcccttccctgcccccaacgtgctccttgcatgtttagagaggtttctgccagccagcctgccaagtggcattctctcccgggctttgaggacagttgcatttgcagaaggaatgtccagaggctacttctttttctcttttaatagatttaggggatacaagtgcagttttgttacttggatgtattgtgtagtggtgaactttggtcttttagtgtacccatggccccggtagtgaacattgtacccaatgggtaatttttcaacccgtaccacccccacaccttttggaacctccagtgtttattattcccctctattatgtccatgtgtacccattgtttagctcccccggtggcggctacttctatattattggccaaggtggaggcatctctccccaaggtgagtggtcagcctggctcttacaggaggcaaaaattgtgcttattctcattggcactgatttggtagagataagtggagaggggctataggtgtgaagaaaagaatacatcttttcaaagaacccacgtgttttcctttccaaaacaatagctggaggtcagtgtagaaaaactccaacttgagcagttgcaataattgagaaaataagttgggcaattattcctctaactgagatttaaaagttcctttcttcgtctggtatttttccgggtacatttgagttccaatttgggtgcttctgaaatgtctggatgttttgtgctgctaaaattatatgtgtctaaaaatgttatcagtgatgacacttatatataagctcgcttggacttatgctagcaaatttctgtgactaaggtcctctcctccccctataaccattcccagaatcgtggcatttgaggtaaaggtaggaaatagaataacccaacttaggtttagcaatcaagtgaaggactatcacttgagaactttgcttcggtcttgtcgacaaagaatacggggttttgttaccatagtttcagtgaaaaatttgaccttagctacaataacatacagttagaaagaaccagctaatcggttttctaaaattagtgttctctagtacataaaccagtaggaacagagtatttaattaaatattatacaaggatataaaagcccaggggaatgcagtcccttgatctgggcggggggagggaggaaacccacagtgctcctttactggtctcttgcaagctacaagaactttacttcttttaaaaatgttagtattggttttattttcagatctgtcaggaatgaatttatacagcttgctgagagagcaaaataaaacattcagcattatttccagttgtcccctacagggtacaaactaacaaggcaagatgtgaaaatgatgttgggctaggattctgataaggacacttgttggtgatctgctagatgactttatgtgaaggaaaattattttcttttttttttttttaatttttttttttttttttttgagacggagtcttgctctgttgcccaggctggagtgcagtggcgcaatctcggctcactccaagctccgcctcctgggttcacaccattctcctgcctcagcctcccgagtagctgggactacaggtgcctgccaccacgcccggctaatttttttttgtatatttagtagagacggggtttcactgtgttagccaggatggtctcaatctcctgaccttgtgatccacccgcctcggcctcccaaagtgctgggattagaggtgtgagtcacctcgcccagccaggaaagttattttctctccaaaatctgggcattttaaagcaactaatttctagactcttgttcctttgaatgcctaatgtgtgattaagtggggccaacatctcctagttctgagtacagctatatctgcctcccccaactccacaggccataagcaataatctgtatgaagattatgtaaaatttgacatctcttttcatctacttatcaagagccccagcagtagctcatgtttctgatagtggctggaaatgtcatcaatattgtgtgaacttagaaagctgtggtaccatttctggaatgaagtggcttccagattttgtaatttcaggacaaagaggtttctggtccttcattgacactcttctctgattttattatcacctgccctggaggctgcagaggtgcaactggagttcagtcgtttgccaggtttatcactgattggaaacattgctctgggttttcttgaacttctattgttgtatctctttgtcaattacatattgatacattttcttaatttcagttttatgatttcagctttttaattggactttaagataactatctaatagaattggaagggtgaggtatatttaagggaatacaaatgtttttgtttgacgtttttaccattttgcatgtttctgtagtggcatctcaactattgcaatggaaaatatgtccttggcaagactcttagaaacacagcctcaaaggtcattggattgtgcaagcttcttgactatttacaaggtcacctacctgaatgaatagaaatgctccctgcccttaaggaatttgcaattttatgaagagagatgagtgagaactactttgtggattattcttggagaatgttgaatcccagacgagcttttagtcccctgatgttcattgtttttatctatgccatcagatcactgtgcccaaataatttgaattcatgttaataatagcttacgaaaaatgcagtaagagagcttgctggaaaagtgacagcatgcattttaaattacttctagttgacctggctttcattacccaaatatccacaggcccttccatgaatatggataattgagttgatatttagcaaataccattgaagaggttagatgtgtcaggttggttgttggaatggtgaactagactcttgattttggatgatagcttaaactaacctaaacaaaagggggattttttggggtcaaacaatcccagacgaacagctgaattgcatgaaggacaggagtgcagcaggggctcaggaaaacacagattcaggcatttgagtactgtcagcagcctacgtccatatcttgtgtcttctttctgtgcatctttcaccttggtttcttgtcctgtcctcttcgggttttgatatcaaggttataccacactgaaaatgagttgtggagtgtttcctttttttattctctaggggagtttgtgtaatattggaattatctgttccttgacagtttggtagaacacgtgagtaaagtcatcccagccatctgttttctttatgtcaaaattaactactgattcacattccttatgtctttaaagggctatttcttcctgggtaaatattgtaagctctgttcttctagaaatttacccatgtcatctaagttttcaaatctatagtctccttgtattattttgttcctagattgactggttttgtccttgtggtaggctgaagaatggcccctgaatgtcttcatcctagtatatgttacctgtgaatatgttacctcatatggtatagggatttcacagatgtgattaattaaggctcttgagatggggagagtatcctggatttccaggtgtgcctgatcacaagggtccttgtaggctagaagcaggaggattcgagttaataggagatgggaggatagaaacaataggttggagtgatgtagccatgagccaaggaatgcaggaagctgcaaaagtcaagaaaattgattctctcttgaagtctccagaggaatgcagccctgccgataccttgattttagacttcttacctccatgactttgagagagtagatttgtgttgctttaagccactacgtttttgattatttgttatagcattggtaagaatacagtagtaattgtcctaatattgtttatttgtgcgttcttttttttcttgaataagcactgacccatgttttttctgtcttattactctttaaagaaacaaattttggctttattaattctttctacgataggttggttttgaagttcattaatgtttgcctttgtttttattttcttcattctctttctttagatttattttgttcttcctttattcttttaaattagataatcaatttacaaatctgacttctcaaattgtaatgttaagcatcttaatctataaattcccttaaaatattgccttaaacttaaacaaatttacaagaaaaaaaccaaacaaccctattaaaaagcaagcaaaggacatgaacagacacttctcaaaagaagacatttatgtggccaagaaacatatgaaaaaagctcgacatcactgatcattagagaaatgcaaatcaaaaccacagtgagataccatctcacgccagtcagaatggtaattattaaaaagtcaggaacaacagatgctggtgaggttgtagagaaataggaatgtttttacactgttggtgggaatgtaaattagttcaatcatcatggaagacagtgtggcgattcctcaaagacctagaatcagaaataccattcgacccagcaatcccattcctgggtttaaacccaagggaatataaatcattctgttctaaagatacatgcacatgtatgttcattgcagcactattcacaatagcaaaggcgtggaatcaacccagatgcccatcagtgatagactggataaagaaaatttggtatatatacaccatggaatactatgcagctataaaaaggaacaagatcatgtcctttgcagggacatggatggagcaaactaattcaagaacagaaaaccaaacattgcatgttctcacttataagtgggagctgaacaatgagaatgcgtggacacagagaggggagcaacacacactggggccttttaggggatgggtgaggggaggaagagcatcagaataaacagctaatgcatgcggggcttaatacctaggtgataggttgataggagtagcaaaccaccatgacacatatttacctatgtaacaaacacatgcacatcctgcacatgtattccagaacttaagattttaaaaaatttatatgtatgcatatgaaataattataaacattgacttcaaaaaattgccttagtttcttcctacacattttgacatgcagtatttttcttattgagttctaattattttcttatgtctgttattttttatacctacgagttatttagaagtatttttatagttctgattttaagggatgtttctagttctcttttttgaaaaaatgttttacaacttagttgtgtgttggtcagataatatctttgttttatcagtcctttacaacttgagaggcttgctttgtggcctagcaagttatcaaattttatgcatgttctactgtgcttgaaagaatatatatatatttccaatcttaggtgcaatgtgctatatatgagtttgttggtttttttatctccttgatctatccagtgttgagagacatttgttaaaattttctattaatattttgggcttatggaattgttcctgattatggtggtggttgcatgaatttgtgtatatgttaaaactcatagaactgtatacggtgctatggcttgaatgtcccctcccaaaactgaggttggaacttggtcttcaatgtggcagtgttgagaagtggggcctttaagaggtgattcattcatggactaatggatttaatgggttaatggattaatgagttatcatggaaagagaactgatggctttataagaagaggaagagggacccaagttagtacattagcatgctcagccccatcgccatgggataccctgtgctgccgagggactctttagagagtccttaccagcaagagggctgtcaccagatgtggcctctgacttggatcttcttaccttctataacttaagaaataaatttcttttccttacaaattacccagtttcaggtattctgttataagcaatggaaagcagactaagatgcaaaaaaaaaaaaaaaaggaaaattacttacagtgaattttactataagtaaattagttaaaagggttaaaaaaattctcactgtgacagtaggtgtgcaattttgccttgtagtttttaagttttttaaaaaggttttttcttttgccttaccctcagttttttctttatgtataatgaggttatattagtaaatgcttagatttatacaattattataactttctggtgaactaaatatttatcattatgtaggaaacatttttctttctaatggtgttttacgtcttatagtctgttttgtctgatattaatatacctacaccagaattgttttagttagtatttgtttaaatatacattttatttacttttaaattctctgtcattatattttagagctgtctctcataaactgtacataactagagaactactctctctgaccatctttgtctattatctattaattggaatgtttagtccatttacatttgttgtaatgtatttatatttatgattttaatttgtggggttttttaaatctttttttcccccttctttaagtttcatcgaaggcttttgtgtgtgtgtgtatgtgtgtgtgcacgtgtgtgtgtttgagacagggtctcactctgtcacacaggctggagtacagtggcttgatctcggcttgctgtaatctctgcctcctgggttcaagtggttctccccctgagtagctgggattacaggcatgccaccatgcctggctaatttttgtatttttagtagagacagggtttcaacatattgcccagtctggtcttgaactcctgggctcaaactatccacctgcctcaggctcccaaagtactgggattacagatgtgagacaccacgcctagctgtgcttcattgaaggtttttttcattgttgttctccattctgttatttccccctctactgatttggaggatatactttatatgtgtttttttttaatagaagttacctcagatattttaacgtgcatatttaattaaccctaaagtttataactatcattattctctcctacaatactaggacattatagaatatttaaactcctgtcatcctctctcagtctatgctcctgttcatgatgttagtgctttgttttatattaaaacttgcatattagatatgattttgttttatattgtcattaaaaaaattaacttacgtattagtatttactatacctatcttggataattttttttctgcctcaagcacattcttagaatttggagaatctgttagtggtaaattctattttgtttgaaaatattcacttttaattctctgaaaattttacttttatttttagatgacagttttgcttggtttagaattgtagattgatgggtactttctgtcagcatcattatttttttgcctttcattgttgttaaaagcaaccttgctcagtatttttttttcccctctggttactttagaggaatctctgtctttgattttctgtaattttactagtatgaatataggtgtcagtttctttttatttatcctgcatgatatttgttaagttcctagatttgaggttgttttttgttagcaattatggagaattccgagctgttatctattcaaataccacttttttttttttgagatggagtctcactctgttgccaggctggagtgcagtggcgtgatctcggctcactgcaacctccgcctcccaggttcaagccgttctcctgcctcagcctcccgagtagctgggactaccagcacgtgccaccatgcccagctaatttttgtatttttagtagaaatgggatttcaccatgttggccaggatagtctcaatctcttgacctgatgatacacccaccttggcctcccaaagcgcaaggattataggcatgagccactgcgcccagccgctttaggctattttttaatctcgccatctttttcatctttgctccataggctggactctaggtaatttcttctcatctttgtttactatttctgttctattataatctgctctgtattcattgagagtttaatttgaattatatttttccatttctaaatgttctatttgggacttctgaaacgtttggtcattctcattcctccatattttcaagcttctactttacttcctgttaccaaaaaagcacactttaaatatattctatctctaaaaattacagtaggtgctatctctacagatcttattctattttctacattggctgtttctgaaaatggtatcttatttccctgtgtgttttgtgattttgactatcagcttgtgtttttttggcatttcatctgtgggaattgtttgaggcctgggttaaagttatgtttctccccagaaaattgtttccttttgccagttgccagagatgctgccaactcaagactatttaaatcaaattctttgcctgaaaattttaaaattttgttttaggtattttttgcttaaattttgggaatttcctatatatgttaattagggtgacaaacgagtatgagggtaacttatttatcttgactttggctctaggtataagagagaaaactctcctcgtagttcacaaacaagttaccttgccttcctatttttagggttggttggtttgttgttcaccattgcattgaagctgtagcttcttgtgtgtggcggtggggggtgggtctgagctttatgcaatggtctcttagaaaacttttgatcttgagtaggtgcagagctttatcccctctacctggcactagtatcataatggaaggttattaggttctccagatattctcagagttctcgctttagaaaggacataccttccaggggtcttgtttccacttcattgcgggcttctctggattcccttctatataactgcttcagaacatttcaaaatgttttctaatatttcatccagctttttctgtgtattaattgatactgtaagaaatgcatacttgcttcctgctcctttttttgtctcactgtcattttctgtgtgattgaaaacattgctacccatagctcttaaaatgtataattttacagttataatcattggagaaagactgatccgtgtttgaatatttaaacaagtgcctgggtgtggtggctcacacctatagtttcagctactcgacaggcttaggtgggaggattgcttgaccccaaggctgcagtgagctgtgattgtgtcactgcactgcagcctgggcgacagagcaagagcctgtctcaaaaaaaaaaaagagaaaaaaaagaaaaaagcaattctagataaggaactttgtggttgagtttgggtcagatttcctcctctgggtcaatctgcttaggctggggacttggattacctgtgttaacatggaagctcccaagaaaaccatttaggctagactcagttccaaaaacaaatcaaaacaaaacaaaacaaaaacaaaaacaaaacaggtaataaatatacagtccaggtatccactgtgatggtaatcaagggataaagaatgatatttgttcaagtgatcctcttgcctcagcctcctgagtagctggggctataggcacgtgccaccacgcctggctaatttttgtatttttagtagagatggggtttcaccctgttggccaggctggtcttgaactcctgatctcaagtgatctgcccacctcggcctcccaaagtgctgggattacaggtgtgagccaccatgcctggccgtatttaagtctgttaggaatgattttgactgcaagtaagagagaaaatccacctaatagtggcttaaaacataagggcatttgttgtttccttagaaatccagagataggcaatatcttatatagtgaaagtctcaaaatcgtgtctttttgctccacatccttagtgtatgggtgcccccatccccaccatgttcttgtcacttcatggttacaaaatagctgcagtggttccaggcatcctgtttgctttcatgataaggaataagggacaacacagtgagctctcctttcattcctgttcctttttttttaagacaacaaaaacttatcttcatgctcctagcagtctacttttatttcattagtcaaaattgggtttaatgcttattcctagctgcagagagtttgactggaagtgaggttttgtcttttcagcctttatgttaagaagcagccaggtcaccatgtgttggaaattgtttgggagacaacaagctttctatactgtggtttattggttgcacattgaggaatccaagtgattctccttccatctagtttttagtgtcttggtgattgaagaataccagcttttgtcgacagtacaggtaatgtaactatccacaggagcaagtagctcttactctagccatctcaaatggatgcaagcaaccatacgtattcacctgatgccagtattcaccataaatagtatgagtgttagtgacagcagaggctttaatgagtaataggcacttcatttgttttattggcttgcatctgagaagtacctaagctaatagtttctgctttttgttagtgatgccttagtttggctagctaagtggggctaggtaaagaaaaaagcattttatacacatgaccaagtttgggagggatcctctcagtcgttttggactgacattgctaacttcgtaaagggaaatgcatagtctgagattttctctttatctgtcatcccttttaagtgatggcgttggcagagggtcattctcttagcttgcccatagctttgctttcattgcaacaacaactttttattttttagacagggtcttactctgttgcccagactggagtgcgtgtggtggtgcactcacagcctacagccttgacctcttaggcttaagcaatccttccacttcagcccccaagtagctgggactataggtgtgtgccaccatgcctggctaattttgtttatttttttgtatagatggagtctccctatgttgcccaagctggtctcgaactcctgggctctagcaatccttccgcctcagcctcccaaagtgctgggattacaggtgtgagccactgtgctcagcctggagcttctcatgaatcaaaagctccctggtagaatcaagaacaatttggttaataattttcaccctcgaacagatgagagaaaaacccaaaatgaatcagttgatctgtttaaactttaatatttattttccttttcatcctaaaggaggaagtagtttttcccagaaagcagtgtggaaactttcctgttcttatttctatacttgtatatggaggctgcttatggtatattaaagaatttggactgggtacagtggctcctgcctgtaattccagcactttgggaggccaagatgtgaggatcacttgagcccaggagtttgagaccagtctgggcaacaaggtgagactccgtctctacagaaaatagaataatttgttgggcttggtggcacatgcctgtggtcccagctactgaggaggctgaggtgtaaggatctctggaccctaggagactgaagctgaagtgagccgtgactgtgccactgcactgcagcctgggcaacagaacgggacccggtctcaaaaaaaaaaaaaaaaaaaggctttggaagcatctttttttgtgttcatatcacggctagtatgcaaactttttttttttttttttttttttaaagacagagtcttgctctgtcacccaggctagagtgcagtggcgtgatccaggcttactgtagcctcagcctcctgggctcaagtgattctcccgcctcagcctcctgagtagtcaggactataggctaggacccccatgcttggctaatttttaattttttgtagagacgggatctcactatgttaccaagggtggttttgaactcctgagctcaagcgatcctcctgcctcagcctcccaaagtgctgggattacaggcgtgacatgtgatcttgagcgaaatatttaatttttctatgtcttaatttgctcttgagtaaaacggtcacaacaagaacaactttagaggttcgggggattaaaggagatatgcaatgctcttgagacaacgtcaggtacattttaagcgtgcagtcagtgtacatgattatcatgataatgatgtaaatttttccccctcttcttgagttcttcttgagttggaagaaggaattcttttctttgagaggatagagttggggagcagaaagtgtcttctccaggcaccacggcaggaccttaggattgctggtgcattagagggtgtgagcactcgaacctgtcatctgcttctatgtcattttttcctcatcacaactttgtgaagttggtggattatacccattttccagccaaaagaggatgacctctgaggttatgaaacttgcccaaactaagaattctagccagaggtagagccaagacttggagctaagagttcctgaatctttcctcctttccaggagttcttgcctcagacagagctcgtgcaccgttcactctagctggtgttcctctgaccagtcagtagcaaatgcatgctctgccttcagccacagaagtccgcaagcagtagtgtcctttgtgttgtttcctcttaaaacgtcatctacttaaacaggttgtgaatctgtcttaaggatagacaaataatttaatggcagaggtgtagggtgatgattcaaattcagtgacataaaccaagcgctgggccaactctgacctttttttttttttttttttaatccctttgaatcatcttgtgctgcattctgatgaaatcttgacataccaccctgaaggaagtgctgtgtgaagaagtgtgggctcataagataggaccaggggaagagaggggccactgaaggctaactttgagtgtttggaaaacaacactggtttaggagctggaggacttgagtcccagtctttggtttgtccctgactagcagtgtgacctccaataacgctcttgacctgtctgggcctttgctgcttcatctgtggcatgaacacgttggactagaaagtgaaacacagcaaaacttttattgagtgtctactccattcaaggcctgtgctaggcatgatttatagtacggttgtagttacagtctcttcactgtctcagattccctcacgtccctgataaactttaatttctcttttaggaaagattcggcctgacattttatttttattcttacatcttagttttaagaagcacatagatttatcacttacatttactcatatgaataaataacatatgtatttattaaagccacttagcaaaggaattaaaactttcttctaaacttaccattcatggaaagctgtaatataagcaatgaaaagaccgttcttcacatgtgtcttgtgttactgctcctgggcctcctacttccatttccctctagatgacatggatttgtcccccttaattgtatccaggcctctatggcttcaaaggactttagcacatagggcggtagggtggcacggtgacaatatgaaagactctgtaatgtaacttgggttcaagtactggctttaccatttattacacgctaatacctttggaacttagttacttaaactgtagcataatatccacatcaagaaaggtgatctgttaggagtctcgtaggcacataaaaaggttgattcccaacccccttcatatgcagttacactgggaatttaagtatttacccagtccgaggagttcaacctcaaatacatcaaaaccacccttgcccttccctcctcaggacttagtgggtgataggtggaatatcaaacaggacaccagcctgtttctttgtgcggaggcctttgagtatcattcagattatttttttttcactctgttaaattcaagttacttctgcatccacttacgaagcatagctacaggattggctcagtctaagtaccggcctgtgagtaagccattctacttcttatttctcatgttgaatttaataatcagaccctctcttatttgtcagcactttgtcagagctatgtagggtgagggagtctttccccagctcagcccaggtttgtttttagtactggataaagttaataagactttatctgactgtaagtggaaagacacagccaagattaaattgcaattgagttaaaaccggtggaattggatttggttaattgattgtgtactatgtctcagtcagcattcatcttcagtttttcacctttgtactgcattcaaacatcaagtttgggttggttatacatttggatttccttttccacaatattttctagcaacatcattcaagaactcgtaaagtgaaaaggggtgtgcgtgtgtgtgaaactaggacattcttgtctttttagtaaatactcattcctttatttcttattgctctaatggcatgtgactttaatttggtctatttagcaactgtttaatttctgtcatgcagaaaacaaatttcagcaccttttcccgaagcccgtatgcctccttatgaaatgtacaggtagtgatgaatgaactctttgtcctgtttattggagttgtgccagtgacccttttcattggtcacttcagttcgttcaaggtgacatgaaaggcattttatttggggggatgtctcagtcaagtcaggagtttcatttgggggctaaatttgagggctagtaactaaattgaaaagccactagccctccaattttaatctgaaataactaatgaccttttaatctaaagtaacttcttagaaacccacattctctgtaagtcagagaaacaagtttccagtaagtgtttgcattagacacttgttccaattctcacctagtctgggaaccccattaagaagatctgggttattctcccttctcagtaaaaactgacttcttgaaatggaaggccgatgtgtgttcccatgttaccaaggagtcacttttcgggagggggggacttgtttttcttcttggtcacagagtgcaaacaacaccaggccactcttggttgtcaagttagcaggaaagaacttaagccctctccatttgttaatttttatgaattattagttaacatgaaaattgtagtgtgtaaatgtttacaaagaaacttctaaataccaatttgccttataatacatagtttaaataaatatgatgcttttctttttaaaaatagacaaatgcactgacaggggtatttagtaatcattgtttgcattttgtcacagaatgtttaaaattgacattgcacataatttagagacttaaccagggcggtttaagcagaggggcctgaagttatttttctgtggcaaaaaataaaaagtaggaaagaacttctaagcttctaaaatcctgacagcctcattgtaaatgaagcattaaagtgctttgttcatttctcacaaacatcagcccttgaatttggagggcccctccctccctccctctcttcctttttcccttcctcccttccttcctcccttcctcctttccccttttctttcttttctcttttttttgaaacctggaacattttggtatctctgaccagatgaattttttcccaagtgccttaggtgctgtcttccatctgaaaagtggggctgccgtcctcttctggggaatggaaccaaagtcttgggttcttcatcttgggttttcatcagtagcctctggcccttttttcctcctagacctataacttggagtgctgagaagtaagaaattgtcagaattaactgtctctttctcttgggccatttctctgcatattctcccatggaggtgattctgactcaggaaatgcccccacatagtcggaacctttcgagggcagaaaagggaggaaagaaaaggacgtggatatgtctactaactgaaaagccaagggtggtttgttcttccctgccgccaaaaaacaaaacaagattttcttcttgagacaacccttcaatgcctctgttttctttagaggactgttttggctaatgaaatcaatgtctgcaggatttcctgtgctttcagtctctttctctatagttttaacattcccctgtcattattagcaagttgtctgctaacagcttggcgcatgccagaaagctattctcggtggggttaatttctggctattaaaagttctctgagaccccagatctctctgagcagggccatgttggggatttccagcacatgtgctgtttagactcaagggccacagcaagcttccccatctcacagcagaaacactgtaggcacaggtgacagcaaatgggcattgaccagtccgctgccagagcgcttggtgaccgtccaacccacagacgcgctgccatctacctaacggggtcgtgacagtgattttattgcgtgcttcatgaaaatcatgtagtgcctggtccataataaatgattgcagactattgttatcctcatgcctgggacataataaatatccctaaactgttacatgaaaaatagaaattccctgagagcataattaggccagttatctccaagttagatttcgttcatgggacaaatggcagacttttccagcatgggctgaaagaagtaaaaaaaagaagaaacactgagaggtaggaggactgcttgaaactaggggtttgaaaccagcctgggcaacatagtgagatcctgtctctacaaaaaattaaaaagttagcgaggcatagtggtacacacatgtagtcccagctactagggaggctaaggcaggaggctcattcaagcccaagcccaggaagtagaggctgcagtgagctatgatcatgctactgtactccagcttgggtgacagaggcagaccctgtctttaaaaaaaaaaaaagaaagaaaagaaacactaacttgttgaagattgagatgactccactaggaacaaaaatggttggtgaagaggaagaggactgagaatagaatagtgctgcctgcctttgtgtttacatctcacatagagctatcttcccctccccacagagcagatgtagctgaagtgctcatgtgtatgtatttgaggggacagcaacttggaagagaagataccagctgcggcatctcatagtggaggtttggaggccaaggcagggcttcagggaagtgccttttctgcaacatgtgttttgttgctcttattcttgtcttggtctgcttgtaacaacaacaaaaaagaccatctggagtctagaaggcaaaaataatgggaatgaagagatggtgttagaatcatagcagtatcaccgtatttatgggatgagttattctactggccctcacttttggtgctgagattgagatgtgaaatcatgaagcgattcagaaatgtgtccttatgaaaatactgtcttctgatagcttcagcatacagggttttttatgagaacagatctttctaatctctcagcgttgccaagaagtgtccatgcttcttatctagagagattattccatgttttaattataaagggttgagtagctgtttcagggctgacgttggttcttgctcatgaatcaaggtcacaacagagctcacccctggccttggccagggacttaatgttcattcagcaaacatctgccaaaccctcactatatttacagcatgtgttaattgtagtgggctagatacagataatactccatgtatatagtacttttaacagtttctaaaggcttattctcttattcacatgaagaatctgaaatcagagaagtcggcttaagttatatagctggtaagtcaacaagcaatagctgcaaccagtcgtatcttattttttgactacatctctgctgtctgaggcaaggtccctactctcaaatgagttaacttttaatagaaaagataatttgattgactctaacgaacatttattacatatgctctggaggttccatgtgaaacaggcttgtctttaatctaggtctcaggatagcagaagtaatcccatttgtatttttatctgttttgtttaggatgcttatcacagttctaatgcagaaattatttggataattctgattgtggaaaaaaacaaactcaaagtgctttttctagtctctcactcaacagcagtcaacacagatttctgtgacaaacggggtgggggaaattctccccatcaccaagcaagcaatcaattctgcagcagacaacagctgggtatcttctattttaatgtttaactggtgatagtattagatcccacagattggaggctcagcccccaagaatgccccacctcccacctgacacaccagtctgggcctctggaacgtctgactgactggctttaagtttggattcctatgaccacctctttgggttggattaatttgctagagtggctcacacaactcagggaagcatgtttacccatttattataaaggatattacaaaggatacagataaccagaggaggagatacacagggtgaggtctggaagggtcttgagtgtaggagcttctgttcctatggagttggggcccactatcctcccagtgggtggatgagttcttgttcaccatcttgtctgcctccacatgttcagttatctgaagctggtccttttgggtttttatggaagcttcattatgtaagcatgattgattaaatcattggccattggtgatcaacttaaccttcagcctctcttccctctcctctttctgggctgaaagctggaccctctaatcctgccttgtttttttctggtgaccagctccatctagaagctgcctgggggctgccagctaccagtcaactcattagcatgcaaaagacatcactttggcatttctgaggattttaggggttgtatgccaggaaacagggtcaaagaccaaatatatatttcacaatgtgacagtaatgatttattttatgcctaactccgctgctagattgtgggtagggactttctcgttgaccccagcatccccaacacaaagtgaaacatctgtcagaaaacagatgtgtctttcatcacaaaagcatgttgaatgagtgcactataaagaatagatgaggtgctgttttaaagtgccatgggaccacagatgaagtttattgtggtgggaggtgatgtcatgagtagaaaaacttacggagaaggcatattaagccgggcaacaaaggatgggcgggcattaaacatgaatggagtgagggttgggatagaggggtgggacatttttctacagtgaattacaggaccaaagacacagatgggcagactccagctatgatttttttgacagatagacagggtgtgtgaggttgaggcttaagtggtttattggtaccagattttgaagtctttgattgactaagacatttgaagtttgttcttgctattgttattattattttgttttgagggagggtcttgctgtgtcacccaggctggagtacagtggtacgatttcagctcaatgtaacctctacctcctgggcttaagcagtcctcccacctcagcctcctgagtagctgggactacaagcgcgtgccaccacgcctggataatttcttttttttttttttttttgagacagagtctccttcttgtcgcccaggctggagtgcaatggcatgatctcagctcactgcaacttctgcctcccaggttcaagtgattctcctccctcagtctcctgagtagctgagattacaggtgcccaccaccacgcctggctaatttttgtatttttagtagagaggggatttcaccatgttggccaggatggtctcgaactcctgacctcaggtgatccacctgccttggcctcccaaagtgctggggttacgggcgtgagccaccacgcccagcctggctaacattttttagttgtttagagacaggattttgccatgttgcccaggctggtcttgaaaactcctgggctgaagcagtccgccctccttggcatcccaaagtgctcggattacaggtgtgagccaccgcgcccagccttactactattattaattttaaaaagaacctttattggtatcttactacactaaatgtattatgttcattacttcatttagcagtgagggcaatcccatcttattggtgaggaaacaggttcagagagtttaagtatcttgcccaaggtaacagtcactgagtggcacagttagtgatgaattctgttctctttgataggaatagaggcccactgatacctgtgagcttagcagtgtatcattctttattttgtcagaaatgagtacagtgtttggcacatcataggtgctccaggttttagagaatacattttttgccgagtcgcagaaggaatcagtactttcctttaggaagattagtctggtaattacgtgtattggcctagttagtaaatgttttttgtgggcatgaatcaattgaatccttgtttttgatgctggctatgtgccaggcactggtgtaggtgctggggacctacggtggtgagctcactggtgggttgggctggagagaaaggggtcgtagggtggcaggcaggctggttgggaaggagtgacagtgtggctacaggttacatcaaccccctgagagagagcagatgggcagagactgaggactgaggtttcagttaacccggtggtaacctagaatcatgatgggggccagtgactcgaaatatctgtctcactggtcattgggtggaggatgacaacctgcccctgattttaaaacagcagtttcttgtcttcctgcttgtgggtggattaattgggttacatatgtttatgaatgatagtgtaaatacatttctgatgacaatctggggaaaaaagcaaaaatggcaataaaagaactgttgctcatatatcaatggataaggcaattatcttctctaggagcacacagcattcatgtgtggggaataggggtgaagaaagatttcgttactgagagcatgatctggggatggaactgtacccgcggaatgtgtttccatctgtcataggctgtgcttttgaaacaacacaccatgttccatagggcttctaataaaggatgaagtgttggagaattcagtgtttttatttgtagaaagcaccagaatcccataatcaaagtcagggtatttgggggattggaatcaattagaggcattactgaatccagtcatccctgcctctcctgctttaaggtgaggaaactaccttaggtgtttcctgagttaggtgacttagccaagattgtacaggtagttattacagagacaggactagaaacttggtcttcagaggcaagcgattgcttttggcagtttggtgtgtatctttccaggatgtttcctattcatttgaaggcatataggcgtatattaaaacatacatttttatgaattttcttaaacccgtaattattattctgcaatttggttttttcacctgactcctttcttaacccattttttgttaatgtcaatagcaaaataataaataaaccatggtatatccaggcaatggaatattactcagtgctaaaaataagtgggttatgaagccatgaaaagacatggaggaaacttactaatctacaatctagtttttttcagcatttgaggattattccatagtatggatgtgccagagtgtaatcagccattctctgagtgataaaaattcaaactatttattttttaccatcatgagcaatactacaatttacttaaaaaatttatacagctcttacttttgtgccccttgctattctaaatgctgtacaagtattaaccaatttaatccttgttactgcataaggaggcttgtctgtcttatagatgaagaaactgaggcaggaagaaattaaaccatctgcttaacatcatatggctcgaagtcaggatttgcacacaagcacttcagctccagggtctgtgctcgtagacactgcgtcgtgctgtgttttagcagtgagatccttcacctagctcttcattcacatgtgcaaatattaactatgtgatgggtagcatagaaatagaattatcaaagaaacattttttctaatttagttaaaaaactttattattattattgttaggtttgcaacaacattgataggaaggtacagaggtttctcatatgtcccttcccctactccacagcctctctcactagtaacatcccccatcagggtgcacagcctctctctctagtaacaccctctatcaggatggtacatttgttacaattgatgaacctacctagacccatcagtatcacccagagaccatcatttacgttaaggttcattctcgaagtcatacattttacagatttggacaaatgtataatgggatgtatctatagatcactgaagtatcgtacagaatagtttcactgccctaagaatctctgtgctcctcctatttattcttccctccccccaacccctggcaactactgattttttttttttaatctccctagttttgctttttccagaatgtgataatgttagaatcttccaccaggtagcctttcctgattggcttctttcactcagtatgtgcatttaaatttcctccatgtcttttcatggctctatagcccgtttcttttcagcgctgagtaatattacattgcctggatataccacgatttatatattcattcacttactgaaagatatgttggttgcttccaagttttggcaattatgaataaagctgctataaacatccctgtgcaggtttttgtgtggacttattttttcagcttctttgagtaaataccaaggatcatcagagaaactcttctgaggagaaatggtcaagcattcaggcacaagatggcttttgagtgctgataatattatcagtgactagcctttacttaacatggtgctgaatgtttcgtatgcagtctctcatttagtcctcacaacacctagtcagatggcaactctttacagaaaggacaatgtagtaagatttttacagcccgatatcaccaatttagtgattgacaattgatgacttgagcccagaatctcaactcttaatcaccgtgtgtattagtctgttctcacgctgctaataaagacatacccgagactgggtaatttataaaggaaagaggtttaattgaatcacagttccacatgactggggaggcttcacaatcatggctgaaggtgaagaaggaaataagacacatcttacatggtggcaggcaagagagagcaggtgcaggggaactctcctttataaaaccatcagatcttgtgagacttattaactatcatgagaacagcatgggaaagacccgcctccatgaatcaattacctcccgccaggtccctcccatgacaagtgggagttatgggagctacaattcaagatgagatttgggtggggacacagccaaaccatatcactgtgtcattcaccaccccccacttttttttgtttttgctatgttgaccaggttggccatgataattcccttttgactgtgttcagctgggcctgcttttgatgaaatattttggctaaagcttttgacagacctctgagtagtaatctgtggctttcaagcttcaaggattatatatttctttagcacttggcattgtttgtaaactaattgtttgaggtttctttttctttcacattatttttgcagattttatacttttttcctatatcaaagttatagtgtagggatatgactcacaagccagatgggggtaggggtgttcccaattattctaaatgtaaatgtaattagagtttcatgtggatgcatacctcctttctaaaaaaatatggttattttagcgctcactataaattcactggtattcataaatttatggtgaaaccctctagttataaagtgagttttattacatccacataagctgctttttaaaacctcctccttcactttcttttctctttcctacaagaacatcatttgtcccctcagaataagtttagtaaagtgtttggaccattctcaaaccggccaacttctcaattcagtttaaaaaattggaacgtatgcttaagaatagatgttctgagttagaatttcttccatcatttgacaggtttaacatatctaagatgtagggggagaatcttaattggacatacagctacccaatagaatgcctgatatgatgaagagtttgaagaaagttaaggacatactaatggcaaatagtgcaaggaaaaataaaagcaattagaaactccaggaaaaactaaaactgagctaaaattgaaatgtattcatattacattatttgagatgcatagaaaaatatttacatggttataatataaacacaatcaatttatagacaaattacaaagctcgtggttataaaacagtaatgctaatcaacctcaatgatatgaaagtaaaaatatagacaatagatggtaaggaatggaaagacgtggaaaagtgaagagggctctaatgatatcaaagttgggcagttaagagttattgtaggtgatgcaacaggaattaaagggactacttttttaaaaaatgaaaacatacataggcaaggaaatagcagtttaatctttttaaaaggaaaataatgactaggaaataaaagaactatgaatatgtcttctctggagaggcatttgggaaaaggagctcctggtgcaggtacgaatccagaaaaatagagtgatacagtgatcccccaagaacccactagccttaacagtattccacattttaccatttttgtttcatctgtcttttttcttttttttttgctggtatcttaaaaaattcaaataccatgccatttgaccccggatacttccaaacgcatctcaagaaaaaggacatctacttagataaccacaataccattatcatacctaacaaaactaacaattccttattaccatattgaattttgtttgattgaaaaaatactttttaattttattagtagtagtattatttagagatggggtcttgctatgttgcctaggctggtctcaaactcctgggtgcaaatgatcctcctgccttagcctcctgagtagttaactacagcatgtgcaactgtgcccacctgaaaaagttgtttttttttttaatagttaatacattcaagtcaggttccaaacaaagccccctcttgtgtatgggtgttatgtctctctagtctcttctgagtcttttaatcttgaatagtcctcttttcctttttatcatgccattgacttactgaataatatttgatgttaaaaatgtgtgcatgcattaatttgattaaaaattttcaagaagttttaattggcttttaaaattttaatggttaaaaagtatagacaactttatatattttaaaagtcttatgttctctgtaagggtatttttataaaaacttgtttttaatgactaaatttaaacatctcaaatgcaggaacctttacatatcagttattctgggcacaattctttgcatgccaagatgagtaaaaatgattattctccagtattttttagtctaatcagagagggcagtttgtggacatgcctgccaaagcattttgccacatggaagtaattacttttaaagctaatagttaatggattccttactaggagccagccattttattaagtgttttaaattatttttatccataccacacactgtgggagaatccatataatccacacaaggaacctgaagcccagggagattaggtaactttgtgtagggtcactcagctagtaaatgacagccagtataggaacaaggtctttctaatacccttaatcactaaactgtatagggcctcccaatttgacatgctagtctcccctcctaagaggcggcgttatgtactggttcagagcatgagttctagagccagactgcttggttttgactctggctctcccactaaatagctctgtgactttgggtgacttgcttaacctctctatgtctcagtttcctcatctgtaaaatggagaaaatagtcctggctcataagattaaatggtttcctatttgaaaagaccttggaacagtacttggcacgtccatgaattaaaaaatgcttaagtaactgcagcacagaaatactgcatttggcatatatatggattggtggatgcacagatggacaaacaaataaaaagtagggagcaaattgtaggctactttttcttatatttcaccaataaaaagtaaaggcacttcccccagttaatgtaataaggttctctctcaggtctcagaatgttgtgtagattttttaaacaaaattgtaataaaattttattgatggtatacacatacattagttattattttgtagagtttttaatgctcaatgttgatatcaacttcctgactactatttttaaagaaagaaggaaaaaccaaattgaatagtatctgttttttccttctttctttaaatcatgtgtttatggaataatccagaagcataagaggcgacttttgtgttaagcatgaggtgactttcatgttaagctttctctggaagaagagagaactggatttggactttttctttcaaggagaaagaaaaaaatgttagtcacattacagccttgaaagaatcttcttgaacagttctggaggaacagattaactttggtgcatgtagatacagtagttcagcctctgccacttaatctatccccaaggtctcatggagggaagaagtagaggtgacagcgacttattataacgtaactgagtggttagtgaatgttctagaactcctatcttggtttgattggctttttgttcatgttcttttaagcttttgaattttgctaaaagataggtgctttgaatccaggatcctagacaacttgggggccaatgaattgatttcaagatggccttttgctgctttgaggatgcaggctgatgacttaggtcctgtgttcattgattctgctggagatgtccatagaacgaggaggagaatcttcggtttaatgtctcctgatttatttttagcagctgacctggctagctgtgatttgctaattgtctgtatgtagtatatgtttgtaagtgctgagtcgtttcgaataaatagtctcatatgaagtgagatgatctacttggcctagtagctgattctttctggaattgataatgacgagagtgaaattctatcttaacaagtgcagcagctgccctaatggagaaggacgacgtggaatttcccattgtctacctgtactgtcctaaaaatatacgaccaattccagtgactgataatgatattgagaccgagtggttaataatggctcaagaaatcccagcttgatttgaccagctttccagcttttttctttggcaggtggggagtgggggattaaatctgttgacttttgcaaatacataattttatagaatatgtgtcctaagaacgaaactcactacatttctaggttcaaacttacttttttgggtccaatgctcaatataggacaaaaaagaagaggaaaggagaaaatatgaaagaatgtatattagttaactcagatttttggatctgggtggatttcggatggtgttaaattggcctggggacttctttattattttttttaatcgtagcattggtttgtaatattcatggtttagcctgaatgacttaaaggatttattttttaatttaacgtgggttaaaagaacatgagcaatagacctgccaataactattttaaaatataaacagataactgtttgttttgctcaaaggtcacattgaggattcagagctcatgactcaggatggctatttttcttagaggaatgatttagacaagttgaattgaatagctcctaggccactgacatttattcaattttgtctttaagatttgtttactttttgaacctgtaaaacaggggtgtccaatcttttggcttccctagaagaagaattagaagaagaattgtcttaggccacacagaaaatacactaacaacagcttatgagcttaaataaataaataaataaataaataaatgcaaaaaaaaaatctcataatgttttaagaaagtttacagatttgcgttgggctgcattcaaagccatcctgggccgtgggttggacaagcctgctgtaaaagactggaatttagatacagctcatcaaaatatcttgctattctaaaagtaattctcaatttctattttttctaagaaaaattattagacagtaatgttaagttgcagcaagtaggtttgcattttggatagtaatagtcccaattttattaaaaggttggcttatgataaccatagatttcttaattttaattttatttattttgtttgcacatactattttactgatagtatgtgcaaaaagatagtgagtgaagcagttggactaattgtttacactaagattacttaggaaggactatctggcatgtttatattacattcagcaaattgtttatagtagggatcatttaaatatgcattaccaatatctcaggttttagatttgccaaccctgtacgttgagattttccaggatcttataattgcaccggctagtggttctcccttgaataaactgcaagactttgcacttagctaaaaatgactcacctttgaaggtggtacgcattcattaaaaaaaaaaaaatcaagtgcgtgcagtgcactgtgcaccatgctaagcactggagatagtgttgagtgagacaaatgtagtctctgcccccatagaacttacattctagtggagtgagacagacaccaagaagcaaacaatacgtaatgaacaagattacatcagagtgataaacactggaaagaatataaaataaggaggatgtgatgcagcatgactgggggtgggatgggtgggccagcactagatagggcagttagggaaatcttctggaggaggtaacatagaggttgacacttacaagtttaggaagagctggccacttgtatctctggggacacagtatgctagcatcaggaacaccaagggtaaaagctatgatgtaggtacgtgcagtgttggagaaacagtaagaaagctgaacagcagggagcctattggtgtgtcttggcccatgcacacctcagggagtagtcaagaccatgtaaaaattaatttgttggctgggtgtcacacctgtaatcccagcacttcaaaaggccaaggcaggaggattgcttgagcccaggagttcaagaccagcccgggcaacatagggacaccgtacgtctacaaagaataaaaaaaattagctgggcatggtgatgcacacctgtggtcccagctactcaggaggctgaggtaggaggatttcttgagcctgggagatcgaggctgcagtgagctgggatcataccactgcactccagcctgggtgacagaatgagaccctgtctcaaaaaaaataaaaaagcaatttgtcctctctgtatgcatattgagaattattacataagttgggtttttattagccacgtgaagtttgggtgataaaaatttgatttcctacgaaattgcagagtacgtgtttctggtaccctgagttgtgttgatgttcagtgctccctttactctctgtttggcttcaagattgaacggtgctagattttttcatgcggatatttttgcgtacctgtgactccacagaccagtgtgcttgtgtgcaggatttggtgggttcatggttgtttattaaacaaaactaatcctatatagaggttttattcgtttgctagggttgctgcaacaaagcaccacaagctgaatggcttgaacgacagaaatttattgtctcacctaaatcaaagtgtcagctgagttgatttgttttcttttcttttttttttttgagacggaatctcaccgtgtcacccagactggagtgtagtggcgcgatcttggctcactgcaacctccacctccggggttcaagcgattctcttgcctcagcctcctgagtagctgggattacaggtgtgtgccaccacgcccggctaatttttgaatttttgtagagacggggtttcaccatgtaggtcaggctggtctcgagctcctgacctcagctgatccacccgcctcggcctcccaaagtgctgggattacaggcgtgagccaccgcacccggccgggattggttccttctgaaggcataggaagaaatccgttatgcctcttgcctggctcctggtggttggcgggcagtctttggtgttccttggctctgctgtatttcttctgccttcatgtttgcgtgtgttctttgtacaggtgtggccttctccaaatttaccctttttataagaatctaagtcatgtcggaataggtcccaccccgctccagtatggcctcatcttaactaatgacaactgtaatgaacgaattaccaaatgagtcacgttctgcatgtttttgtcctcctgaaattcctatgttgaaacctgataaccaaggtagtgttaggagctgggtactttgagaggtgattgggattagtgcccccttgttcctcccaccatgggaggacacagcaagaaggtgccatctgtgaactagggccctcacctgactctgaacctgctggcatcttgatcttggaattccaggccttcagaactctgagaaatacatttctgttgtttatgggccacttaatttatgatatttttttaagctgcctgaactgtctaagacactttctgagcgactgagggttaggacttcaacacaggagtttaaaaaaggggttttccagcgctagacaaattctaaaagagctgtaacactcagcataggaattttacaatggggacgcagttcagttcataaaagaggtgcatataatttggctaaactcattgtctctcacaaatgaaaatacggacaatacctgcaaacattttgaagctgtttaacccattttttgctcagacacctggaagccacggccccttttttatttaataacatctggtgtgtactgagcattggtaggctcctctgtgataagatcttgaatgtgtcaccttgttgattcctcataagcaccctctggagtttgttctgtgagcagcctcacttgacagttgagggaactgaggcttagttccagaaagaaccttcagctcatcaccgcagccctagtttcagcatgatttttcttactgctagagttgatagaatagtcacagccactagcactggagcctgccctagccactaatagcacctccacgtaaaaggtttctcattgtgaggttagtttcttatcttcctaattctaccacctagtccattcaatgcctcccttgttctttatccctgagtttatgtaatatgcagcagtactgagaagattaattagttaatacttgtgaagcactttgaggatgaaaagctcatgaacacttaaagttaaattaaattttgcctcctggtgccaagaaataaacagtctttctccttcctggttggggtcagcatctccccttggcccgcaggagagtgtgttcccacagagagcaggctgtattgattgtctccccaagacgaaggtcggaatggctactaattctcttttgaactagattggattctgcaaacaattgaacagctgactctatgctaagtggaaatgtgattgatattgaaacagaattaaaatttcaacttctagggaattaaattgagtgcaacttcagaaatttggagatgaatgtccaagtggtttgaaaagcaattttcatgttccactaagtatattaatatcaaaagtgatattgatgtttgagaacattgggctgcagttgtttccttgtccttttcatttattgccattttgacctaaggtttgtgccaggaagttcagcttcactcctagtgaatctgagtggcgtaatgctggccccgtcttgctcattgattttcctggtagccaaatccctgtacaacgaactgtaacatatcctcaaatgaactgcataaaagtatgttggagatggagaggagatctataaattcagaggacaaataaatcaaaaagtgaatgacttgtaagaattcataagccaaattcagagccaatttggaaactgaacctcagatttttccagggctgtattcattccttcccctgttggatagatcttctaagagccaccctcaactcgtgagtctgataattgcttttcagatggacagttaccttaatgaactctgactttatgtatgagtagtagtttgttgcacaggagttgttttcccagaaggtattgacctttattccagtctctactatgagcaaacctctatctgttgaatcagctcctggaacctcagctctgaataaataaagagcttaaaggtaaggaataggtgggtcagttcagccaagtaaggccagatagaattagagttgagagccaggtcagagttgagagtggggagaaatagccaggactatttggcccaggaagcctgaatggggacacatgcacacacacacacacacacacacacacacacacacacactgaaacactctgcaaaaattgaggtgtttcccaggttcctaacctcctgaatgcaatgcagattctttcctccaccttcccttcattgttcccatacaactctggcctgtaatcagcccaacctgggcctgggccttggccactactagatattctgttggcaccaagagtagtcaggaccagttttccctctcttaatttcctcctcaggagagttgagtgtttatcatattctcttcttttcctctctctttctctgttcagcttaggcaatcttccattctgcagtctttctcctagctgtgtatcttgagaggtaatgcaatgtaggttaagactgcctgagttgaatcctggcagtgccacttatgacttgaatgacctcaagaaagacatttaatctctttacctcagtttccccatctgtaaaatggggataataatacctatttcagtggaatgttgtgagagttaaacaagttgatatgtggaaagctcgtagggtgtggtctgtaatgtgttcaattagcattaattgaagagaagtggagtctccccttcaattcttacctgagtaacactggacaatttcatactttgttgtcactatttttctttagctcttactcttttttatccattcctgtagcactagtgatcaggataaaagacgtgattgctaatagagtaataccttgttgaatttgtgtaatgttccaggttggaggggggatgataaagcctaagaagaccaagtccttttttcttgcaactttaaattgttgtaggaaaggagacatgttgataatggtttgcagtataacatggaacatgctagactccaagtcgaaactgagattagagataggcgaatgaagatgacagtcaaccacgtgcggtgggcttgggggctgaggtgggtcatggagggctttataggggaggtgacgcttgagctagttttttttggtttcttttttgagacggggtcttactctgccacccaggctggagtgcatgctgccatcttggctcactgcaacctcctcctgggctcaagtgatcctcccacctcagcctcacgagtagctgggactacaggcatgcgtcaccacacccagctaatttttttgtacttttagtagagatgggatttcaccatgttgtccaggctagtcttgaattcctgagctcaagcgatccacctgccctggacttccacagtgtgggggttacaggtgtgagccaccgtgccccaccttgagctagttcttaaaggtgtgagaggttcaatgatagacactatcaacactcccagtacgtcacgtaattaaggtgagagtgctgctcagtagatttatcaggtatgtggtcactgatttgaaatctatgccaaagtcggtgcagtgaggtggggatgggagagcctgaaggcgcagacctgagaagagaaggagattaagagtctgtgatttttacatagttgggccctggaggccagggtcattacatagagtttgtgttaaaactttctggtagctagtgatgttgttgtggagaacctcagaagacaaaattaaaaactttgatgggaactgagacaaagtaaaaactaggcatactctactgctgagatccttactgtcttttaggactgcatgctttcatctttttctattttaacttctcttttattcttctcccctttgctcactccacagagctttgctgaacacctattatgtgccagatgcaggggatcccaagttgggttaaggcattatttcttccctggagctaacctcacccaaaaggggaagatagttgtgtgaagaactaattgacagtgtgaagtgtggctggtaatatagggagctgtgtgggaggaggaggtgtgtctgggctaagaaggcagggatggcttcaagatcttgaaagtcttgccacatggatagatagtgaccaggtagacagaggcactccagcaaaggtaacgcagcctgcaaaatcaaggagatatggaagtccatagtttgagtaaggaatgagccatgttgtgtggctggaatagagggagccaggtgtcaggcggatatggttccagatgaggctgaaaatgttgatgagggctctatgagtgtattaggcttttcttgcattgctataaagaaataccactgagactgggcaatttataaagaaaagaggtttaattggctcacagttctgcagtctgtataagcatggtgctggcttgtgcttagcttttggggaggcctcagggaacttttagccatggtggaaggtatgtcacatggcaaaagcaggagcaagagaagaatggggaggggtcacacgctcttaaacgaccagatctctagagaactcactccatccatcacctcccaccaggccccacccctcacactgaggatcacatttcagcatgagatttgggtggagacaaatatccaaactctatgaatggggcaggttctttgatgctctcttcaaggcgcatggacttttatcttgtagaatccagggggatcccatgaaagttttttaagctggaaagtgacatcattaaatttgccttatttttattttaaagaaagttaattttggtgacagtgtggaagatgtgtttccttatatttggccatataaaatataaaatttgatttttaaaacattttaaaacagtttctagtattctaacagtataacagtatgtttagatttataaacaaaggacattttatgtttttataagtcaactcatttttatgactacgttttcaatggaaaaatgaatattgagcgtcaacaaacaaaacattgtgtgacaagcttgtgcattgctgattctctgtgttggcctcatccataaactaaagcctcttaaactcaaatctctgatgccttttagaaatgccttttactttctttttgtgtagtaagagggatcatggaacctatgatctaaaaactgggaagcaatgatgccatgtgtctgcaagcataggtaacacagctgttttagagatgtctttaaaagggtacatgagtgttttgatatttgagaacagatcttccagcttgtcatgggagttgcatagttttagaaatcagtccttaaccttaaactttgttcacattgaactctagaatagcagtggtttttgaagagcagttgttgaatgcatttatgcatatttaatttttttgaatggctattaaagacctaagacaattatattcaggtttcaaggaaagaacttcttgtgggagtttaacatttttaaattgttggttggtggagggctggtatttactgatattcttgagttaatgagtcccaactataatagccacaattgtgctgcccttcactttggagaattgcgtatttttacactcatactttgaggcttactatttcagtatagaaaacaaatatagttgctgaaaaaaaatgattagatttcaaactttatctgaggcaaatgtgaggtcattaattagacttctttcaaacttcttaagttcccgagcctcatgatattatcaaattaaaaggacagactattgaaatgttaatttcagttcatcatgaatgtttgcacttctcataaaatagccatttctgtgttaaaaatgtcttataatctgtgaatagcatttaagaaagcaatgtgaatgtgagtgtatttaaaatcatcctctaagtaatgcttttggaagccagtgtacagtctgacctaacaattacaagtagaccatgtaaccactcattgaagatgaatgatgtttttatgctacaagaattaaagactgtttcttaaaagaaaacaagagactgcttttttagtttttaaccacctgtacagcaaatcatgaataggagaatctgaatgcctgatagccttctgtattattttgcttatttatatatttattttacaataaactttaaaatgatatttaattctacagtagctgtggatagatcaaccacattctgtataatctagatttttcttaaagctcccttttcttgccctatcaattacttaccgtccatatttggccattttggggagccaagttgtccccacgtatcagtggtgataaatggatcagaagaaagttgatcaaatccaagtgtgtttttatatatgatgcatcagttatctttgacacatagcagttccaaaacctcaggcagacacaacaagaagtgcttttttgtacatgtgtctgtggtcacagaggttctgctgatcttgggtgagcttacccatgtgcctgagggttggcttgctgttggacagagtgaggtgactgaatgacttggctctgctccatctgtctctcattcttcagcagttgtggcaatgacagtggctctagagagctagccccgtgcacaagtccgtgaagcctttgtttgtgtcatatctgctgaccaaagcatgtctctttgggctgagtccaaagtcaaggggcagagccggcctgcccacctatggtaaattggcattacaaagtttcatgtcagagggcatggatacaaggaggagtgaagagctgggactaaatgatgcagttcactacataagatttagaatttttattgataacacgtaatttcacttctttttctttttttctcttctcttctcttccctttttttcttttgtttctttggaaagggtcttgctctgtcacccaagctggagtgcagtggcatgatcacagctaactgtagccttgacctctggggctcaagcaatcctcccgtcagtctcccgagtagctgggactacaggcacatgttaccacgcctggtttaagtttttaaaattttatgtagaactgctacattgcccaggctggtcttgaactcctgggctcaagcaatcctcctgcctgggcctcctaaagtgctgggattataggtgtgagccaccacacccggcctgatttcacttcttacctaccacacgtgttgtctcccttctttaggccttcatcagggaatatttgggggtaaagaacagaaacccactcaagttgcttgaagattaccataaacagaacagggaagctcacaggcctataaaaataggaaacctagaatgggcaggtctcaccagaactgggactgctagatgttagactttgagacccttctttcatctctgctcctctctgtttctccccctctgccccactccctactcttatgaccccttgtggccacatcaattttaattgtatgcagttgtgtggctcaagcacctactatgaatttagggatatgaattagacctcactgtctgagtctaattcatttccctaaatcctagctcatggattagttattcctgagtctacttgtgagtctcctagagctgagtgctcagtcttcatctctttctttactttgcttattgagcgggtccagccctatgacttgaaatgctgtcttgatgctgatgactcataagtttctgtcttcagcctagacttctcccttgaactccagactcacatatactacatcctactccacatgtccatttggatgtatctcataggcatctcaaacttacacccacatagaccacttgatttcctcctcataatttgcctctcccagtcttttctcagtaaatggcaatttcagttttccagttatttaaatgtcggaatcaaatccttggttaaatattcatactttaaaattatatgcatatattatagttctaatatagtatatatattataaaagaacgcaaatttgcaagcttcatgtgacactgattaagtaaactagatctttaatgtctggctaattaggatgcttcatatttttatttactaatatcacaagcataatagataatgtgagtttcattttttaaaaattgtggtaaaaacagataatacaaaatttaccattttaaccatttttaagtgtaaagttcaggagtgttaggcatattcacattgctgtgagacagatctccagaactttttcatcttgcagatctgaagttctgttcgcattaaacagtaagtccccttttcctgctcttcccagctgctagtaactaccattctacattctggtgtctatgaatttgactactttagatacctcatataactggagtcatattgtatttgtgtttttgtggctggcttatttcccatagcagaatgtcttaatagttgatcagtgttgtagcatgtaacatgatttccttcatttttaaggtgaaataatactccactgtatgtgtacaccatgtttggtttatccattcatttatcacggggcatctgggttgcctctaccttttgacgattgggattagtgctgctatgaccatgggcgtgcaaatctctttgagaccctgcttttaatttctttggctatataccagaaccggaattactagattatatagtagctctacttttgattttttgaggaaactccatactgttttccattacagttgtttcgttttataatctcgccaacagtgtacaagggttctaatttctccacatctatccaaaccttggagtctttttttggcttctctatttcatgccctaatctagtccctcagtaaatcctcttgacttatatttgaaatatatcctacatctgactgcttcccatctatcactgtcacctttttctgagtcaccattggctcttgtctggactatgatactagtcttctcactggtctcctggtctcaatccttgcccccctacagtctgatctccatagaacaaccagagtagtaatttaagaatataagctacatattgtcattcctctgcttaaaactttctaatgactcccatcacacactgaggataaaattcaaagttgtttccttggtttataatgtcttaaaaattctcattcctttgcttgcctggcttcagacacactggtttttgtacttgccttaaacacactaagattgtccctgcctcagggcctttgtcctcgatgtttcctccacctgggtgtctgtattcacagacatttgcccttcacagaggcctttccaaacagccttctcttaaaaaggtactcactgtcaactttttctattctcttaccgtactttcttttcctctgtgcacttgccactttctgacatcgtagtgtatttatttgtgactttcttatggctgttttccccaagagaatgtaaacaccatgaatacagggattctatctcagcatctgaaagaatgtctgatactgaaaagatgctcaataactatttgtggaatgagtgcgtaaaataatattttgtagccatgtgtttaagcagctttggccatggcgacagaggtgccccatgtacacatggcgccttaggtggaggtggttgcccaggaaaatgctgtaatctgtctaccatttctagccaatttctccagctagaaataatttatgggctattattgttcatgaggtctaagtgggaaagtatagatgccttatcttctttttttttttttcagcctcttattgaaaaaaaaattcagggattgatgggaattatttgcctctgcccttttggccccagatcatccttcctgagtcttggctgctccttattacctgcagtcacatttcctgttgtaatgtgagggcaatgcttcgtttgcacaatgaatgccagaaatggattttaaagcattataaagcaaagccagaaattcctcctgcaggggagatggtcggttgacaagtctgtgaattatataatagaatctcctcttactctccttgtaaaatataccaaaatatcaaaaaacaatgggcttttcttcccagtttgtttgggatcatactggcatcctcctgtattttggggctgtgggattagaatcatgtataacggctttgttttcccccggctaggtttgtgatgaagttgttctgatggaaacagtcagttaattctaaaggatctgcacacgcttgctgagcagagtacttctaccttaaatggtcttccatgctgtgggagagagctcctgatgcgtcagtcacagtgataatgtcatgggattggaacatcaattttgcctgttcccaccgcctcatggcctggagaagtctatttcagtcttactagtctgttagaagcaacagtaattaaaatggatctgcaggcttctggggtctttggataggtagccagaggtctatcaattgcaagagattcaaagatgattgcaaatgcagtgtgagggacactccctgaggccctcctagagtgcaagtgatgcttggctttttgtactggatggtgcttacacatgggtgtacgtttatgaaaattcaggttctctacttatgatttctgtacttttcttgcaaatatgttatattttagtgaaaaagactttcttaggaaaacaaaccaaccatagtttctacctgcaagaagatctcctggtggagatactcaaatagaagatcacacagtcaacttagtgccaagattaagcaaagcgtattatgggagcacaaataaaagagatcacactcatctttgggggaggatagaggaaaaccagagagaaggtttaaatgggatttatctatcatcttttcctggcttcctccatatagaataaggatttatatgaggaaaccagagtaaatgggttcaatcctgattctgtggtagcatgcttggaagttaaaatatgcttggaagataaaatattgccttaaaaagcagaaaatttattaaatatcatcaccctcagggagtttgttgatgattgtctctccagacctgtctcactgttggcatggataactagattgatgaatgactaagagctgaaacacaagactgtgtatttctcatcaatgtgttttgttattgtgaaatatttaatattattaagagctggcagtgaccctgtgttggaggagggtagggtgtgtttgtgtaagagcagtgagaaagtaatggctaaaaaaagttgatgtcttctttaaaaaaaaaaaaaaatgttgccagcagctggatgcagtgtctcatgcctgtaatcccagcactttgggaggctgaggcagaagcatcgcttgaggccaggagttcaagacaagcctgggcaatatagtgagacctcatctctacaaaaaataaaaaattatctaggcatggtgatgcatgcctgtagtcccagctacttgggtagttgagacaggaggatcgcttgggcccgggaggtcgaggctgcagtgagccatggtcatgccaccacactccagcctgggtggcagactgagatgctgtctcaaaaaaaaaaaaaaaagaaatgtggctggtgataagagatttatagtctaatgaggcacaaagtcgttttattgtttgttttctttataatgaatgaacaaaatcataataggcaataattaatataggaaacattgcaaggtggtataaaatgaatttctttactgttaagtacattgagctcatagaaggaactgatgaatagggaatggaactgctgggcgattggagttgttagagtagatagtacccaaattggtctttggacaaataggttggaaccagacctgaatgtgcataagaatatcttggtaacaagttaaaaatgtagattcctgggtccaacccccagattctgtgggtctgaggtgaggccttgggttatggatcttcacaaagaggtttaggtgtaggtggttcagacaataccatgagagataatgactaggagtcttggcagggagagagggcaggattggtggaaggcaaatgcttggaagcaaaaaaggatagcattcagtgaagaggcagactcattcctgagacagaaaaagaaaatttatctagaaacaataaatatgccaggcagctcctagcgttggacggactgatggcaaaacgggtcatggcaatggagcccgttatccgtggaatgctacaatctgtagctaatgtttttatttgcaggttccttcagaacgaagtcaatatttaaatgaaaatataattcttgaataatttgcactttaacatgtggaggctggaacataccttaaaggttattttcctattcaaccctgtcatttaagagaaaggaatgggaggtagtaattcatgagggatcagcggagatttggctgaagttcagagatttcctgaagggtcataaacacttatttgtttattcatcaaaacttattaagcacctcctctaaacacccagtcctgggctagaccccgggatcctgctgaaaagaagaaaatcaatacagccttgcctttgggagttgacagtctaatgaaggtgtcagttgtagaacaagtatgggaatttttcctacaatgaattgtgttccccacgctgccagttatatgtggtagagttgcattccacagacccccctactgaatacacttttattgaaatgagggccctgggcacatgatgacacacgatggcacaggacgagccacacggctctctgtgcagctgcagtgtttgaatggctttctagttggccctgagttctttcattgtatgcaatctgctgtgatttatttggatcgtgtacagcagtgctttttaaactttaatttgcaaggccatcacccagggctcttgttaaaaatacagattctgtaggtctagaataaaaactgaggtgccctgtattttcaccaaacttgcagggatgctgacgttgctagcaggcgaaccatgctgactagtgctagatgtctggagagagcagaagtcttttgggtcactgaagatctcctaaattgagatcaggttggtttttgttagtgttgatcaactgatttgtattttttcagcttatagccacaaggcctactatatatagtagcttataataacgaggtgcattataactacaataatacctttgctgttgaaatttgtccagaaaaacaactttatgatggaaagtcgtgtcctctgtaacctctaattcttttgtacgtcactgaaaaaaggataacattttggataaaacaaaatttcttgacttcgccaactgtcacaaaatagcagaacagactgtaattacaagtgtgacaaacgtgataaaggaaatgaggctagggctgtctagattggggtcctctaactgtagttatttggatagaggccatattggtttcttgttctgctctcccccacctcaatcttacattactgcataagttggcataggctggcacagaaaatcttgaaggatagttgcatttttacctgaagctcatccagcaaccagtgccagtgaaactgtgcattctatactcatcttgaaatattagcccttccagctcatagtttgtttatagcaagcaaaaagagaaaaaggattactttcagattgctataacgcttgacaccattgggctttttaaaggttgtaagtgaataaattgagctcttgtgtaggcatgtttctttttaaaaatggtttgatatgaggttaaaaactaaattatgtaagattctatagaaaacattttttttctgccactttttttattttttggtttctagagtgatctttttcctctcttttcttttgagtgacagtatcagagaatgcaaaaatcataggagggagcggttcggtttgacctgatggattaattgtgtataggcctctgcattcaaatgaggagttgtgtgtctgacaacaaagttgctattccaagttgctttgccagtgagaatttttattgtgtgtgtgtgtgtgtgcatatacatatatatagtgtgtgtgccagtgagaattgtggagctcataatgtcccacagccagaaggggctttagtgcttagcctgaccagctggtcctgtgttctgtgatgagcttcttcagtatttgagttaccattgttcatagagccacgtgctaagtgctcctccaaccaacgtttgtgtatgagatttaaacgtggttggcgcgctcatgattgccatactgagtttccaaggaacaatgaaggagggctagatgactgcacctctgaaagttgttcttattgttgatttttaatttattttggttttatcttgtgtgaacacacaacccttacactggtccatgtagacacatagcaaacgaagtaaacagtgagcttcacgttgtcattgagagagggggccccacagggtcaaggcatcttttgtttttttatcttgtcgttctgaggcttccaaaatactgagtagaacaaaaattccattgacccatgtgatattgctgattttgcttccaggcgaggctgttgtgacgtgaacattctgatacaaagaagcaccatttgggtattgacttaacgtagcaggctcagggtcaccttacctgggtctcagttccggccccatagctcatcagctgtgtgacattgagaagattacttaacctcttccagctgcaatttcttcttctaaaagatgtgtcgttgtgatgatgaaacgatattgtccagtacatgcatagtacctagaacgttgttactgctacattgtagcaatacgattgagcatttgctgatccctgtaaatattagttatgtaattttgatgataatttcttattaatatcaataaatatttctaaatacttgttactaaatggctgaatatgtatatatgtataacatatattatacagcttaaacattgaaaataatagattagaggaagtatgatatagattctgtaacctgatcaagagctatcttcatggaaattaattttctacctgcaggttaaataactctgaaattggtttctggctttgcttagagaaaggaaatattggttaatcaatcacaagttgagtgtatccatctttggtggtttccctttaaacaaaaagcctgttacggatcttgcttcctttccgtaggaaagttcattttagaaagtatattgagtcagggtttttgtttattttaatgatagagaattgaaaattggcattatcagatggcatgatgggttctttctggtgctgtttgaatcagggttagacagagactttgtgggactgttctccttcattgcattttctttatagttccatcccccaaagattccaggcatattatatctgtattgcacaattagatctaactgtattttgaatgttaaattcagccttaaaaaaaacctttattagccaggtgcggtggctcacgcctgtaatcccagcactttgggaggccgagacgggtggatcacgaagtcaggagatcgagaccatcctggctaacacggtgaaac

SEQ ID NO: 1383 - DNA, 9517 bp, Homo sapiens
gttgctgtcggagagagaaagccgcacccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctccgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcaccgtgctgagtcacgggctgcggagcgggggtggagtaggagatgtactcaggaaaccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatcgatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaatgaaatcttttatatctgttgcctagttttgtacatggatctcattttacaagagaatctctctgcta

SEQ ID NO: 1384 - DNA, 8088 bp, Homo sapiens
atgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctccgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcaccgtgctgagtcacgggctgcggagcgggggtggagtaggagatgtactcaggaaaccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataa
